United States Patent 10,696,975 (GENES AND USES FOR PLANT ENHANCEMENT) - sequence listing, part 15

SEQ ID NO: 65857 - protein, 264 aa, Oryza sativa Indica Group
LGANYRLIDIPVSNCLNSNVSKIYVLTQFNSASLNRHLSRAYGNNISGYKNEGFVEVLAAQQSPENPNWFQGTADAVRQYLWLFEEHNVMEFLILAGDHLYRMDYQKLIQAHRETDADITVAAPPMDEERATAFGLMKIDDEGRIIEFAEKPKGEKLKSMMVDTTILGLDTERAKELPYIASMGIYVFSKDVMLKLLRQNFSAANDFGSEVIPGATEIGMRVQAYLYDGYWEDIGTIEAFYNANLGITKKPVPDFSFYDPSAAI

SEQ ID NO: 65858 - protein, 463 aa, Prochlorococcus marinus str. MIT 9215
MKSSDKFHLEDIYKLKNTVITGKTEDIKWRIKQINIVSKLLDENKKEIIKSLFIDLGKSEIEGLSEILLVKEEISLIKKKLNSWMRPKEIDTPFYLFPSSSKIIYEPLGCVLILGPYNYPLLYVLKPLVNIFSAGNTAVIKPSEKCPATSKLIKKLTSKYFHKEVLLTVEGDYKQSIKLVEQHFDHIFFTGSTKTGKSIMKLASKNLTPLTLELSGTNPVIIFKNANLEVAAKRIVWGKFFNSGQSCVAPNHIFVDKEIENNFIEKLKKCILSFYGENPITSENLSKLEKKQFSSTVEILKRYKKEKRILYGGTFNKKTLKISPTIMKAKLDETDILQKELFSSLLPVIGIKNKESALEQINQTSKPLAIYLFGGNKKIHNHISKVTSSGSICINDVMLPVLIPNLPFGGVGKSGIGKFHGEEGFRNFSNQKSITFKGFLFDLDLRYPPYERIKKFLKIVFKI

SEQ ID NO: 65859 - protein, 268 aa, Mycobacterium avium 104
MVNELAGKVAIVTGGASGIGRGIVERFVAEGARVVIADIETERGERLAAELGGEAVFRRTDVSDIEQVGALVAAAVEKFGGLHVMVNNAGISSPLRRLLDDDLADFHRVMGVNVLGVMAGTRDAARHMADNGGGAIINLTSIGGIQAGGGVMTYRASKAAVIQFTKAAAIELARYDIRVNAIAPGNIPTPILGKSAGDMDPEQRERFEARIREGMREDRPLKREGTPDDVAEAALYFATERSRYVTGTVLPVDGGTSAGKAMRSKRQG

SEQ ID NO: 65860 - protein, 333 aa, Wolinella succinogenes DSM 1740
MRRMPAEWERQSAVLMAMPHEESDWYPYLEEARENFIQIIEEITKRERCLLLVDDWKLYEERLGHLSNLIPLELLTNDTWARDFGPIGIEENGKKRLLDFGFNGWGLKFASFLDNQANRALARKGIYQVPLETKNLILEGGSIESNGAGLILTNTQCLLEANRNPEYSKEKIESILTQELGAKKVLWCHHGYLAGDDTDSHIDTLARFVGENRIVYLKCEDESDEHYKELKQMEEELKELRGVDGEPLELIPLPFTKAIYYDGERLPASYANFLFVNGAVLLPIYGDEKDQEAIRTMKRACPNHEIVPIDCRVLIRQHGSLHCVSMQLVEGMV

SEQ ID NO: 65861 - protein, 468 aa, Propionibacterium acnes KPA171202
MGHRPPIAYTRKGEPLLNKEFTVDVLVIGWGKAGKTIAGRLAAEGRKVALVERSAQMYGGSCINIACVPTKDLIDSASKRDGRDPASYFTSAVADRDTLIATLNRTNHAMLEGKVLLLDGVASFTGPHTVKVVAGDDEITVRAETIIVNTGSHPANLPVPGADGPRVHDSTTIQHVDPLPSQLVIVGGGFIGLEFAQMFARFGSQVTLLEAGETFVPALDTDIAERVRNMLEGEGVTVVTGAQVTSCDETGDHVDVVTDDQTFAADAVLVAAGRRPATEDLDLTAAGVATDERGYITVDDQLRTNIDGVYAVGDVNGGPQFTYISLDDNRVLWDTLHDGPRRRDDRVAVPATTFLDPPLSQVGMTMRQARESGRSVLVATKDVATIAAMPRPKIVGQTEGVIRVLVDADDHTVLGATLWCIDSQELVNFVSLAMRLGVRYETLRDGIWTHPSSTEAFNEVLGVLEPLT

SEQ ID NO: 65862 - protein, 303 aa, Pantoea sp. C1B1Y
MMTVCAEQHVNFIHSDAASLLNDIEQRLDQLLPVESERDLVGAAMRDGALATGKRIRPLLLLLAARDLGCNATPAGLLDLACAVEMVHAASLILDDMPCMDDAQLRRGRPTIHCQYGEHVAILAAVALLSKAFGVVAAAEGLTATTRADAVAELSHAVGMQGLVQGQFKDLSEGDKPRSADAILMTNHYKTSTLFCASMQMASIVAEASGEAREQLHRFSLNLGQAFQLLDDLTDGMADTGKDAHQDDGKSTLVNLLGPQAVETRLRDHLRCASEHLLSACQDGYATHHFVQAWFEKKLAAVS

SEQ ID NO: 65863 - protein, 386 aa, Vibrio vulnificus YJ016
MSELIQNVKTSFEQVLGYAPSHIIQAPGRVNLIGEHTDYNDGFVLPCAINYQTVVAAAKREDNLVRVVSVDYGNAVDEFDITQAITFQQDKMWANYIRGVVKCLLARGYAFTGADISVSGNVPQGAGLSSSAALEVVIGQTFKVLFNLEISQAEIALNGQQAENEFVGCNCGIMDQMISAEGRENHAMLLDCRSLETESVSMPEEMAVVIINSNKKRGLVDSEYNTRRQQCEEAARIFGVKALRDVTIEQFNEKVAELDEMVAKRARHVITENDRTVEAAQALRAHDMKRMGELMAESHASMRDDFEITVKEIDTLVEIVKEVIGDQGGVRMTGGGFGGCIVALVPPALVDDVKATVAAKYQAATGLKESIYVCQAKDGAGLVEML

SEQ ID NO: 65864 - protein, 68 aa, Triticum aestivum
MTTSRRLADRKSAKFQKNVTKRGSVPETTVKKGNDYPVGPIVLGFFIFVVIGSSLFQIIRTATSGGMA

SEQ ID NO: 65865 - protein, 339 aa, Vibrio vulnificus YJ016
MNVLVTGGMGYIGSHTCVQMMAAGMEPIIVDNLCNAKVDVLSRIEALTGKQPTFYQGDIRDEAFLDSVFAQHDIQAVIHFAGLKAVGESVAKPLEYYDNNVNGSLVLARCMRKAGVKSIVFSSSATVYGDPQVVPITEDSPTGATTNPYGRSKYMVEQCLSDLFHAENDGSITLLRYFNPVGAHPSGSMGEDPQGIPNNLMPFIAQVAVGRREKLSVFGNDYPTPDGTGVRDYIHVMDLADGHIAALKSVGKTSGLHIYNLGTGKGSSVLEMVEAFAAACGKPVPYELCPRRPGDIAECWASTEKAERELGWKATRTVAEMTTDTWNWQSNNPNGYSPA

SEQ ID NO: 65866 - protein, 170 aa, Lactococcus lactis subsp. lactis
MELKDYIATIENYPKEGVVFRDISPLMADGNAYNYAATEIVQYARDKEIDMVVGPEARGFIIGCPVAFALGVGFAPVRKPGKLPREVIEATYEKEYGTDTLTMHSDSIKPGQRVLIVDDLLATGGTIAATIELVEKMGGIVVGCAFLIELDELKGREKIGDYDYKVLMHY

SEQ ID NO: 65867 - protein, 542 aa, Yarrowia lipolytica
MIYTANSSPSTNLQWLSTLNTDDIPTKNYRKSSIIGTIGPNTNSAEMISKLRQAGLNIVRMNFSHGSYEYHQSVIENARESEQRFRGRPLAIALDTKGPEIRTGVTKDDKDWDVKAGHVMLFSTNPKYKDQCDDKIMYIDYTNIVKQIDIGKIIFVDDGVLSFKVLEKIDGETLKVETLNNGKISSRKGVNLPGTDVDLPALSEKDKADLKFGVEHGVDMIFASFVRTANDVQAIRDVLGEKGKGIQVISKIENQQGVNNFDEILKETDGVMVARGDLGIEIPAPQVFIAQKQLIAKCNLAGKPVICATQMLDSMTYNPRPTRAEVSDVGNAVLDGADCVMLSGETAKGTYPIESVKMMHETCLVAEKAIAYAPLFNEMRTLTVRPTETVETIAISAVSASFEQQARAIIVLSTSGTSARLCSKYRPNCPILMVTRNAQAARFSHLYRGVYPFIYHKARASNPAEWQHDVEERLKWGMDEAVALGILNKGDVVVAIQGWTGGLATPTLSEFSSVSKLFNTNLLDYKTYSMVIKSVNGGVLYK

SEQ ID NO: 65868 - protein, 332 aa, Physcomitrella patens subsp. patens
MENSTRRVLFVLGALLIFLSCAMIPRGRHNVHKHDVLYNRTKALSLVEYASAVYSVDDVSLLAWNCSRCQGLNKDFKIHSLIVDVQHCLQAFVGVAEDFNSIVIAFRGTQKTSMQNWVEDLYFKELDLNYPGISDAMVHRGFYAAYHNTTLREQVVAAVQSIKQLRSDLEVTITGHSMGGAMAAFCALDLTVNYGVKNIEVYTFGQPRLGNAVFAAFYIATVPRTIRVTHAHDLVVHLPPYYVRMGEKTYHHFPNEVWLYKISVDRLHYEFEQICDSSGEDPYCSRSVSGNSVADHLNYYGVYLRTVDKVLASISDSTNSSTELGYCRTEVK

SEQ ID NO: 65869 - protein, 218 aa, Saccharomyces cerevisiae
EGEEGSRKTHESKTVVVDDQGKPRFTSASKTQGNKIKFESRKIMVPPHRMTPLRNSWTKIYPPLVEHLKLQVRMNLKTKSVELRTNPKFTTDPGALQKGADFIKAFTLGFDLDDSIALLRLDDLYIETFEVKDVKTLTGDHLSRAIGRIAGKDGKTKFAIENATRTRIVLADSKIHILGGFTHIRMARESVVSLILGSPPGKVYGNLRTVASRLKERY

SEQ ID NO: 65870 - protein, 354 aa, Prunus armeniaca
MGSVRASHELLQAQAHIWNHIFSFINSLSLKCAVQLDIPDVIQKHGQPMTLSELVSALPISPTKAHFIPRLMRILVHSGFFAKESLSGCGEQGYILTDASALLLKDNPMSARPFLLAMLSPILTDPYQYLTTWFQNDNPTPFHVVNGMTCWDYVNQDPTLAHFFNDAMASDAQLISSLVIDDCKEVFQGVDSLVDVGGGTGTVAKSIADAFPHMKCTVLDLPHVVADLKGSKNLEYVAGDMFEAVPAADAIFLKWILHDWSDEECVKILERCKAAVTREGKKGKVIIVEMTVENKNTDKESGETQLFFDMHMMVMSTGKERNEKEWAKLFSDAGFSQYKITPLFGFKSLIEVYP

SEQ ID NO: 65871 - protein, 152 aa, Debaryomyces hansenii CBS767
MSNNERTFIAIKPDGVQRGLINSILGRFENRGYKLVGIKLVQPTESLLREHYDDLQSKPFFPSLLSYMLSGPVLATVWEGKDVVKQGRAILGATNPLQSAPGTIRGDFAVDMGRNVCHGSDSVESAEKEIGLWFKKEELVDYKPALFGWIYE

SEQ ID NO: 65872 - protein, 412 aa, Lactobacillus sakei subsp. sakei 23K
MGKSLNTSRQDFPILEQLVNDEPLVYLDNAATTQKPQAVIDQIVSYYQHDNANVHRGVHTLAERATAQYEAARVKVQQFINAASSAEIVFTKGTTQSLNWIAGSFGPTVVQAGDEIVISYMEHHSNLVPWQQLAKKTGAKLRYIDLLPDGQLDLDAAKQVIGPRTKIVSLAHASNVLGVVNPVKTIAALVHVQGGYMVVDGAQAVPHMPVDVQALDADFYAFSGHKMLGPTGIGVLYGKQALLEQLSPVEYGGEMIDFVGLQESTFKELPWRLEGGTPNIAGAIGLGAAIDYLNQIGMTNIQAHEQALVAEALPALQAIDGLTIYGPQEASQRTGVIAFNLDNLHPHDLATALDMEGVAVRAGHHCAQPLMQWLNVAATARASFYLYNTSEDVQALVAAIQAAKEFFQNGTL

SEQ ID NO: 65873 - protein, 650 aa, Debaryomyces hansenii CBS767
MSVNDNLFNDQNNDMLDANDEDEEMEDTENNNNLYGEEDEEEENEEDDENNEDDDEEDEDDDDDDEDEDDDDDDENEEGDEDEERAKFLDARESNVSELQEDANKDNDHMIVDKSDSANDEQRQKEADAQDSSKTKSELDQEEAEEHVSRETIRENSIIKAKESSEFDIIPSVAIPYTSECHALAFTDGPKWILTGGEDGFIRKYDFIASIEGKSPLTMAQRHNLVDSITKAGVISSYWENEQPLTKKQLMETNPKLKISDFSTGSVSYEPKVNPVYSLDVERNGYWCLSGLSSGGISLYTMRYNEGNIHHYFNHSPKKQSAALDNGHNDAVSVLKLNSEQKKFLSGSWDKSIREWDLNTGKCVNLFTGSSGQISNIQYRPEGLADFSLSYEDSDIKIVDQDIKPESDIDSLFGDSDNENNEERKNFESQDKPNSSKITTNDFKATNKTFSNDSIFMSSSIDGTINLWDVRVSNTTSSPVLRFGVSDGIPPWCMSSTWSNCGEYIYAGRRNSTVEEFSIKMPHKRSKSGHNKDTMVPNVLKLLQFPKISGPVSAISTLPNNDFILCGSNDNIRLYNLNLYNDLSKTSSTTNKKPATPFMIIPGHHGGILSALYVDETGRFMVSASGNRGWGHANFTESVLIYEIEFENDN

SEQ ID NO: 65874 - protein, 351 aa, Physcomitrella patens subsp. patens
MLISKDLLELDGHPPNGAAARKPDHRHDRYDISRGKERVPISLSALGAEDLPEEFFYTKSSVVFQSAHVGISMARIGEDDRCSGCVGNCLDKLTPCECARLTDGEFAYTVEGLLYPHFLKQELDRKRNLSFLSFCLPGTCPVERTGDEPCKGHTQRRFIKECWEKCGCKQLCGNRIVQRGITARLQVFWTGGKGWGVRALDYLPAGTFVCEYVGEILTNTEMWFRNNESHRSAKHHFSLNLDADWCSERYLKDEEALCLDGTCYGNVARFINHGCFDTNLLEVPVEIESPDHHYYHLAFFTSKDVAANEELIWDYGLDFNDKDHPLRAFECLCGSDFCRGKSLGGNSWHKS

SEQ ID NO: 65875 - protein, 63 aa, Pleurochrysis carterae
MRGILVDWLVEVHLKFKLMIETLYLTVNLIDRYLEKEKITRNKLQLVGVTAMFLASKYEEIYP

SEQ ID NO: 65876 - protein, 521 aa, Wolinella succinogenes DSM 1740
MSIQLHDKVSLLILDFGSQYTQLIARRLREYGIYCEIVPYHEKLEAIKAREPKGIILSGGPASVYEEDAFLIDKAVFELGIPVLGICYGMQLMTHYFGGVVAKAEHHEYGKAEVIFDALEGSESKLFEGCHSGKVVWMSHGDKVEKLPEGFTRIAHSTNSPFAAIAHQEKPFYAVQFHPEVVHSEEGALYLKNFALGICGCENDWNMHNFAEEQIKKIQERVKSGKVLCAVSGGVDSSVVAALLYRAIGEKLIPVFVDHGLLRAGEREAVEKMFKENLHVPLITVDASEIFLGKLKGVSDPETKRKIIGETFIEVFDVEAKKHDGIQYLAQGTLYPDVIESVSVKGPSKTIKSHHNVGGLPDWMTFELIEPLRELFKDEVRALGAELGMPREMLMRHPFPGPGLAIRIMGEVNFEDLELLRKADVIMLDELKKSGFYDKTWQAFTVLLNVRSVGVMGDNRTYDNTVCVRVVEAIDGMTATFAHLPHELLERMSTRIINEVDGINRVVYDISSKPPATIEWE

SEQ ID NO: 65877 - protein, 227 aa, Oryza sativa Japonica Group
MAAEMEVDDVDVHEVPECIASMIDRGSVESHRLFLARRTAMEMLRDRGYSVPEAEIARTLPEFRAWWAEKPGIERLAFTTTLVSDPSKKVQLVFCPPEPVKIATIREIYLQTKEENLSRLVLILQSKILSRAREAIKEIFKFKVDIFQATDLLVNITKHVLKPKHEVLSADQKAKLLKEYNVEDSQLPRMLETDAVARYYGFDKGTVVKVIYDGELTGKRVAYRCVF

SEQ ID NO: 65878 - protein, 312 aa, Xanthomonas oryzae pv. oryzae KACC10331
MTDKIPLLIDTDPGVDDALALLMAFNDARHEVVGLTIAAGNVGLEHTVRNALKVCEIAGRADVPVYAGCSQPLLHPSVDAAHVHGLDGFGDVGLPPAKRTAEAEHAALAILRLSHQHAGKLLLVALGPLTNLALALILDPTLPTRVARLVVMGGALTGHGNITAAAEFNIGFDPEAAHIVFRGFPQFDVADWEATIAHGLLHRDVEQWLVADSARARFYEEISRKTRLRSKDSRGAYWCAADALAMAFALHPEGAQRLEQRPVHIELSGTHTRGMTLVDWNRQGGASDNANLLLAYDIQQFYGLVGAALAAN

SEQ ID NO: 65879 - protein, 265 aa, Burkholderia caledonica
DDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSRNVIGIDASAKPEQTKAQILRIARHTAELVELGREITEEDVVLDTRFAYPEYGLPNEGTLEAIRLCGSLEGVLTDPVYEGKSMQGMI

SEQ ID NO: 65880 - protein, 187 aa, Propionibacterium acnes KPA171202
MSLINTKILPFKANAFRNGDFIEVSDSDINGKWAVFFFYPGDFTFVCPTELGDLADHYEELQAMGVEVFSVSTDSHFVHKAWHADSDTVGKVNYTMIGDPNLQLTRNFDVEREGAGQADRATFLVDPDGVIQFYELTAEGIGRNATELVRKVKAAQYIYTHPGEVCPAKWEEGDETLAPSIDLVGKI

SEQ ID NO: 65881 - protein, 265 aa, Pseudomonas fluorescens
EDCNCGFAFGGNKTRKLEYLIPEALAQGCDTLVSIGGIQSNQTRQVAAVAAHLGMKCVLVQENWVNYSDAVYDRVGNIQMSRILGADVRLVPDGFDIGFRKSWEDALESVRAAGGKPYAIPAGCSDHPLGGLGFVGFAEEVRQQEAELGFKFDYIVVCSVTGSTQAGMVVGFAADGRADRVIGIDASAKPAQTREQITRIASRTAEKVGLGRDIMAKDVVLDERFGGPEYGLPNDGTLQAIRLCARLEGVLTDPVYEGKSMHGMI

SEQ ID NO: 65882 - protein, 317 aa, Desulfitobacterium hafniense Y51
MPKIADNLTDLIGKTPLLRLNRYSKGKNLFAEIIAKLEYFNPQSSVKDRIAYAMIEDAEKQGAIDQDTTIIEPTSGNTGIGLAFVAAAKGYRIVLVMPDTMSVERRRLLRALGADLVLRPGTQGMGGAIRKAEELKEQISKSFIPDQFSNPVNPSFHRETTAKEILEDTEGKVDVFVAGVGTGGTVTGVGEALKAVNPGIKVVAVEPYNSPVLSGGQPGPHAIQGIGAGFIPKVFNSSFVDEIFQVKNEEAFEASREVAKLEGLLVGVSSGAALYAATRIAARRELEGKKIVVLLPDTGERYLSTPLFPYDEGSNHF

SEQ ID NO: 65883 - protein, 116 aa, Vitis vinifera
MSRSLGIPVKLLHEAAGHVVTVELKSGELYRGSMIECEDNWNCQLENITFTAKDGKVSQLEHVFIRGSKVPWLIPDMLKNAPMFKRLDARVKGKGSALGVGRGRAVAMRARDETLE

SEQ ID NO: 65884 - protein, 264 aa, Burkholderia cepacia
EDCNTGFAFGGNKTRKLEYLVPDALAQGADTLVSIGGVQSNQTRQVAAVAAHLGMKCVLVQEHWVNYEDPVYDRVGNIQLSRMMGADVRLVADGFDIGIRRSWEEAMESVRQSGGKPYPIPAGCSEHPLGGLGFVGFAEEVREQEAQLGFKFDYIVVCSVTGSTQAGMVVGFAADGRADRVIGIDASATPERTHEQITRIARHTAELVGLGRDIETKDVVLDTRYAGPEYGLPNDGTLEAIRLCARLEGMLTDPVYEGKSMHGM

SEQ ID NO: 65885 - protein, 399 aa, Physcomitrella patens subsp. patens
MSATAFPAASCAVKASGFSEFSGIKSTNSVTFGKRHDDLTTIVTAQSAVAASSGAKRAVTEAKIKVAINGFGRIGRNFVRCWHGRKDSPLDVVVINDTGGVKQASHLLKYDSMLGTFDADVKVEGNDAISVDGKVIKVVSDRNPLNLPWGDMDIDLVIEGTGVFVDEAGAGKHIQAGAKKVLITAPGKGAIPTYVVGVNEKDYKHSDSIISNASCTTNCLAPFVKVLDEKFGIIKGTMTTTHSYTGDQRLLDASHRDLRRARAAALNIVPTSTGAAKAVALVLPNLKGKINGIALRVPTPNVSVVDLVVQVEKKTFAEEVNQAFRDACATEELKGVLAVCDEPLVSVDFRCTDVSSTVDSSLTMVMGDDMVKVVAWYDNEWGYSQRVVDLAHIVAEKWQ

SEQ ID NO: 65886 - protein, 317 aa, Debaryomyces hansenii CBS767
MSIKLNSGYDMPLVGFGCWKVDNDTCAATIYNAIKVGYRLFDAAQDYGNCKEIGEGINKALDEGLVARDELFITSKLWNSYHDPKNVELALKKVLSDMKLDYLDLFLIHFPIAFKFVPIEERYPPGFYCGDGDKFHYENVPLADTWKAMEKLTKSGKVKSIGISNFSGALIYDLLRSAEIKPAVLQIEHHPYLQQPRLVEYVQSQNIAITGYSSFGPQSFLELKHSKALDTPTLFEHKTIKSIANKNKKTPAQVLLRWASQRNIAVIPKSNNPDRLLQNLEVNDFDLSKEDFEEISKLDQELRFNNPWDWDKIPIFA

SEQ ID NO: 65887 - protein, 593 aa, Schizosaccharomyces pombe
MVKRHKNTIGVWRLGKTLGTGSTSCVRLAKHAKTGDLAAIKIIPIRYASIGMEILMMRLLRHPNILRLYDVWTDHQHMYLALEYVPDGELFHYIRKHGPLSEREAAHYLSQILDAVAHCHRFRFRHRDLKLENILIKVNEQQIKIADFGMATVEPNDSCLENYCGSLHYLAPEIVSHKPYRGAPADVWSCGVILYSLLSNKLPFGGQNTDVIYNKIRHGAYDLPSSISSAAQDLLHRMLDVNPSTRITIPEFFSHPFLMGCTSLSSMDSTTPPTPSLSIDEIDPLVVDCMCVLWKKSSSKKVVRRLQQRDDNDEKYVYKVLSEILRDDMLKKQRFDENKYLSLYDLIHDNNLFTKASISTTSLVKSNVSTNSRKSSNFEDELARRVSSPLSALNQMSQSPIPIRVSSDKDYDSYACHEVVSNPSTLDDDYNYMFVCPPEEYTYSTDNVRTDSLDLQSLPTPTLEQLESVPFNRYGYVRIFPSTTLSSTASGYYTPDSLSTPEPSIDGLTNLDDVQVGGFVQGSGNQNRRPISFPVISNMQPNITNVRSASAPLCSSPVPSRRYSQYATNIRYTPRKVSSGSVLRKISSFFRKD

SEQ ID NO: 65888 - protein, 446 aa, Triticum aestivum
PVRNFRVDPRVRLKGSIPHSLDNLTKLASFNVSMNFLTGPIPSDGSLTNFNETSFIGNRDLCGRQINSVCKDALQSPSDGSQQPSKDDPNKRSSRVVISAVATVGALLLVALMCFWGCFLYKSFGKKDIHGFRVELCGGSSVVMFHGDLPYSTKDILKKLETMDEENIIGAGGFGTVYKLAMDDGNVFALKRIVKTNEGRDKFFDRELEILGSVKHRNLVNLRGYCNSPSSKLLIYDYLPGGSLDEVLHEKTEQLEWEARINIILGAAKGLAYLHHDCSPRIIHRDIKSSNILLDGNFEARVSDFGLAKLLEDEESHITTIVAGTFGYLAPEYMQSGRATEKTDVYSFGVLVLEILSGKRPTDASFIEKGLNIVGWLNFLAGESREREIVDPDCDGVQIETLDALLSLAKQCVSSLPEERPTMHRVVQMLESDVITPCGSDFYDSE

SEQ ID NO: 65889 - protein, 655 aa, Oryza sativa Indica Group
MGSGSAANGGGGGTARVPMPPARPFLETLGGNMKETFLPDDPFRVVRRERGCGRRAAAALRYVFPFMEWAPSYTLGTLKSDLIAGITIASLAIPQGISYAKLANLPPVLGLYSSFVPPLVYAMMGSSRDLAVGTVAVASLLIGSMLSEEVSAAEDPALYLHVALTATFFAGVFQALLGVFRLGFIVDFLSHATIVGFMGGAATVVCLQQLKGMFGLDHFTTATDLVSVMRSVFSQTHLWRWESVVMGCGFLFFLLITRFFSKRRPRFFWVSAAAPLASVIIGSLLVYLTHAENHGIQVIGYLKKGLNPPSATSLNFSSPYMMLALKTGIITGVIALAEGIAVGRSFAMFKNYHIDGNKEMIAFGTMNIVGSLTSCYLTTGPFSRSAVNYNAGCKTAMSNVIMSVAVMITLLFLTPLFHYTPLVVLSAIIMSAMLGLIDYPAAVHLWQVDKVDFCVCLGAYLGVVFGSVEIGLVVAVGISILRVLLFVARPRTTVLGNIPNTMIYRRMDQYTAAQRVPGVLVLRVDSPIYFTNASYLRERIARWIDDEEDQCKEKGEMQIQYVVLDMGAVGSIDTSGTSMLDELRKTLDRRGLQIVLANPGSEIMKKLDSSKVLEAIGHEWIFPTVGEAVAECDFVMHSQKPGMVMGSGAPHENLV

SEQ ID NO: 65890 - protein, 375 aa, Neisseria gonorrhoeae
MNTPALLVLADGSVFHGTSIGYEGSASGEVVFNTSMTGYQEILTDPSYCKQIVTLTYPHIGNAGTNAEDEESRTVLPAGLIIRDLPLLHSNFRASESLHDYLVRNETVAIADIDTRRLTMLLREKGQGGAILTGADATVEKAQELIAAFGSMVGKDLAKEVSCTETYEWTEGEWELGKGFVTPDKQPYHVVAYDFGVKTNILRISPRGCRLTVVPAQTSAEDVLALNPDGVFLSQRPGDPEPCTYAIEAVQKLMESGKPIFGICLGHQLISLAIGAKTLKMRFSHHGANHPVQDLDSGKVVITSQNHGFAVDADTLPANARITHKSLFDNTLQGIELTDKPVFCFQGHPEASPGPQDVGYLFDKFIGNMKAAKQA

SEQ ID NO: 65891 - protein, 1181 aa, Vitis vinifera
  misc_feature (251)..(251): Xaa can be any naturally occurring amino acid
  misc_feature (269)..(269): Xaa can be any naturally occurring amino acid
  misc_feature (351)..(351): Xaa can be any naturally occurring amino acid
  misc_feature (376)..(376): Xaa can be any naturally occurring amino acid
  misc_feature (476)..(476): Xaa can be any naturally occurring amino acid
  misc_feature (531)..(531): Xaa can be any naturally occurring amino acid
  misc_feature (575)..(575): Xaa can be any naturally occurring amino acid
  misc_feature (730)..(730): Xaa can be any naturally occurring amino acid
  misc_feature (1106)..(1106): Xaa can be any naturally occurring amino acid
MGGYGAEGSKPMQPLFETKQVKGRVASKVLASTIFLGICLILVYRLKHIPSAEEHDRWAWIGLFMVELWFGFYWILLVARQMGLIYGCAVEDIITGLPIICRGWKPVYFSPHKSAFLGVAPTTLDQSLIQDKRWSEGLFQILLSKYCPSLYGYGKVSSLWFLPFAYVFVAKNAYSILETVSCGETFKTLWNFERMWMMRSATSYLFAFIDNLIMLFGLSETTFVITAKVADEDVLKRYQHEIIEFGSSSLXFTIISTLALLNLFSSVGXIKKVIFDIEFRAAAGLIPHVILCGVTVMLHVPVYEALFVRNDKGQIPSSVMFKVIHIPTEDGRWGWIGLLLAELWFGLYWLXTQASRWNPIYRSTFKDRLSQRYEKXLPAVDIFVCTADPVIEPPIMVVNTVLSVMAYDYPQEKLGVYLSDDAGSELTFYALLEASHFSKHWIPYCKKFKIEPRSPAVYFSLTSHLHDADQAKELEXIQKLYEEMKDRIETATKLGRIPEEVLMEQKGFSQWDSFSSRHDHDTILQILIDGXDPNAMDVEGSKLPTLVYLAREKRPKHPHNFKAGAMNALTAICTXTIHIPFRDALCFFMDEEKGQEIAFVQYPQNFENITKNELYSSSLRVISEVEFHGLDGYGGPMYIGTGCFHRRDTLCGRKFSKDYRNEWKRESIKTEESAHELQESLKNLASCRYEGDTQWGNEMGLKYGCPVEDVITGLSIQCLGWKSVYLNPAXKAFLGVAPTTLEQTLVQHKRWSEGDLQILLSKYSPAWYGLGRISPGLILGYCTYCLWPLNSLATLSYCIVPSLYLLHGIPLFPQVSSPWFLPFAYVILAKYSGSLAEFLWSGGTLLGWWNDQRIWLFKRTTSYLFAFMDTILRLLGFSETSFILTAKVADEDVSQRYEGEMMEFGGSSPMFTILATLAMLNLFCVVGVVKKVGLDMEVYKTMALQILLAVVLLLINWPLYQGLFLRKDNGKMPCKARPRESNKTDISSSGISSEMKIWAPEFGFIVILVLLSVQAVCGIRFVIDREECFSHNVEYEGDTIHASFVVIKVDASWHYNKDGVDLVWYFQYDYTLSNKVKGPSGNQIQDYRDKTSEKFEFMAHEKGLHXFCFTNKSPYHETIDFDVYTGHFAYYDQHAKDVNDAMSRRAVYKAFYESAALIGASILQVYLLRRLFERKLGTSRV

SEQ ID NO: 65892 - protein, 447 aa, Solibacter usitatus Ellin6076
MKVSIIGLGKLGAPMAAVMAHKGNFVVGVDINPEFVKAIREGRPPVNEPQLAEMITANHERLTATESYEDAILATDLTFIIVPTPSGPDGRFSLDYVLKAVEKIGAAVRKKAAWHLVVLSSTVMPGSVDLHVLPALEKYSGLKCGVDFGLCYNPEFIALGSVVRDMLNPDMILIGEAEPRSGAMLEELYTGVCESNPRIQRMNYVNAELTKLSVNTFVTTKISYANMLAQICETLNGADADVVTSALGCDTRIGPKYLKGALGYGGPCFPRDNIAFSALARENGVPALLAEATDELNRRQVPRMAELLLSHLPAGGTVGMLGLSYKPHTEVIEESQGVAIAKELAARGARVVVYDPAAMDSTRRVLGDRIEYAATAAECAGRADVLAITTPWPEFKNLTPANLKQGAKPAIVDCWRVLPRTAFEGASEYMTLGFGMSALALATAEGD

SEQ ID NO: 65893 - protein, 223 aa, Lolium perenne
MCQIKKEMSGESGSPCNGEYCSPSTSSEQKQQTVWTKRPAGRTKFRETRHPVYRGVRRRGNAGRWVCEVRVPGRRGSRLWVGTFDTAEIAARAHDAAMLALAAGDVCLNFADSAELLDMPASSYRSLDEVRHAVTEAVEEFERRQALGEEDALSGTESSTLTDDEESSTPFELDVLSDMGWDLYYASLAQGMLMSSPFLAASAALGDYGEANLADVPLWSYLS

SEQ ID NO: 65894 - protein, 771 aa, Hordeum vulgare subsp. vulgare
MVAAAILPELATQLVVPVAAAVGIAFAVLQWVLVSKVKVAPEPRAEGGSASAVGAKDGATEYLIEEEEGLNDHNVVLKCAEIQTAISEGQTSFLFTEYKYAGGFMTIFAVLIFVFLGSIEGFSTKSQPCHYSVGKTCKPALANAAFSTIAFVLGAVTSLVSGFLGMKIATYANARTTLEARKGVGKAFITAFRSGAVMGFLLAASGLFVLYVAINLFGLYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMMYPLLISSVGIIACLITTLFATDFFEVKEVDQIEPALKRQLIISTAVMTIGIALVSWLGLPYTFTIFNFGAQKTVHSWQLFLCVAVGLWAGLVIGFITEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAGITTVDVLTPNVFIGLLVGAMLPYWFSAMTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHAKSLGPKGSDCHKAAVIGDTIGDPLKDTSGPSLNILIKLMAVESLVFAPFFATYGGILFKIL

SEQ ID NO: 65895 - protein, 360 aa, Mycobacterium avium 104
MSAQRTAVHQPWPGLIEAYRDRLPVGDDWTPVTLLEGGTPLIPARRLSEKTGCTVHLKVEGLNPTGSFKDRGMTMAVTDALARGQQAVLCASTGNTSASAAAYAARAGITCAVLIPQGKIAMGKLAQAVMHGAKIIQIDGNFDDCLELARKMAADFPTISLVNSVNPVRIEGQKTAAFEIVDVLGAAPDVHALPVGNAGNITAYWKGYTEYHHEGLIEKLPRMLGTQAAGAAPLVHGEPVKNPETIATAIRIGAPASWTAAVDAQQQSHGRFLAATDDEILAAYHLVAESEGVFVEPASAASIAGLLKAVEDGWVARGSTVVCTVTGNGLKDPDTALRDMPTVTPLPVDPVLVVEKLGLA

SEQ ID NO: 65896 - protein, 267 aa, Burkholderia phenazinium
CEDCNSGLAFGGNKTRKLEYLIPEALAQGCDTLVSIGGIQSNQTRQVAAVAAHLGMKCVLVQENWVNYSDAVYDRVGNIQMSRIMGADVRLVADGFDIGFRKSWEDALESVRQAGGKPYAIPAGCSDHPLGGLGFVGFAEEVRQQEAELGFKFDYIVVCSVTGSTQAGMVVGFAADGRAERVIGIDASAKPAQTRDQIFRIAKQTAEKVELSRDIVAKDIVLDERYGGPEYGLPNEGTMDAIRLCARLEGMMTDPVYGGKSMHGKGS

SEQ ID NO: 65897 - protein, 244 aa, Azospirillum lipoferum
GLAMGGNKLRKLEYIVPDAIASGADTLVSIGGVQSNHTRMVAATAAKIGMKCVVVQESWVPHEDAVYDRVGNILLTRLMGADSRIVPDGFDIGIRKSWEDAIQSVKDAGGKPYGIPAGASVHKYGGLGYVGFAEEVRKQEAELGFKFDYIVVCVVTGSTQAGMIVGFAADDRADRVIGIDASGTPEQTRTQVRQIVDNTAELVELGRKVRDDEIVILEDYAYPAYGVPSAETNEAIRLAARTEA

SEQ ID NO: 65898 - protein, 265 aa, Triticum aestivum
  misc_feature (152)..(152): Xaa can be any naturally occurring amino acid
  misc_feature (159)..(159): Xaa can be any naturally occurring amino acid
  misc_feature (175)..(175): Xaa can be any naturally occurring amino acid
DSGCPGQIGRTPAIYKPRAEFGTRDELVSIAEPLLSDIPTATGTGKPKSVYVGGEYRRAADSSNTDLALAFELPGGWLKEKEFATASVLQALLGGGGVFTWGRPGKGLHSRLNPLVNEFDQIKSISAFKNVHSNTGIFGIHASTEAAFVPKXIDLAARXELTSLATPGQVDQAPXWDRAKASAKSAILKNPESKASTTEDIGRQALAFGERKPVEQLLKAVDGITLADVSTVAEKIISSPLTMASHGNVLNVPAYETVRGKFSSK

SEQ ID NO: 65899 - protein, 159 aa, Desulfitobacterium hafniense Y51
MLHTLAVLVENNPGVLTRVAGLFARRAYNINSLSVCQTEHPGISRMTIVVDGDDTVIEQVSKQLHKLVVVHKVTDLTNETVVDRELALIRIKVKADTRLEVLQIVDVFRGRVVDMGRSNLTVELTGDEEKIDAFVKTIRPFGLMELVRTGKIAITRLES

SEQ ID NO: 65900 - protein, 265 aa, Burkholderia tropica
EDCNSGLAFGGNKTRKLEYIVPDVLASGADTLVSIGGIQSNQTRQVAAVAAHLGLKCVLVQENWVNYSDAVYDRVGNIQMSRMMGADVRLVSDGFDIGIRPSWEEALESVRNAGGKPYPIPAGCSEHRLGGLGFVGFAEEVRAQEAELGFKFDYIVVCSVTGSTQAGMVVGFAADGRADRVIGIDASAKPEQTREQILRIARQTADLVELERPIADADVVLDTRYGGPEYGLPSEGTLEAIRLCAKTEGMLTDPVYEGKSMHGMI

SEQ ID NO: 65901 - protein, 260 aa, Azospirillum lipoferum
EDCNTGLAMGGNKLRKLEYIVPDAIASGADTLVSIGGVQSNHTRMVAATAAKIGMKCVVVQESWVPHEDAVYDRVGNILLTRLMGADSRIVPDGFDIGIRKSWEEAIQSVKDAGGKPYGIPAGASVHKYGGLGYVNFAEEVRKQEAELGFKFDYIVVCVVTGSTQAGMIVGFAADDRADRVIGIDASGTPEQTRTQVRQIVNNTAELVELGRKVRDDKIVILENYPYPAYGVPSAKTNKAIRLAAFPEGRIHDPVFEGKS

SEQ ID NO: 65902 - protein, 352 aa, Desulfitobacterium hafniense Y51
MPKIAVLPGDGIGQEIIPQAVRVLKAVLAETDAEFEFQDYPIGGAAIELVGKALPDETLQGCREADAVLLGAVGGHQWDHLPASERPETAALLGLRKGLNFYANIRPVRMIPSLLATSTLKENVLDGVDMVVIRELTGGVYFGEKGRSDNPRSAYDKMTYSEEEIRRILIQGFETAMLRSKKLCSVDKANVLETSRLWREIANELAKEYPEVELTHMYVDNAAMQLVRNPKQFDVIVTENMFGDILTDLASMLGGSIGMLSSASLSGTQGMYEPAHGSAPDIAGKNLANPLATILSAALMLRYSFGMEAEALRIESAVEKVLEQGYRTGDLAQAGDKVVGTIEMGDAVLAAL

SEQ ID NO: 65903 - protein, 241 aa, Pseudomonas fluorescens
AFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSRNVIGIDASAKPEQTKAQILRIARHTAELVELGREITEEDVVLDTRFAYPQYGLPNEGTLEAIRLCRSLE

SEQ ID NO: 65904 - protein, 553 aa, Debaryomyces hansenii CBS767
MSQPEFKLSTELPAWKKLEATFKSKGEKFQVKEAFDKDPKRFEKLSKTFQNFDNSKILFDFSKNLIDDEILEQLVQLAKEAKVEELRDAMFNGDKINTTEDRAVYHVALRNRSKREMKVDNVDTFPEVDEVLQHMKEFSNQIRSGEWTGYTNKAITDVVNIGIGGSDLGPVMVTEALKAYGKPGLNVHFVSNIDGTHIAETVKKCDPETTLFLIASKTFTTAETCTNANSAKKWFLAKALDTKHIAKHFAALSTNAEEVSKFGIDTKNMFGFESWVGGRYSVWSAIGLSVAIYIGFDNFESFLKGAEAVDKHFVETPLEENIPVLGGLLSVWYNNFFGAQTHLVAPFDQYLHRFPAYLQQLSMESNGKSVTRANAFTNYETGTILFGEPATNAQHSFFQLVHQGTKLIPSDFILAAQSHNPIENNLHQKMLASNFFAQAEALMVGKNEDEVKKEGATGGLVPHKVFSGNRPTTSILAQKITPAALGSLIAYYEHLTFVEGAIWNINSFDQWGVELGKVLAKVIGKELENNNEKVDTHDPSTKGLINQFKDWAE

SEQ ID NO: 65905 - protein, 294 aa, Oceanobacter sp. RED65
MTFQEFQTWSQDRFQSILKADYVLPNVDAQRLKDAMTYSLLNGGKRVRPLMVYATTRSLSGDLQAADQCALAVEMIHAYSLVHDDLPAMDDDELRRGQPTCHIAFDEATAILAGDALQTQAFQVLVQPIDGMAPQQQLRMVQTLAHASGLAGMAGGQSLDLEAVDKQVDIEYLQNMHLHKTGALIEASVKLGGLCANASEQQLSYLSVYAQAIGLAFQVQDDILDVISDTRTLGKPQGSDESRNKPTYVSLLGLDGAKRKAQDLHQQARDALRKLDADTSPLEDIARYIIERTY

SEQ ID NO: 65906 - protein, 510 aa, Oryza sativa
MMKSLFLFSAHPKPPPLPPSPHLRKLLRLTASASTSASSPPRAGCSRGPAHARPRPSPRPSPSSSSSLYARPSLLDMERGRAARRADVDAFLASLGVDPGELAGLELPATVDVMRERVEFLHSLDLSNEDLAAYPLALGCSVRKNMVPVLDYLGKLGVRQDALPDLLRRYPQVLHASVVVDLAPVVKYLQGMDVRPHDVPRVLERYPELLGFKLEGTMSTSIAYLVGIGVARRQVGSVITRFPEVLGMRVGKIIKPFVEHLEGIGLQRLAIARIIEKKPYVLGFGLEDKVKPNIEALLEFGVRKEALAFIVAQYPDILGIELRDKLATQQSLFESSILVSSEDFGRVIERMPQAISLGRTAVLKHVNFLTSCGFLLSQVSKMVVACPQLLALNMDIMKMSFEYFQNEMERDLEELVEFPAFFTYGLESTVRPRHEMVAKKGFTCSLAWLLNCSDAKFDERMKYDTIGIEEMEVDNSFDTNTLSERVEDEVEDEDLDEDSDYDSTDDEFIE

SEQ ID NO: 65907 - protein, 388 aa, Glycine max
MAAIVSHHHHRLFSASTRFNSTSRDSRRRRSGSNSVRCADVSTATSENRRVTVSNRNDSLEICRVLNGMWQTSGGWGRIDRDDAVEAMLRYADAGLTTFDMADHYGPAEDLYGIFINRVRRERPAELLEQVRGLTKWVPPPVKMTSSYVRDSINVSRKRMDVESLDMLQFHWWDYSNPGYLDALKHLTDLKEEGKIKTVALTNFDTERLQIILENEVPVVSNQVQHSLVDMRPQQRMAELCQHTGVKLITYGTVMGGLLSEKFLDTNIAIPFAGPAINTPSLQKYKRMVDAWGGWSLFQGLLRTLKQVASKHGVSIATVAVKYILDQPAVAGSMVGVRLGLAEHIQDTNAIFSLVLDEDDVNSIREATAKGKDLLKVIGDCGDEYRRA

SEQ ID NO: 65908 - protein, 257 aa, Oryza sativa
MADPAPARTNFGTRAPGTTQRPTGQRPGGKPGGRGNRAGKEEKEWEPVTKIGRLVKDGKVKSLEDLYKHSIPIKEAEIIDFFIGPQLKDEVLKIMPVQKQTRSGQRTRFKAFVAIGDSNGHVGLGVKCSKEVATAIRGAIIAAKLSIIPVRRGYWGNKIGKPHTIPCKVTGKCGSITIRLIPAPRGTGLVAAQVPKKLLSMAGIEDCYTASVGSTCTLGNFAKATYQAIQKTYSILTPDLWASETLNNHYTVPILNI

SEQ ID NO: 65909 - protein, 468 aa, Mycobacterium avium 104
MASEDSALTGSDTAMLSLAALDRLVAAGAPETRVDTVIVAFPDMQGRLVGKRMDARLFVDEAAATGVECCGYLLAVDVDMNTVGGYAISGWDTGFGDLVMRPDLSTLRRIPWLPGTALVIADVVGADGSPVAVSPRAVLRRQLDRLAGRGLFADAATELEFMVFDEPYRQAWASGYRGLTPASDYNIDYAISASSRMEPLLRDIRRGMAGAGLRFESVKGECNRGQQEIGFRYDEALRTCDNHVIYKNGAKEIADQHGKSLTFMAKYDEREGNSCHVHLSLRDAQGGAAFADPSRPHGMSTMFCSFLAGLLATMADFTLFYAPNINSYKRFADESFAPTALAWGLDNRTCALRVVGHGAHTRVECRVPGGDVNPYLAVAAIVAGGLYGIEQGLALPEPCAGNAYRARGVGRLPATLAEAAALFEHSALARQVFGDDVVAHYLNNARVELAAFHAAVTDWERMRGFERL

SEQ ID NO: 65910 - protein, 395 aa, Bacillus cereus G9241
MKLAKRVAALTPSATLEITAKAQALKAEGHDVIGLGAGEPDFNTPEHIMDAAHKAMLEGHTKYTPTGGLQALKQEIVKKFTRDQGIAYDPSEIIVCNGAKHALYTLFQVLLDEGDEVIIPTPYWVSYPEQVKLAGGKPVYVEGLEDNEYKITAKQLREAITEKTKAVIINSPSNPTGMIYSKEELQQLGEVCLEHDILIVSDEIYEKLIYGGAEYTSIAQLSNALKEQTLIINGVSKSHSMTGWRIGYAAGNKQLIKAMTNLASHSTSNPTSIAQYGAIAAYAGSQEPVETMRQAFEERLNIIYDKLIQIPGFTCIKPQGAFYLFPNVKEAVALSGYETVDDWAKALLEEEKVALVPGTGFGAPNNVRLSYATSLEQVEKALERIHTFMKSKVQA

SEQ ID NO: 65911 - protein, 524 aa, Propionibacterium acnes KPA171202
MAEKKPIKLADTMAGRIEQLADERHAVELGGGEDRLQKQRDRGKQTARERIDNLVDAYSFDEVGAFRKHRTTLFGMDKAEVPADGVVTGRATIHGRPVHIASQDFTVMGGSAGETQSTKVVETMEQSLLTGTPFLFFYDSGGARIQEGIDSLSGYGKMFYANVKLSGVVPQIAIIAGPCAGGASYSPALTDFIIMTKKAHMFITGPGVIKSVTGEEVTADDLGGADAHMSTSGNIHFVAEDDDAAVLIAQKLLSFLPQNNTEDAQISNPNDDVSPQPELRDIVPLDGKKGYDVRDVISKIVDWGDYLEVKAGWATNIVTAFARVNGRTVGIVANQPKVMSGCLDINASDKAAEFITFCDSFNIPLVQLVDVPGFLPGVQQEYGGIIRHGAKMLYAYSEATVPKITVVLRKAYGGSYLAMCNRDLGADAVYAWPSAEIAVMGADGAANVIFRRQIKDSEDPAATRAAKIEEYRNAFNTPYVAAARGQVDDVIDPADTRRKITAALETYATKRQSRPAKKHGVMPC

SEQ ID NO: 65912 - protein, 251 aa, Azospirillum lipoferum
GLAMGGNKVGKLGYIVPDAIASGADTLVSIGGVQSNHTRMVAATAAKLGMKCVVVQESWVPHEDAVYDRVGNILLTRLMGADSRIVSDGFDIGIRKSWEDAIQSVKDVGGKPYGIPAGGSVHKYGGLGYVGFAEEVRKQEAELGFKFDYIVVCVVTGSTQGGMIVGFAADDRADRVIGIDASGTPEQTRAQVRQIVDNTAELVELGRKVRDDEIVILEDYAYPAYGVPSAETNEAIRLAARTEAMITYPLY

SEQ ID NO: 65913 - protein, 264 aa, Burkholderia cepacia
DNCNTGLAFGGNKTRKLEYLVPDALAQHADTLVSIGGVQSNQTRQVAAVAAHLGMKCVLVQEHWVNYDDPVYGRVGNIQLSRMMGADVRLVDDGFDIGIRRSWEEAMESVRQAGGKPYPIPAGCSEHPLGGLGFVGFAEEVRAQEAQLGFRFDYIVVCSVTGSTQAGMVVGFAADGRADRVIGIDASATLERTREQITRIARHTAELVDLGRDIGDRDVVLDTRYAGPEYGLPNDGTLDAIRLCARLEGVLTDPVYEGQSMHGM

SEQ ID NO: 65914 - protein, 266 aa, Burkholderia cepacia
CEECNTGLAFGGNKTRKLEYLIPDALAQGADTLVSIGGVQSNQTRQVAAAAAHLGMKCVLVQEHWVNYDDPVYDRVGNIQLSRMMGADVRLVADGFDIGIRRSWEEAMESVRQAGGKPYPIPAGCSEHPFGGLGFVGFAEEVRAQEAQLGFKFDYIVVCSVTGSTQAGMVVGFAADGRADRVIGIDASATPDKTHEQIARIARHTAELVELGRAITDADVVLDTRYAGPEYGLPNDGTLDAIRLCARLEGVLTDPVYEGKSMHAHD

SEQ ID NO: 65915 - protein, 625 aa, Oceanobacter sp. RED65
MFHHIPTTRPSTPLLDTINEPADLRLLDAKQLPQLATELRHYLLYSVGQSGGHFGAGLGVVELTVALHFVYDTPEDLLVWDVGHQAYPHKALTGRREQLPSIRQKEGLSPFPKRKESIFDTFGVGHSSTSISAALGMAIAARQQGSDKKVAAVIGDGAMTAGMAFEALNHAGHTDTDMLVILNDNDMSISENVGGLNKYLSKILSSKTYAVMREGSRKVLSNIPHAWELATKTEEHVKGFLTPGILFEELGFNYVGPVDGHDVDALVRTLRNMRELKGPQFLHIITKKGKGFEPAEQEQIKYHALSPQTTKVNPNQKKAKSFSNIFGEWICDQAAADKKLFGITPAMREGSDLVKFSEDYADRYFDVAIAEQHAVTLAAGMACEGSKPVVAIYSTFLQRGYDQLVHDVAIQNLDVTFAVDRAGVVGADGPTHAGAYDISFMRCIPNMVIACPSDENECRLLLNTAYQFNGPAAVRYPRGSGKEVNVTAKQETLEIGKAKVLQKGQSGIAVLCFGPLLEEAEKALSELANGQDITLVDMRFAKPLDETLLIQLASDHRYFVTLEDNAIMGGAGSAVSEFFASKDIQTNVTFLGIPDECIEHGSQKEQWAEMGIDAAGIKATLEKRF

SEQ ID NO: 65916 - protein, 387 aa, Oceanobacter sp. RED65
MVSSDSFVLTIGGILLIGLITSTIAKRTVLPRITLLLLFGILIGPEALNLIPHLFTSHFDLIADMTLLMVGFLIGSKLTKEHLQETASQVLAISIIAALATTLIVALGLYACGVSVQLSIILGCIAAATAPAAILDLVMENGPESRFGRLLIAIVALDDVWALLLFAIGLAIVSGMQNGTLEWTSLLHAGREIGGALVVGLLIGLPAAYLTGRINPGEPGITEALGVVFVCGGIAIFFGFSHLIATMVMGAVIANLAKHHDYPFHAIENIEWPFMVTFFVLAGASLELSTLQNIGAIGLLYIGLRAFGKYSGAWLAGKLSHAPQATQNWMGLALLPQAGVAIGMALVASNALPEQRQLLLSLVISTTVIFELIGPVLTQIAIRKGQN

SEQ ID NO: 65917 - protein, 302 aa, Aspergillus fumigatus
ESLIIIDRMVDFGTPLLTQLTYEGLIDEFVGIKNNQADVDTAIVGANSVPQAQESSKAPQQTLKQGQKRKIQLDSSDQLFSQVRDANFAIVGDILNKVARRLESEYETRHAAKTASELREFVNKLPAYQLEHQSLRVHTNLAQEIMRNTRSDIFRKVLEVQQNNAAGTDPTYQHDTIEELIARDVPLKTVLRLLCLESCMSGGLRSRDLENFKKQIVHAYGHQHILTFSALEKMELLQPRSSAATMLIPTAGAQPGTKTNYNYLRKNLRLLVEEVSEEDPNDIAYVYSAFAPLSIRLVQCVL

SEQ ID NO: 65918 - protein, 466 aa, Oryza sativa Japonica Group
MAVIALKCPDVEVVVVDISAPRIEGWNSERLPIYEPGLDDVVRQCRGRNLFFSTDVERHVADAGIVFVSVNTPTKTRGLGAGKAADLTYWESAARIIADVSRSDKIVVEKSTVPVKTAEAIEKILAHNSKGGNIRYQILSNPEFLAEGTAIQDLFSPDRVLIGGRETPEGRAAVAALKSIYARWVPDDRIITTNLWSAELSKLAANAFLAQRISSVNAISALCEATGADVTEVANSIGKDSRIGPRFLSASVGFGGSCFQKDILNLVYICECYGLPEVANYWHQVIRINDYQKSRFVNRVVSSMFNTVAGKKVAVLGFAFKKDTGDTRETPAIDVCKGLVGDKAVVSIYDPQVTEEQVQRDLVMNKFDWDHPRHLQPMSPSSAKHVAVSWDAYEAARGAHAVCILTEWDEFRRLDYQRMYDAMHKPAFLFDGRNVVDPDKLRRIGFVVYSIGKPLDHWLRDMPAVA

SEQ ID NO: 65919 - protein, 223 aa, uncultured bacterium
MTQDEMKTLVGLAALDHVQAGSIVGVGTGSTVDKFIDALGAALKTDPQRVVGAVSSSVRSTERLQSLGVKVLPAESVSRLAVYIDGADEINHQGDMIKGGGAALTREKIVADLAERFVCIADETKLVQTLGKFPLPVEVIPMAAAQVIRAFAAQGGQARVREGVVTDNGNLIVDVTGLSITDPARLESDVNQWPGVVTVGIFARNRASVCLLGTPNGVKTLNF

SEQ ID NO: 65920 - protein, 488 aa, Bordetella parapertussis 12822
MGKITGFMEFQRLQEAAEAPQKRLKHWREFVLHLNDEQAKQQAARCMDCGIPFCSNGCPVNNIIPDWNDLVYRQDWRRALDVLHSTNNFPEFTGRICPAPCEAACTLNINSDAVGIKSIEHAIIDKGWAEGWVTPQVPVRKTGKKVAVVGSGPAGLACSQQLARAGHSVTLFEKSDRIGGLLRYGIPDFKLEKSQIDRRIAQMEAEGVEFAPSTYIGNPDDAAADGLTVRTPQSLLADFDAVVMTGGSETPRDLPVPGRELSSVYYAMDFLRQQNKAVAGDRLSGQTLAKDKHVVVIGGGDTGSDCVGTSNRHGAASVTQFELLPQPPECEDKPMVWPYWPLKLRTSSSHDEGCERDWSVATKALAGSDGQVEKLVGVRVEWFKDEATGQMKMREVEDSEFEIPADLVLLAIGFVSPVATVLDAFGVDRDARGNVRANTDDYRTNVDKVFAAGDMRRGQSLVVWAIREGRQCARSVDEYLMGASELPR

SEQ ID NO: 65921 - protein, 280 aa, Yarrowia lipolytica CLIB122
MSANYWTSSQRLHWLLTKETLAERRKGLEDIFDPGKLQTIKALNPWHVRVYLHTLIHLLGQNLSIRQRILATAEVYLTRFHTKVPFGEINPYLVVATAVYVACKVEEHPQHIRTITSEARSLWPDYISHDPTKIAECEFYLIEELGTYLVIFHPYKSLMQISDAMARSNAQITMAPEEIQVTWSMINDSYITDLHLLNPPHIVAMACIYMTVVLRSHIMRMTMPSEAVKSRIEAFMTFFGESNVDLEQTIDCVQEMISLYVNWDTYSEKQCRVEIAKVIT

SEQ ID NO: 65922 - protein, 253 aa, Physcomitrella patens subsp. patens
MQGSSPQVPTGPNNPLNDVFYGAAPGLLGAYLGNSKDYVQSNVSRYFASHDIQYYFQVTDQYVRNKLKVVLCPFLHKGHWTRIAEQVAGGLKYKPPRHDINAPDLYLPIMALVTYILLSGFLLGMAGKFKPEAMSGLVTKATIGWIIETIMLKASLFALGSGDAPTLDVVAYAGYAFIGVSLSLVVRLLSPYAFHITWAYTSLCMASFLVKTMKRLLFAEVRRYDRDSTRHHYLLLLMAVAQFPLFYWLVHVR

SEQ ID NO: 65923 - protein, 384 aa, Yarrowia lipolytica CLIB122
MASPKGANPVEASKPPVAVAHKQKTTAWRGLMDYLSARQITLPLKVLTYIVVMHRFAALRPYTRKFFHLQYPKHEVDGVAAYYSRGRDDIYFVLTGILALTFLRAACMDFVLVPMARALKITKRKPQLRFAEQGWALIYYTSSTWIGFYLYYHSPYWLNVEELWRGYPHFELDPFFKAYYLIQFSFWVQQIFVLNMEEKRKDHYQMFTHHIVTCALMCGSYYYYYTRVGHLILVLMDGVDTLLASAKMLKYLRYDTMCDAMFGLFVIAWVVLRHGLYNYVTWSAYFQAPVLVAENCLRDEDGQETCFNPALHRVFVVLLIALQIITLIWLYMIVRVIVKILKGGGAEDSRSDDEDSDEEEGEAEGEEEEEEEEEVMEEKVSDDN

SEQ ID NO: 65924 - protein, 300 aa, Bordetella parapertussis 12822
MTDTPDPAAVLSPAVKAAVLSEALPYIRRFHGKTIVVKYGGNAMTEERLQRSFAHDVVLLKLVGLNPVVVHGGGPQIDDALRRIGKQGTFVQGIRVTDAETMEVVEWVLGGQVQQDIVMMINEVGGKAVGLTGKDGMLIQATKKLMVNKDDPSQPLDIGFVGDITRVEPAVVKALQDDQFIPVISPIGYGEDGTAYNINADVVAGKMAEVLGAEKLLMMTNTPGVLDKGGKLLRSLSAQTIDELFADGTISGGMLPKISSSLDAAKNGVNSVHIVDGRVPHCLLLEILTDQGVGTMISSH

SEQ ID NO: 65925 - protein, 765 aa, Oryza sativa Japonica Group
MMRLLLVAVAVAMAAVVVAAEERATYIVHMAKSAMPAEYGDDHGEWYGASLRSVSGAGKMLYAYDTVLHGFSARLTAREARDMAAMDGVLAVNPEARYELHTTRTPEFLGIAGNDGLFPQSGTAGDVVVGVLDTGVWPESRSYDDAGLGEVPSWWKGECMAGTGFNSSACNRKLVGARFFNRGYEAAMGPMDTTRESRSPRDDDGHGTHTSSTAAGAAVSGASLLGFASGTARGMAPRARVAVYKVCWLGGCFSSDILAGMDAAVADGCGVLSLSLGGGAADYARDSVAIGAFAAMEQNVLVSCSAGNAGPGTSTLSNVAPWITTVGAGTLDRDFPAYVSLGNGKNYTGVSLYAGKALPSTPLPIVYAANASNSTAGNLCMPGTLTPEKVAGKIVVCDRGVSARVQKGFVVRDAGGAGMVLSNTATNGEELVADAHLLPAAGVGAKEGAAIKAYVASDPSPTATIVVAGTQVDVRPSPVVAAFSSRGPNMLTPEILKPDIIAPGVNILAAWTGKAGPTGIAADTRRVAFNIISGTSMSCPHVSGLAALLRSAHPEWSPAAVRSALMTTAYSTYAGAGDANPLLDAATGAPATPFDYGAGHVDPASAVDPGLVYDLGTADYVDFLCALNYTSTMIAAVARSKSYGCTEGKAYSVYNLNYPSFAVAYSTASSQAAESSGAAATTVTHRRTLTNVGAAGTYKVSAAAMPGVAVAVEPTELAFTSAGEKKSYTVSFTAKSQPSGTAGFGRLVWSDGKHSVASPMAFTWT

SEQ ID NO: 65926 - protein, 513 aa, Aspergillus oryzae
MSWPRIGAYALLAFVAIMALNVTYQFLFRMLNKTRPPLVFHWIPFIGSTIHYGTDPYGFFFSCREKYGDIFTFILLGRPTTVYLGTQGNEFILNGKLKDVNAEEVYSPLTTPVFGSDVVYDCPNSKLIEQKKFIKFGLSQAALEAHVPLIEKEVEDYLAMSPNFHGTSGEVDIPAAMAEITIFTAGSALQGEEVRSKLTTEFAVLYHDLDKGFTPINFMLPWAPLPHNKKRDAAHARMRAIYIDIINKRRNAGDNVPEKLDMIGNLMQCTYKNGQPLPDKEIAHIMITLLMAGQHSSSSISSWIMLRLASQPAVVEELYQEQLANLERTGPNGSLAPLQYKDFDNLPLHQNVIRETLRLHSSIHSLLRKVKNPLPVPGTPYVIPTSHVLLAAPGVTALSDEYFPNAMAWDPHRWETQAPQENNKDDIVDYGYGAMSKGTSSPYLPFGAGRHRCIGEKFAYLNLAVIVATMVRHLRFSNLDGQTGVPDTDYSSLFSGPMKPARIRWERRAAKSG

SEQ ID NO: 65927 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKISPETGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 65928 - protein, 792 aa, Oryza sativa Japonica Group
MKDKEETKFINIECLTHTHYTLLEGILHSAEMQKNFIYKERLPRQEGWLQIPEDETISLFPDVPSSQEEDLQKTILIELPSCKSYPLVKFKISIPRDSRNCQQAVWTVKEKMISGFPLLCERELSKQIQDYSRAASLSVHPMERRRGGGGGGGGFFAALREEVARGLSPARARGRSRSDAAELAAAMRMSGGGGGGGEMLAPLMEGPDPESGDGEGGGGGGGGGGGGGGGGRGARGRRGEGWGQWVRGQLSRTPSSVAAAAAGAGAARNDLRLLLGVMGAPLAPVHVSAAEPLPHLSIKDTPIETSSAQYILQQYLAASGGQKLLASVRNAYTMGKVRMVATEFETAGRLVKNRNAARCAEPGRFVLWQMAPEMWYIELAVGGSKVHAGCNGKLVWRHTPWLGAHAAKGPVRPLRRALQGLDPLTTASMFAGARCIGERKVNGEDCFILKLCTEPETLKARSEGLAEIIRHVMFGYFSQRTGLLVHIEDSHLTRIQSTTGGDAVYWETTINSFIEDYRPVEGIMIAHSGRSAVTLFRFGEVAMSHTKTRMEEAWSIEEVAFNVPGLSMDCFIPPTDIKSGSISETVELSHGEKSKLTDFDECSVGDKQVEGGFGVCRTKCPLCTGSTMRSTAGQRKEPDLSRRGDEIEEGGARGDLPWRHGSDQCFLCAWTNLEFLRSSSVKPAVILVMMAPVTAKPVRKGQQRFHSLRKNTGHGSKRLKNILDLLLFLLLRGGLGVVGGSRGPFAFFSIRRGKKRMVVVVIASRLGLGRGAAAWRWASPLLHVGQILVGLE

SEQ ID NO: 65929 - protein, 873 aa, Lactobacillus sakei subsp. sakei 23K
MNYIYAFAEDQTLTNQELGGKGANLAEMTRLGLPVPAGFTITTAACRQYLASAKQETGFLEDELMKAVHILEEKTQRQLGNAEQPLLVSVRSGAPISMPGMMDTILNLGLNDQTVIGLAEMTNDPWFAYDCYRRLIQMFGDVVYGIDKPIFEAALTALKNKRQVQKDTDLTLVDLKQLIETYKGLYVAAGQYQFPQSVDQQLRLAIEAVFKSWQNPRAQTYRRLNQIDGAMGTAVNVQQMVFGNYQGQSGTGVAFTRNPATGEPGLFGEYLLNAQGEDVVAGIRTPEPIATLKAQLPVIYEQFKTIANQLEAHYRDMQDMEFTIEAGQLYVLQTRVGKRTAPAAFRIAVDLVDEGVIDRPTAISRLKPTMIDGLLHPLFETSAVQQATQLLTGLPASPGAATGAIYFDAQKAQQAHEAGEKVVLVRQETSPEDIDGMVISEAIVTSRGGMTSHAAVVARGMGCCCVVGCQQLQVDYEQREAHFAGRVLKEGAIISVDGHTGRLYLGALPQQTGVHETTLGTVLSWCDEIAPFAVWANAETPQEVATAFEFGAQGLGLVRTEHMFFGPERIFKMRQMILATELADRQVALAALKKLQITDFKQIFSLAEERPCTIRLLDPPLHEFLPQNEVEQAELATALGISLAEIKRRIADKAEVNPMLGHRGSRLAVTYPEIYQMQVLAIVESALAVQTTYHHAVTPKIMLPLIGTATEMAYLKQLLQQTINDYLVENQQQLTYQIGTMIEIPRACLVADQIAATADFFSFGTNDLTQMTYGFSRDDIGHFMPDYQQQGLMPAEPFQTLDQDGVGALMQLAVQKGRQTKPDLSIGVCGEVGGDPTAMPFYRDLGIDYVSCSPYRVPSARLAAAQSQLTLAD

SEQ ID NO: 65930 - protein, 181 aa, Wolinella succinogenes DSM 1740
MRASTPSLFKLFLGFMLLPAWLWSAESPVVVLETTSGTIELTLFPKAAPKAVENFTTHVKNGYYDGLIFHRVIKRFMLQGGDPTGTGTGGESIWGKPFEDEIALGYAFDREGLLAMANSGPNSNGSQFFITTARTPWLNGKHTIFGEVSKGFDVVRRIEYTETDRSDRPKKEQKILKAYLK

SEQ ID NO: 65931 - protein, 309 aa, Wolinella succinogenes DSM 1740
MRGYKIFTGSAHPEFGGEIAKYLGIPLSSATVNRFSDGEINIQISESVRGRDVFIVQPTCAPTNDNLMELLIMIDALKRSSASSINAVIPYFGYARQDRKAAPRVPITAKLVADLLQRAGATRVITMDLHAGQIQGFFDIPVDNLYGSIVFRDYVKSKHLPNPIIASPDIGGVARARYFADQLGLDLVIVDKKREKANVSEVMNIIGDVQGKDVILVDDMIDTAGTMAKAAEVLKSKGATSVIALGTHPVFSGSAYEKIEKGALDEMVVANTIPLKKESSKIKVLSVAPLFAEVIRRVYHNESVNSLFV

SEQ ID NO: 65932 - protein, 268 aa, Bacillus clausii KSM-K16
METTWVELERQARAWIVEAGDAIKQALHRPFHIDAKSGPNDLVTDVDKSTESFFYDNIVATYPTHHFLGEEGIADRLDTLDGIVWIIDPIDGTMNFVHQKRNFAISVGIYENGKGKVGLVYDVMSGELFHAIEGVGFFINDRKQSPAKGNELAQSVIGINGNWLVKDNLPIQPDLVDIAKTCRGTRSYGSAALEMAYVASGLLDAYISPKLSPWDYAGGAVLLQEAGCKTTRFNGEALSLLERGSIVAAKPSLHETLVSTYLHKGEST

SEQ ID NO: 65933 - protein, 411 aa, Oryza sativa Japonica Group
MNALAATSRNFRQAARLLGLDSKLQKSLLIPLREIKVECTIPKDDGTLATFVGFRVQHDNSRGPMKGGIRYHPEVDPDEVNALAQLMTWKTAVAAVPYGGAKGGIGCTPGELSRSELERLTRVFTQKIHDLIGINTDVPAPDMGTNAQTMAWILDEYSKFHGHSPAVVTGKPIDLGGSLGRDAATGRGVMYATEALLTEYSESISGSTFVIQGLGNVGSWAAKLIHQKGGKIVAVGDVTGAIRNKSGIDIPALLKHRSEGGSLEDFYGAEVMDAAELLVHECDVLVPCALGGVLNRENAAEVKARFIIEGANHPTDTEADEILAKKGVIVLPDIYANSGGVVVSYFEWVQNIQGFMWDEEKVNRELQKYMKNAFQNIKDMCKSQNCNLRMGAFTLGVNRVAKATLLRGWEA

SEQ ID NO: 65934 - protein, 445 aa, Oryza sativa
  misc_feature (308)..(308): Xaa can be any naturally occurring amino acid
RETASLSLSLSLHSLSRPAAAAASALRKRPVLLLDQRPHPSTPNLDSSAAAAAAAAAAGVAQAQPPPPRRKKAGHTSSSTRPRWQTALSVAAKNAVLLAVLLYVGDLAWRAARPAPPRPVDQAAMAGYDARVADVEASLARAFRMLQVQLEAVDRKIDGEVGAVRGELAALLEEKRLELEGQLKRLDARADDLSDALGALKRMEFLRKDEFDKFWNEVKESLGSGPGTEVDLDQVRALAREITMGEIEKHAADGIGRVDYAVASAGGKVVRHSDAYDAGKRGGFFSSLLSGDTAASPKKILQPSFGEXPGQCFPLQGSSGFVEIKLRKGIVPDAITLEHVSKDVAYDMSTAPKDCRVSGWYQEAHNEAYSGHAASAKMYVLTEFTYDLDKKNVQTFDITAPDVGIINMVRLDFTSNHGSSALTCIYRIRVHGHEPVSPGMSVSQS

SEQ ID NO: 65935 - protein, 476 aa, uncultured bacterium
MEDGRMTPEQVLEFAKENNVEFVDVRFLDFPGLWQHLTVPVTELTLQSFTQGFGFDGSSIRGWQAINESDMLIIPVPDTAIIDPFCQHPTLSMICDIQDPLTRQRYSRDPRSIARKASDHMCSTGIADTAYFGPELEFFIFDQVCYDQGMNYAHYRVDSREGTWRRGQDEPDNLGNQLRPKEGYFPVPPADTMHNLRSEMVAVLQQCGIEVETHHHEVATGGQAEIDMRFDKLVRMGDKMMLYKYILKNVAARHGKVVTFMPKPLHGDNGSGMHTHFSLFKGDQPLFFDKDKYAEFSDLGRWSIGGLIKHAGAVVAFTNPTTNSFKRLVPGFEAPVNLFWSMRNRSAFVRIPVYQHNPNTKRIEFRCPDSSCNPYLAFSAILMAALDGIENRLDPGPAVDENLYEMSPERVAEIGQTPTSLEGALDALGRDHQFLLKGGVFTEDVIHYWIQYKMDNEVNQLRSRPHPYEFCLYFDI

SEQ ID NO: 65936 - protein, 439 aa, Xanthomonas axonopodis pv. citri str. 306
MSSTVPPLSFARILALNAGFFGVQYSFGLQQSNMSPIYNYLGADHANLPYLWLAGPITGLVLQPFVGAWSDRSVTRWGRRMPYMVLGALVCSLCLLAMPFSTALWMAVCLLWVLDAANNVAMEPYRALVSDVLTPPQRPLGYLTQSAFTGLAQTLAYLTPPLLVGMGMNQDAANAHHIPYVTIAAFVIGAGFSAGSILLTARSVREPAIAPAEIARIRQSGAGLGATVREIGSALREMPPTMRQLAPVMLFQWYAIFCYWQYIVLSLSTTLFGTTDPTSHGFREAGLVNGQIGGFYNFVAFLAAFAMVPVVRRFGPKYTHAACLVAAGIGMWLLPGIENRWLMLLPMIGIGLAWASMMGNPYLMLADSIPPERTGVYMGLFNLFIVLPMLIQIVTLPLYYEHVLHGDPRNVVRLAGALMLAAAAAMLCVRLRKPKAVAA

SEQ ID NO: 65937 - protein, 505 aa, Moritella sp. PE36
MQIQIIESYFNKIVTSPVFDYLKPTPVDRLVNLSKQTNNDIYLKREDLQDINSFKIRGAYQKIISLPLIQLNRGVVAASAGNHAQGVAKVCKELGTTATIVMPDTTPKIKVDAVRSYGANVVLHGVNYDEAYRYAYNLADSRDLSLIHPFDDIEVICGQGTIGLEFASQVEQLDYLFVQVGGGGLLAGLTIAMNTLSPSTKIIAVEPEGAQTLGVSLRAKVISKLDSICSFSDGVAVGQIGKLPYEICKDAIDDHMTVSKDEVCSAIQYIHEDTRAIAEGSGAVGLAGAYKYLKDHHIKGKKIGVILSGSNMNFQKLEYVAQRCNLGQKKEKLVYLTIPEKQGELIKLVDQLSEVDITELKYRKSASEQANIMVSFSSVDDTSLVNSTLDLLRENGYKALDMTDSDVGKSHLRFMIGDSNLTTSKKSEKFYRFEFPEKKGQLLIILQHIYSNVDFTAINYRKDGSSFCSLLLGIEANYKPCVQEFLEKYSCTISDVTLPQSEFVD

SEQ ID NO: 65938 - protein, 514 aa, Medicago truncatula
MKHFWRFTLKASKSSKFNQLHTLSNPTFIKRYSNSNTPQNPNKVLDLVSFLKPSTSIPNPESTEQIPNQALDLVSLFKPLNQEDKVAILVKDLICVASDSVSVTSILDENSEFLIGSHPVYIQLLNQLDSKPSLLLEVINWRRKRKVSFSDACRNSMQAHEYSKGIKAAGRSRNIDLAVALFKEAEFKGVKITSTYNALMGAYMFNGLSDKCYSLFLDMKKDPTCFPSVATYNIVISVFGRLMLIDHMEATFKEMNELPLAPNISTYNYLIGGYISTWMWGDMERVFQVLNSGPVEPNMKTYLLMIRGYAHLGNLEKMEKIYSLVKDNVNDMPIIRVMICAYCKSSDADKMNKVKALLKLIPEKEYRPWLNVLLIKLYAEGNCLEEMDNAINEAFERRTVVTTMGIMRCIITAYFRNNAIESLEKFTRRSVLAGWRMCYSLYHSKLVMYGSQKNLREMQNVLEEMDSVNIQRTKKTMWIMYKAYWNCGQRSMVLKILGQMFKHGHEVPIDAFPS

SEQ ID NO: 65939 - protein, 267 aa, Desulfitobacterium hafniense Y51
MKKISFIGAGNMAEAIIKGLTGAGSYEIRVTNRSNQAKLAQMKEDYGIIPASFMEAVKDSEIILLAVKPKDVGEVLAQAREGMKSNQLLISVAAGIPLVLLEKHLPHCPIIRAMPNTSSAVLHSMTGLVKGQSVTEENQRDVEAIFGAVGKYIWITEEQMNPLIAMSGSGPAYFYLFTEALVKAGVDMGFSQEAAENLAKETLMGAAKMLAQSGKSPGELRVAVTSPKGTTQEALNVFLEKGLEELVAQAAKACKHRAQAMEREYLG

SEQ ID NO: 65940 - protein, 272 aa, Xylella fastidiosa Ann-1
MAGTSAVITIPSDLHESVIAIATDSGRAIMEIYQDHFKVQIKADMSPLTQADLISHQIIVHGLKQLTPSLPVLSEESTGITWEERRHWKSYWLVDPLDGTREFVKRNGEFCINIALIHEGIPVYGMILAPVEGTIWHAMHGGQAFRRDGHRDTTLHVRAPAGTALQVAASRSHIDVHTSALLAQMKEITLVSQGSALKFCRLAEGTLDVYPRLGATYEWDTAAGQCLLLAAGGTLLNIETGKPFRYNKRETLLNGGFIALGDATLPWRDWLP

SEQ ID NO: 65941 - protein, 423 aa, Xanthomonas axonopodis pv. citri str. 306
MSTAPQKPLAIRERLSEVRYEIRGELARRARELEAQGRKLIKLNIGNPGAFGFRAPEHLQRAIADDMGRTDPYTHQQGLPEAREAIATAYARRQHPDAHPDRIFVGNGVSELIDLSLRALLNPGDEVLVPSPDYPLWSAATILNDGRPVYYRCAPENGFQPDPVEIETLVSSRTRAIVLINPNNPSGASYSRELLERIVAIATKHNLLLMVDEIYDQVLYDDAAFVPVAPLAGAHPCITFSGLSKVHRACGWRVGWALLSGDQARINDLRNAMDLLGALRLCANVPGQYAIDAAVNGPDTISALCAPGGRLYETRRAVIEACAASEHLSLVAPAGALYAFPAVVGAAARNFDDHAFALDLMNEEGVLVVPGSSFNVPYRHHFRVTLMPEAGVMRDVFARIDRALARRAEAVTKVVPLKPRSVA

SEQ ID NO: 65942 - protein, 485 aa, Xylella fastidiosa Ann-1
MHHNVHQSEILADPCDLQRAERWRQRDLRVLWHPCTQMREHPDTLPLVPIVRGEGVWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACSAISTDTDDKQLGIMPDLLCLSKGLTGGVLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEEQLHLLAETTRVAIDEAIACV

SEQ ID NO: 65943 - protein, 334 aa, Klebsiella pneumoniae
MKFLITGAAGFIGFHIAQRLLNEGHDVVGIDNMNDYYDVSLKQARLDRLASPAFHFQQLDLADREGMAKLFATEQFNRVIHLAAQAGVRYSLENPYAYADANLMGYLNILEGCRHTKVKHLVYASSSSVYGLNRKMPFSTEDSVDHPVSLYAATKKANELMAHTYSHLYGIPTTGLRFFTVYGPWGRPDMALFKFTKAMLEGKSIDVYNYGKMKRDFTYIDDIVEAVVRVQDVIPQANANWTVESGSPATSSAPYRVYNIGNSSPVELMDYITALEEALGMEAQKNMMPIQLGDVLDTSADPQPLYDLVGFKPQTSVKEGVKNFVEWYKDYYQI

SEQ ID NO: 65944 - protein, 86 aa, Oryza sativa Japonica Group
IEKKAKGPLDPPTTPRPPRRRRKRRRSRMFFSRFDPWPVFFRREWKRCWPFLTGFAVTGAIITKMTAGFTEEDLKNSKFVQAHKKH

SEQ ID NO: 65945 - protein, 309 aa, Yarrowia lipolytica CLIB122
MTSLDFTMNNGKTIPAIGLGTWKSTTEEVAGAVECALTEGGYRHIDTAFNYRNEDAVGLGIKRAMEKGVKREDIFVTTKIWVTYHDRVEENLDLSLERLGLDYVDMLLIHWPVPLNPNGNDPVYPLREDGSRDIDESGSQPKTWKQMEAVLKTGKTKSIGVSNFSIPYLEELLKEAEVVPAVNQVELHPLLPQLELMEFCKKHNIVMTAFSPFGSVGGPLLKNELVLKLADKYKTTPGGILTSYHIGNGTVVIPKSVTNSRIIENGKSAVTLNQEDLKSLNDLHKTEGIHRTSKPKWGVDLGFPDFDFC

SEQ ID NO: 65946 - protein, 384 aa, Schizosaccharomyces pombe
MSGYGQQGVSAANIDSIRPKKRLSIGVVGSGNWGTAIAKICGENARAHGHHFRGKGRMWVFEEEIEYKGEKRKLTEVFNEAHENVKYLPGIECPPNVIAVPDVREVARRADILVFVVPHQFIERVWHQMVGLIRPGAVGISCIKGVAVSKEGSLYSEVISEKLGIYCGVLSGANVANEVAREQFCETTIGFNPPNEVDIPREQIAAVSDRPYFSVVSVDDVAGVALGGALKNVVAMAVGFADGLEWGGNTKAAIMRRGLLEMQKFATTFFDSDPRTMVEQSCGIADLVTSCLGGRNNRCAEAFVKTGKSLETLEKELLGGQLLQGAATSKDVHEFLLTKDMVKDFPLFTAVYNISYEDMDPKDLIIVLQPLKEDSENEGGTETE

SEQ ID NO: 65947 - protein, 169 aa, Glycine max
PLLSGFDTSLGEDEIRGSLQEHFGSCGDITRVSIPKDYESGAVKGFAYVDFSDVDSMGKALELHETELGGYTLTVDEAKPRDNQGSGGRGAGGRSGGGRFGGRSGGGGGGRFGGRGGGGRFGGSGGGGRFGGSGGGRFGGRGGGGRGRGNRPNLAAEGTGKKTKFADDE

SEQ ID NO: 65948 - protein, 242 aa, Glycine max
LLLHLFRWRKPFSPENPPQPSRFAIPLPVSPCSSYTQHMGKTSWLIILVTCLCLLAFSDGRELKVRHKKPHYQYNHTLATILVEYASAVYLSDLTELFTWTCSRCNGLTKGFEMIELVVDVEHCLQAFVGVADDPHAIIIAFRGTNEHSLQNWIEDLYWKQHDINYPGMDDAMVHRGFYTAYHNTTIRPAILDAVERAKKFYGDIEIIATGHSMGGAMASFCGLDLTVNQNEKNVQVMTFGV

SEQ ID NO: 65949 - protein, 463 aa, Synechococcus elongatus PCC 6301
MPDSVVLPATLQTALQTAEQLLWDRALVRYHDQWAGAIAALPEDQELAAANYREIFIRDNVPVMLYLLLQGKTDVVRDFLQLSLSLQSQALQTYGILPTSFVCEETHCVADYGQRAIGRVVSADPSLWWPVLLQAYRRASHDDAFVHSPTVQQGLQRLLAFLLRPVFNQNPLLEVPDGAFMVGRPLDVAGAPLEIQVLLYGALRACGQLLQYTEAANAAHVQARRLRQYLCWHYWVTPDRLRRWQQWPTEEFGDRSHNPYNIQPIAIPDWVEPWLGESGGYFLGNIRAGRPDFRFFSLGNLLAIVFDVLPLNQQGAILRLILQNEAQILGQVPLRLCYPALTGSAWKILTGCDPKNQPWSYHNGGSWPSLLWYLSAAVLHYQQRGGDRNLCQVWLNKLQHYHTQQCEQLPGDEWPEYYEGQDSVQIATRACRYQTWTFTGLLLNHALLSQPQGIQLLSLRGLP

SEQ ID NO: 65950 - protein, 173 aa, Oryza sativa
MGDRERRTVFVTVGTTCFDALVKAVDSPQVKEALLEKGYTDLIIQMGRGTYVPSKVVSGDGTLQVDYFTFSPSIADYIRDASLVISHAGSGSIFETLRHGKPLIVVVNEDLMDNHQSELAEELATRKHLFCASPQTLGETIQEMDIETLNPYVPGDAKPVVSLINKFFGFPDD

SEQ ID NO: 65951 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPMSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDEYALFEATHGTAPDIAGQDKANPGSIILSAEMMLRHMGWTEAADLIVKGMEGAINAKTVTKDFESLMDGAKLLKCSEFGDAIIENM

SEQ ID NO: 65952 - protein, 373 aa, Oryza sativa Japonica Group
MAGKENAAAAQPRLTRAAAKRAAAVTAVAVAAKRKRVALSELPTLSNNNAVVLKPQPAPRGGKRAASHAAEPKKPAPPPAPAVVVVVDDDEEGEGDPQLCAPYASDINSYLRSMEVQAKRRPAADYIETVQVDVTANMRGILVDWLVEVAEEYKLVSDTLYLTVSYIDRFLSAKSINRQKLQLLGVSAMLIASKYEEISPPNVEDFCYITDNTYMKQEVVKMERDILNVLKFEMGNPTTKTFLRMFIRSSQEDDKYPSLPLEFMCSYLAELSLLEYGCVRLLPSVVAASVVFVARLTLDSDTNPWSKKLQEVTGYRASELKDCITCIHDLQLNRKGSSLMAIRDKYKQHRFKGVSTLLPPVEIPASYFEDLNE

SEQ ID NO: 65953 - protein, 64 aa, Glycine max
MVKVATYFAMTLGAFVFWQSMDKLHVWIALRQDEKKERLEKEAEIRRVREELLQQQASQKDSLS

SEQ ID NO: 65954 - protein, 502 aa, Delphinium grandiflorum
MSISLFLAGAAILFFVTHLLLSPTRTRKLPPGPKGWPVVGALPMLGNMPHVALANLSRRYGPIVYLKLGSRGMVVASTPDSARAFLKTQDLNFSNRPTDAGATHIAYNSQDMVFADYGPRWKLLRKLSSLHMLGGKAIEDWAVVRRDEVGYMVKAIYESSCAGEAVHVPDMLVFAMANMLGQVILSRRVFVTKGVESNEFKEMVIELMTSAGLFNVGDFIPSIAWMDLQGIVRGMKRLHNKFDALLDKILREHTATRSERKGKPDLVDVLMDNRDNKSEQERLTDTNIKALLLNLFSAGTDTSSSTIEWALTEMIKNPSIFRRAHAEMDQVIGRNRRLEESDIPKLPYLQAVCKETFRKHPSTPLNLPRVAIEPCEVEGYHIPKGTRLSVNIWAIGRDPNVWENPLEFNPDRFLTGKMAKIDPRGNNSELIPFGAGRRICAGTRMGIVLVEYILGTLVHAFEWKLRDGEMLNMEETFGIALQKAVPLAAVVTPRLPPSAYVV

SEQ ID NO: 65955 - protein, 406 aa, Physcomitrella patens subsp. patens
MAGTAFTAATVPSSASLKVAGSNGFSDFSGIKSTSAVTFGKRSEDLASIVSAQSAVSASSGAKRAVTEAKIKVAINGFGRIGRNFVRCWHGRKDSPLDVVVINDTGGVKQASHLLKYDSMLGTFDADVKVEGNDAISVDGKVIKVVSDRNPLNLPWGDMDIDLVIEGTGVFVDEAGAGKHIQAGAKKVLITAPGKGAIPTYVVGVNEKDYKHSDSIISNASCTTNCLAPFVKVLDEKFGIIKGTMTTTHSYTGDQRLLDASHRDLRRARAAALNIVPTSTGAAKAVALVLPNLKGKINGIALRVPTPNVSVVDLVVQVEKKTFAEEVNQAFRDACATEELKGVLAVCDEPLVSVDFRCTDVSSTVDSSLTMVMGDDMVKVVAWYDNEWGYSQRVVDLAHIVAEKWQ

SEQ ID NO: 65956 - protein, 369 aa, Acinetobacter baumannii
MKSRAAVAFAPGKPLEIVEIDVAPPKAGEVLIKITHTGVCHTDAFTLSGDDPEGVFPAILGHEGAGVVIEVGEGVTSVQPGDHVIPLYTAECKECLFCKSGKTNLCVAVRATQGKGVMPDGTTRFSYKGEPIYHYMGCSTFSEYTVVAEVSLAKINPEANHEQVCLLGCGVTTGIGAVHNTAKVQEGDSVAVFGLGGIGLAVVQGARQAKAGRIIVVDTNPDKFELAKQFGATDFLNPKDYDQPIQQVIVEMTGWGVDHSFECIGNVNVMRSALECAHRGWGQSVIIGVAGAGQEISTRPFQLVTGRKWLGTAFGGVKGRSQLPKMVEDAMKGDIQLEPFVTHTMPLQDINTAFDLMHEGKSIRTVIHF

SEQ ID NO: 65957 - protein, 446 aa, Xylella fastidiosa Ann-1
MNFETLGLLPSLLRALSEQGYEIPTPIQQQAIPLALAGHDLLAAAQTGTGKTAAFGLPVLQRLMAASSNVGAGKPRALVLTPTRELATQVHDSLRGYAKYQRVSSAVIYGGVGMGNQLDVLRRGVDLLIACPGRLIDHIERRSVDLSGVGILVLDEADRMLDMGFLPSIKRILGKLPRQNRQTLLFSATFAEPIKQLALEFMCRPREVMVASHNTVAETITHRVHPVDVSRKRELLLYLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVHTTPALKKQSGVQHSNGSRNRDGMFPVHQRG

SEQ ID NO: 65958 - protein, 403 aa, Propionibacterium acnes KPA171202
MSNRVIRLMGPAFVAAVAYVDPGNVAANLAAGAGYGYLLVWVLVVANVVAMLVQYLSAKLGLVTGHSLPELVGGALPRRGSRLAYWFQAELVAAATDLAEVIGGAVALQLLFGLPLIVGGLMTGALSLAILAIPSRHGQRTFEIVIIGMLVVIAIGFTAGLAFSPLSWGGVASGLVPRFEGTETVMLATSMLGATVMPHAVYMHSSLVRDRHGTDDRPKRITTLLRATRWDVAVSLVLAGSVNIAMLLLAAASLQGVKGIDGIAEAHAAMSNSMGPVVGLIFAVGLFASGLASTSVGAYAGAEIMAGLLHMRVPMLVRRLVTIIPALIILASGANPTQALVWSQVLLSMGLPLVLVPLARFTGDRRLMGQWTNGRVMAAIAWIVVAAVSALNVVLVVETVMGA

SEQ ID NO: 65959 - protein, 487 aa, Carica papaya
MVLMLRNQELLSKIATSNGHGEDSPYFDGWKAYDSDPFHPTQNPEGVIQMGLAENQLCFNLIHEWLLKNPEASICTAQGAAEFRDIAIFQDYHGLAEFREAVAKFMGKVRRNRASFDPDRIVMSGGATGAHEMIAFCLADPGDAFLVPTPYYPGFDRDLRWRTGVKLIPVVCESSNDYQITIEALEAAYETAQEADIKVKGLLIPNPSNPLGTIITKDTLEALVTFTNHKNIHLVCDEIYAATVFSQPEFTSIAEIIEEDKICCNRDLIHIIYSLSKDMGFPGFRVGIVYSYNDAVVSCARKMSSFGLVSSQTQYLIASMLADDEFVDQFIVESRKRLAMRHSFFTQRLAQVGINCLKSNAGLFVWMDLRRLLKEQTFEAEMVLWRVIINEIKLNVSPGSSFHCSEPGWFRVCFANMDDKTMEIALSRIKTFMLQHKEAMVPKKKLCWQTSLRLSFSSRYEDIMETPGSFMSPHSPIPQSPLVRART

SEQ ID NO: 65960 - protein, 495 aa, Chlamydomonas reinhardtii
MLALAGGLQSMLQVSSPLVTHKITYGSLRLSSPPPPAFPAGPSGDQTLPLLTDPLRFLTDATATYGPVVGLLLGGERVALVTGRAEARAVLVEAAGEVYVKEGTAFFPGSSLAGNGLLVSDGPVWQRQRRLSNPAFRRAAVEAYGGAMVAATEDMMRRVWGPAGGTRDVYADFNELTLQVTLEALFGFGSADEDAAQIVAAVEKAFTFFTQRAATGFVIPEWLPTWDNLEFAAAVQQLDRVVYGMINRRRQELAAAFGAGVPSDLLTSLLLARDEDGSGMSDQALRDELMTLLVAGQETSAILLGWASALLAAHPEVQAAAAAEVAAVCGGPEAGTPTPASVRHMPYLESVVLETLRLYSPAYMVGRCARRDAALGPYVLPAGTTVLVSPYVMHRDPEVWEEPEVFRPERWQELQRSNLGPNGAYLPFGGGPRNCIGTGFAMMEALLVLAALLQRYSLALPPAAGSSSGGAFPKPKPLLTLRPEAVVLRISPRRQ

SEQ ID NO: 65961 - protein, 452 aa, Propionibacterium acnes KPA171202
MTEPDQQLHRSLRNRHIQLIALGGAIGTGLFYGAADSIAAAGPAVIVSYLIGGVVIYLIMRALGEMSVHNPTSGAFSEYAHQWWGDLPGFISGWNYWFNYIFVSMAELSVVGIYINYWFPVVPRWVSAAVLLAIVTTVNLLHVRAYGEVEFWFAIIKVVAIIAMIVLGLWIIFFGTGSTPATGIGNLWRNGGFLPHGVTGMLAGIIVVMFSFGGTELIGITAGEAEDPQRSIPRAINRVVGRILLFYVGALIVMVAIVPWTKIDGNASPFVQIFDLVGIPGAAAILNLVVLTAAISAYNSGLYANGRMLHALAHQGDAPAFLGKVNKAGSPWAGVLLSSAVTAIAVVVVGLLPEQAFVYIMSIAMIAAIINWATIIITQMLFRRRLDPESRSELRFTMPGAPVTNWIVLAFLVLMVVVMTTMPPYRIAVAIGPIWLAVLGLGWRVSRRRQTL

SEQ ID NO: 65962 - protein, 100 aa, Oryza sativa
MADTGAQTQSADQNRGERGFGRGGRGGRGRGGPREGGRGGRGGRGGAKEESGRWVPVTKLGRLVSEKLIKRLEEIYLYALPVKEYQIIDWFLGTKLKDEV

SEQ ID NO: 65963 - protein, 347 aa, Propionibacterium acnes KPA171202
MTETMLAERFHAADRSITLEDIPIPHPGPGEVLVKVAYCGICHSDLSLISGAFPAALPVVTQGHEASGTIVELGAGVIGWKEGDRVIPSAGRPCLKCRKCRRGAFTDCLDLNLMAFAYDGAWAEYHIAQASGMTKIPDNVPLDQAALLADAVSTPYAAVVRTGKVHMGNAVAVWGVGGVGTHLVQLAKLAGGVPVIAIDLNDAVLERAKRVGADHTLRSDDPELMQKIEDITHGRMIDVAFDAVGIKPTLRACVDSLDVDGKAVSVGLSAQDIDAGPFLNFNLQRKQVLGHLGYKSQDIALLAEMLSYHRLDLTESISKVIPLKDVESGIAELESHQGNPIRILVKP

SEQ ID NO: 65964 - protein, 396 aa, Vitis vinifera
MASASLLKSSPVLDKSEWVKGQSLRQPSVSVVRCNPVAPSVLTIRAGSYADELVKTAKTIASPGRGILAMDESNATCGKRLASIGLENTEANRQAYRTLLVTAPGLGNYISGAILFEETLYQSTTDGKKMVDVLVEQKIVPGIKVDKGLVPLVGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGAECKDKATPEQVAQYTLKLLSRRIPPAVPGIMFLSGGQSEVEATLNLNAMNQAPNPWHVSFSYARALQNTCLKTWGGRPENVKEAQDTLLLRAKANSLAQLGKYTGEGESEESKQGMFVKGYVY

SEQ ID NO: 65965 - protein, 486 aa, Pseudomonas putida
MKEFLNFINGEYVRNASGKTFQDINPVNGQVIGNIYEAGQVEVDAAVAAARAALKGDWGRLSVAERCKLLDAVAGEINRRFDDFLQAEIADTGKPHHLASHVDIPRGAANFQIFIDTIKSTATESFNMRTPDGKTALSYGVRVPRGVIAVVCPWNLPLLLMTWKVGPALACGNTVVVKPSEETPATATLLGEVMNAVGMPKGVYNVVHGFGPASAGEFLTKHPGVNGITFTGETRTGTAIMKAAADGVRPVSLEMGGKNAAVVFADCDFQVTIDTLTRSCFENAGQVCLGTERVYVERPIFDKVVAALKERAEAMKPGLPFDHDTRIGPLISKKHQAKVLGLYKTAKDEGATIVTGGGIPDMPEELKNGSWVQPTIWTGLPETATVVTEEIFGPCCHISPFDSEEEVLGKVNANRYGLATAIFTQDIARANRLAHQIEVGLCWINAWFLRDLRTPFGGSKQSGIGREGGVHSLEFYTELRNVMVKF

SEQ ID NO: 65966 - protein, 431 aa, Bordetella parapertussis 12822
MSISQQAFLRDAMRRLNLTRDVFAGRIGVKRRALDTWLLPEGSQEFRAMPEVVERFVSEIVQNRDLLEKYTQSGQVGPLRDRIAVEGRHQLLSVDQFTRESVEDLFRVADMMQPIARRQKVSRVLEGAVLGNLFFEASTRTRVSFGAAFCRLGGSVCDTTGFTFSSMAKGESIYDTSRVMSGYVDAMVIRHPEQGSVAEFAQATNIPVVNGGDGPGEHPSQALLDLYTILTEFSRLGKLLDGAHIAMVGDLKYGRTVHSLIKLLALYKGVKFTLISPQGLEMPDYIVEQASRNGNVIEQKSTLAEGLAGADVIYATRVQKERFANEEAGEGYTADFQVSRAIIDAYCGPDTIVMHPLPRDSRPGSNDLSTDLNHDPRLAIFRQTDNGIPIRMAIFAVLLGVEGLVQHSMRDVTWQHPSHIGPDDSVFHGLD

SEQ ID NO: 65967 - protein, 374 aa, Arabidopsis thaliana
MTITAFLARRLIGNGSSQILGTSSSSSGPFISVSRAFFSSSTPIKATLFPGDGIGPEIAESVKQVFTAADVVIDWDEQFVGTEVDPRTNSFLTWDNLQSVLKNKVGLKGPMATPIGKGHRSLNLTLRKELNLYANVRPCYSLPGYKTRYDDVDLITIRENTEGEYSGLEHQVVKGVVESLKIITRKASMRVAEYAFLYAKTHGRKKVSAIHKANIMQKTDGLFLQCCDEVAAKYPEIYYEKVVIDNCCMMLVKNPALFDVLVMPNLYGDIISDLCAGLVGGLGLTPSMNIGEDGIALAEAVHGSAPDIAGMNLANPTALLLSGVMMLRHLKLNKQAEQIHSAIINTIAEGKYRTADLGGSSTTTDFTKAICDHL

SEQ ID NO: 65968 - protein, 434 aa, Zea mays
MERGEQAHRSLSPPPSFLSRTTRGLIVPACRARSARQKEGRTRGTRFQMADCMQEWPEPVVRVQALAESGLSVIPSCYVKPPCDRPAPAPAPTMAPPAPAVHPRKKEPSSDAIASIPVVDLGELLAADGAVATVTEAVAAACRDWGFFQVVNHGVRPELMRAAREAWRGFFRRPPAEKQRYANSPRTYEGYGSRLGVQRGAVLDWGDYFFLHLAPEAAKSTPRFWPAQPSNCKDVSEEYGREVVRLCELLMRVLSVSLGLDEAHLQRAFGGAECGATLRANYYPRCPQPDLTLGLSAHSDPGALTVLLADEHVRGLQVRRAAADDWVTVQPVRDAFIVNVGDQVQILSNSVYKSVEHRVVVNAEEERISLALFYNPKGDVPIAPAPELVAAASLPALYPTMTFDEYRLYVRNKGARGKAQIEAFKGQGTPESQL

SEQ ID NO: 65969 - protein, 487 aa, Aspergillus oryzae
MASFITDDEFRSLHQKLRAAFTDNRTRDVRWRKWQLKQLFWLLDENEDALVKAMADDLHRHAFESLSYDVSDVKNTILTMLKNVDTWSQGAPPPEAGLFFRYVGKAWIRKEPRGVVLIIGAWNYPLSTLLSVAAAAIAAGNSVILKPSEIARHTELLLSELVPTYLDSSAIALIRADPASMGTILEYKFDFIFYTGSTRVGRIIAEAAAKHITPTALELGGQAPAIVTKSADIEVTAKRLVAAKLTNLGQICVCVNHVYVDPEVHDSLVARLIYWTERFSKGDGLNGLARMVGERQYDRLHNLLEHTQGKKVFEGPHSRKEKLIFPTVVTDVKLDDSLLSEELFGPVLPVVKKTVPEVLDILRGSPYPLGLYIFSNDSTEIDTILNFTNSGGVTINDVAIHADVPSAPFGGVGDSGYGAYHGKWGFDTFSHNRTVVRVPTWIDRFVQWRYPPFDIKNRSETDAPRLRFKKGETLEDQGGSGMGCVVM

SEQ ID NO: 65970 - protein, 605 aa, Brassica rapa subsp. pekinensis
MALTLTVLILACLLSLVSPDAQGDALFALRMSLRALPNQLSDWNQNQVNPCTWSQVICDDKNFVTSLTLSDMNFSGTLSSRIGILGTLKTLTLKGNGIAGGIPEEFGNLTSLTSLDLEDNELSGFIPSTLGNLKKLQFLTLSRNNLNGTIPVSLTGLPNLINLLLDSNRLSGQIPQTLFEIPKYNFTGNNLNCGVGQPHPCVSEVARSGDSSKPKTGIIAGVVAGVTVILFGILVFLFCRDRHKGYKRDVFVDVAGEVDRRIAFGQLKRFAWRELQLATDNFSEKNVLGQGGFGKVYKGVLPDNTKVAVKRLTDFESPGGDAAFQREVEMISVAVHKNLLRLIGFCTTQTERLLVYPFMQNLSLAHRLREIKAGDPVLDWETRKRIALGAARGFEYLHEHCNPKIIHRDVKAANVLLDEDFEAVVGDFGLAKLVDVRRTNVTTQVRGTMGHIAPEYLSTGKSSERTDVFGYGIMLLELVTGQRAIDFSRLEEEDDVLLLDHVKKLEREKRLGAIVDKNLDGDYVKEEVEMMIQVALLCTQGSPEDRPVMSEVVRMLEGEGLAERWEEWQNVEVTRRHEFERMQRRFDWGEDSMNNQDAIELSGGR

SEQ ID NO: 65971 - protein, 393 aa, Bordetella parapertussis 12822
MSSALANIYARLPVSFTHGRGVWLWDTGERRYLDALAGIGVSCLGHGHPGLVAAISEQAARLIHTSNIYEVPQQAALARRLAELSGMSEVLFSNSGSEANEAAIKLARYYGYKQGNTHAHIITMDSSWHGRTLATLAATGSDKARQGFGPMPSGFIQVPYNDLPAIRAAGEAEPRVTAVLLEVLQGEGGIRPSDMAFLRGVRQLCTERGWLLMIDEVQSGIGRTGKWFAHQWADIRPDVMTLAKGLAGGVPIGAMLAAGPAAGVFAPGSHGTTFGGGPLACAAGLAVIDAIEQEGLLANAHEVGAHLHAALASELAGVPGIIEVRGHGLMLGIELDRPCGILATRAMEAGLLINVTRERVVRLLPPLILSGEEADQIVRILVPLIKQFLAQQQ

SEQ ID NO: 65972 - protein, 578 aa, Zea mays
MLSRLAAARRQLLLSPAVAYRSSSAAATASAVHERAAPASASVLPDTLERGSDAYQRNTAAVGGLLSDLRARVSQVLRGGGAEAVRRNAARGKLLPRDRIDRLLDPGASFLELSQLAGSDVYDEALPSAGIITGIGPVHGRLCMFVANDPTTKGGTYYPLTVKKHLRAQEIASECKLPCIYLVDSGGANLPRQADVFPDRDNFGRIFYNQAKMSSDGIPQIAVVLGSCTAGGAYIPAMADESVIVKGNGTIFLAGPPLVKAATGEEISAEDLGGASVHCKVSGVSDHFAQDEIHGLELGRNIVKNLHLAAKGTNIQSSACGYQEPLYDVEELRSIAPADVKQSFDIRSIIARIVDGSEFDEFKKLYGTTLVTGFARICGQPVGIIGNNGILFTESALKGSHFIELCAQRHIPLIFLQNITGFMVGSKSEASGIAKAGAKMVMAVSCAKVPKITIIVGGSFGAGNYGMCGRAYSPNFLFLWPTARISVMGGIQAAGVLAQIEKNNKKRQGVEWSKDEEEAFKAKVVEAYDREGSPYYSTARLWDDGVIDPADTRRVLSLCLSASAKPVPEDTRYGVFRM

SEQ ID NO: 65973 - protein, 368 aa, Brassica rapa subsp. pekinensis
MARTKQTARKSTGGKAPRKQLATKAARKSAPATGGVKKPHRFRPGTVALREIRKYQKSTELLIRKLPFQRLVREIAQDFKTDLRFQSSAVAALQEAAEAYLVGLFEDTNLCAIHAKRVTIMPKDIQLARRIREGKFNVANPTTGCQKKLEIDDDQKLRAFYDKRLSQEVSGDALGEEFKGYVFKIMGGCDKQGFPMKQGVLTPGRVRLLLHRGTPCFRGHGRRTGERRRKSVRGCIVSQDLSVLNLPRMRGPKRASKIRKLFNLGKDDDVRKYVRKYVNTYRRKFTNKKGKEVSKAPKIQRLVTPLTLQRKRARIADKKKRIAKANADAAEYQKLLASRLKEQRDRRSESLAKKRSRLSSAAAKPVAA

SEQ ID NO: 65974 - protein, 188 aa, Physcomitrella patens subsp. patens
NTVVTEIHVAGKKIVVTNTKEGAVAQAWLKRQIGKVFGLDAEWRPSFRKGVEHKIALLQICGEDDCLIVQMLYLDSIPTELVNFLKDPSIKFPGVGIKGDALKLKRDWGLECNGAIDLTTLAASVLGRPELKAAGLKSLAKVVMDYDMAKPKRVTMSNWAKPILDKVQVEYASLDAWVSYAIHQKLFQ

SEQ ID NO: 65975 - protein, 248 aa, Bacillus cereus G9241
MSIMKTKNEIELMHESGKLLASCHREIAKIMKPGITTKEINTFVEAYLEQHGATSEQKGYNGYPYAICASVNDEMCHAFPADVPLTEGDIVTIDMVVNLNGGLSDSAWTYRVGNVSEEAERLLLVAENALYKGIDQAVIGNHVGDIGYAIESYVASEGFSVARDFTGHGIGKEIHEEPAIFHFGKQGQGPELQEGMVITIEPIVNVGMRYSKVDVNGWTARTMDGKLSAQYEHTIAITKDGPIILTKL

SEQ ID NO: 65976 - protein, 468 aa, Bacillus clausii KSM-K16
MVVGDFAQEVDTLVVGSGPGGYVAAIRAAQLGQKVTIVEKGSLGGVCLNVGCIPSKALIQAGHRAHLAKSSEDIGIRAENVAIDFEKVQEWKGSVVKKLTGGVEGLLKGNKVEIIRGEAYFSGEDTVKIMDEKSSSTYKFKHCIIATGSSPIEIPNFKYTDRVINSTGALALKEVPKKLVVIGGGYIGIELTGAYSNLGSEVVVLEGTKQILPGFEKQMAKLVERKLKKNGVTFHTEAMAKGVEETDNGVKVTAEIKGEEKVIEADYVLVTVGRKPNTEEIGLEGIGVEMDDRGYIKVDKQGRTSVKNIFAIGDIVPGPALAHKASYEAKVAAEAISGEPSEVDYLAIPAVCFSEPELATVGYNEAQAKEAGYDVKVAKFPFAANGRALSLNDADGFMKLVTRKEDGLVIGGQIAGPNASDMIAEIGLAIEAGMTAEDIALTIHAHPTLGEITMEAAEVALGTPIHTL

SEQ ID NO: 65977 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNAAEDRAVMHMALRAPKTEKIVVDGHDVVPDVHEVLDAIRALTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLRGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQARAQLSASRTENAPVKGFNSATTSMLEAYLAHKA

SEQ ID NO: 65978 - protein, 425 aa, Bacillus clausii KSM-K16
MAYKYKLPEVGEGIHEGEIVKWFVKEGDEVKEDDILLEVQNDKSVVELPSPVDGKVLEVKVEEGTTSYVGDVILVIDDGSGDDDAEEESKEEAPKEEKQAASEPEKGQSSSEESDEEEGSRVIAMPSVRKYAREKGIAISKVKGSGKNGRVLKEDVDAFASGGQTEEAAAPKEEEKTASSKPAATAQAGGNEQLEERVPLKGIRKAIAKAMVNSKHTAPHVTHLDEVDVSALVAHRKQYKQIAADQGTKLTYLPYVVKALTSALRKYPALNASIDDEAGEIVYKKYFNVGIAADTEQGLVVPVVKDADRKSIFALADEINELAGKAREGKLSSAEMSGGSATISNLGSARGQWFTPIINHPEVMILGIGRIEEKPVVKDGEIVVGTMLALSISYDHRLIDGVTAQSALNQIKRLLNDPQLLLMEG

SEQ ID NO: 65979 - protein, 636 aa, Zea mays
MLSTRTAAVAASASPASPWKLGGRSEGGASCDGCRTYRNTLRRRAAPAKVRALPPRRVDAVAMVSNAETETEKEQEEAAAASEELPVMPWATSVASGYTLLRDPHHNKGLAFTEEERDGHYLRGLLPPAVLSQELQIKKFMNTLRQYQTPLQRYIAMMNLQETDERLFYKLLIDNVVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITIDVGTNNEKLLNDEFYIGLRQKRATGEEYDELIEEFMSAVKQFYGEKVLIQFEDFANHNAFDLLEKYSKSHLVFNDDIQGTASVVLAGLLAALKMVGGTLAEQTYLFLGAGEAGTGIAELIALEISKQTNAPIEECRKKVWLVDSKGLIVDSRKGSLQPFKKPWAHEHEPLKTLYDAVQSIKPTVLIGTSGVGRTFTKEIIEAMSSFNERPIIFSLSNPTSHSECTAEQAYTWSQGRSIFASGSPFAPVEYEGKTFVPGQSNNAYIFPGLGLGLVISGAVRVHEDMLLAASKALADQATQDNFEKGSIFPPFTSIRKISAHIAAAVAAKAYELGLATRLPPPSDLVKYAENCMYTPVYRNYR

SEQ ID NO: 65980 - protein, 1706 aa, Oryza sativa Indica Group
MEQKFHVVDKKLLDQYDATHLQTVIDLAMNCLENASIDRPSMTEVVSVLKGCSETCNSKIMAIVYFYLTNTGALRWLLAFQLFLAASMIEVHAQPPAGFLSIDCGYTDSADYVDKNTTLTYVSDKGYVEGGKNFSILAQYMKDATNKQEETLRSFPDGQRNCYTLPTNRSKKYLIRATFTYGNYDGRNSSESGSPFLFGLHIGINFWTMVNLTKLPSSDTVWKELIMVAPDNFISVYIPEDVFDRFWEGAFHTRSYPWIDLSTTQEVKRLPGDEKFMVPTTILQKASTIDSKYSWLNITVRGADNLLGSGDLELLPIFHFAEIASTTRLFDIYSDGEELFTSFSPSPFQVDSMYQNGRFLRRVNSTFTLRKQPTSQLPPPLINAFEVYSLVRIATASDDGEQNSGLNSDIFVYTLYSRAKWIEPFVNCDLAGKSKEHDDYDIYEEDTPLHTDTRRFTYTELKTITNNFQSIIGKGGFGMVYHGILDNGEEVAVKVLRETSITLSKDFLPEVQILSKVQHKNLVTFLGYCHNKKCLALVYDFMARGNLQEVLRGGLEYLHESCTPPIVHRDVKTANILLDKNLVAMISDFGLSRSYTPAHTHISTVAAGTVGYLDPEYHATFHLTVKADVYSFGIVLLEIITGQPSVLVDSEPVHLPNWVHQKIAEGSIHDAVDSRLRHQYDATSVQSVIDLAMSCVENTSIDRPSMTDIVIKLKECLPAGTGEMQLVSRSYKQKEAMDADIVRQFQLPISGVSIESIEGNSSGTTELRYPSGSEMGNHVPIIARKTNRMKMAVLHKEMSNQCNGRMTKIKAIVYCCLMSTEARWLLAFQIFLATSMIQVHAPTPPGFTNIDCGFVDGESYTDSTTNLTYVPDHEFVEGGTHHVVVPKLISGSTDEQEKTLRSFPDGQRNCYTIPSTSGKKYLIRATFTYGNYDGLRSSENGSLFLFGLHVGVNFWTTVNLTKQNSSDTIWKEVLTVAPDEFISVCLVNFGSGTPFISALELRQLDDPMYPFLNLSVSVSYFTRQRFGAVDDFITRYPTDLFDRFWEAAQLYSYPWLNLTTNQTVNKLPGNDNFQVPTLILQKASTINSSFSWLNISVRAGDNLNGQSLELLPIFHFAEIEKNRSKRTFQIYSDGVELHQAFSPSYLQVDSVYPRDRYLHESGTTFTLRKTNSSELPPLINAFEAYSLVRMENLTTDTIDVSSMKQVKMQYNVQRRSWNGDPCSPKEYTWEGVKCNYYDGKQNPRIILVNLSASRLSGWINPSFRNMSLEILDLSHNNLSGTIPYNQVNSLKSLNLSYNQLSGSIPDYLFERYKAGLLELRLEGNPMCSNISESYCATQADKAKKNTSTLFIAVIVPVVAIILVLILWMLCCKGKSKEHDDYDMYEEETPLHTDTRRFTYTELRTITNNFQSIVGKGGFGTVYHGILGNGEEVAVKVLRETSRTLSKDFLPEVQTLSKVHHKNLVTFLGYCQNKKCLALVYDFMSRGNLQEVLRGGLEYLHESCTPAIVHRDVKTANILLDENLVAMISDFGLSRSYTPAHTHISTIAAGTVGYLDPEYHATFQLTVKADIYSFGIVLLEIITGQPSVLVDPEPVHLPNWVRQKIARGSIHDAVDSRLMHQYDATSVQSVIDLAMNCVGNVSIDRPSMTDIVIKLKECLLAGTGEKQLVSGSYKQKGALDADIARQFQLLISGVPIVNRGTSWCLNG

SEQ ID NO: 65981 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSAPRTENAPVEGFNSATTSMLEAYLAHKA

SEQ ID NO: 65982 - protein, 129 aa, Brassica napus
MMMLRVCPSSLFYLRPLHLSTSSAKFPFCPSIRRELRLVPSRSSSSSFRRMESSPASETDSLGEDMQNQTDEGDKIKRKLEEFNWDHSFVNELPGDPRSDVISRKVFHACYSKVSPSVQVDDPQLVAWS

SEQ ID NO: 65983 - protein, 556 aa, Phytophthora infestans
MINDTPAWKALAEHAAEIKFTHLRELLNDDARNAAMRTEQQGIYLDFSRQNATSKTLDLLFELAETAELKKKLQAIASGEHVNATEDRAVMHMALRAPKTEKIVVDGHDVVPDVREVLDAIRAFTSNVRDGKLVGATGKQLKNVISIGIGGSYLGPEFVFESLRYEPVAEAAAEGRNLRFLANVDPVDVARATSGLNPEETLVVVVSKTFTTAETMLNARTLREWLVDDLTKKGSSEADAVAKHMVAASSAVPLVQQFGIDRANIFGFWDWVGGRYSVTSAVGILPLALRYGFDITEKFLAGAHAMDKHLLETPLRNNLPVIMGLLGVSNSSFLGHSSRALLPYSQALLRFAAHIQQVDMESNGKRVTVEGVDLPFQPGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSTTTSMLEAYLAHKA

SEQ ID NO: 65984 - protein, 556 aa, Phytophthora mirabilis
MINDTPAWKALAEHAAEIKSTHLRELLNDDARNAAMRTEQQGIYLDFSRQNATSKTLDLLFELAETAELKKKLQAIASGKHVNATEDRAVMHMALRAPKTEKIVVDGHDVVPDVHEVLDAIRAFTSNVRDGKFVGATGKQLKNVISIGIGGSYLGPEFVFESLRYEPVAKAAAEGRNLRFLANVDPVDVARATNGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 65985 - protein, 128 aa, Arabidopsis thaliana
MTVEGVNPKAYPLADSQLSITILDLVQQATNYKQLKKGANEATKTLNRGISEFIVMAADTEPLEILLHLPLLAEDKNVPYVFVPSKQALGRACGVTRPVIACSVTSNEASQLKSQIQHLKDAIEKLLI

SEQ ID NO: 65986 - protein, 247 aa, uncultured bacterium
MTLEGNKAIVTGGSLGIGAAIARELGRQGADVAINYRKHDVEAKQVVADMESMGRRGLAIRADVASFNDAQRMVGEVQEKFGGLDILVNNAGINRDSVIWKMTEEQWDQVIDTNLKGYFNYIRAAAGVFKEQKSGKIVNVTSINGLRGKFGQTNYSASKAGIIGLTKALARELGRSSVNVNAVAPGLIETDMMKDAPQKVLDAALAEIVLGRLGKPEEVASVVAFLCSDAARHITGQVVQVDGGQYI

SEQ ID NO: 65987 - protein, 311 aa, Bacillus coagulans
MDMLSAYSAVNQGHRHPKIIEALKNQADKVTLTSRAFHNELLGPWTKRMAKLTKKDKVLPMNTGVEAVETAIKAARRWAYQVKGVTENQAEIIAADGNFHGRTLNAISLSNDPDATKNYGPFVPGINKVSYGDINAIEKAITENTAAIILEPIQGEAGIIIPPEGYLKKVRELCSERNILFIADEVQTGFARTGKMFACEWENVEPDIYVMGKALGGGVFPISAIAANNEIMDVFTPGSHGSTFGGNPLACAVSMAAIDVIEEENLVNKSLESGKYFADKLRAINFEGIKEVRARGLFIGMEFHQPVRAIC

SEQ ID NO: 65988 - protein, 481 aa, Ralstonia solanacearum GMI1000
MASPVEPDGRRMRAHSAVSFDLIVIGAGSAGLAAARRAAQLGARTLLIDRAEVGGTGVNRGCMPKKLLGYGAAWSQSASRCLHTAAAHGRDAWQDAAARIRTEVGRLHGVYRAHLAEAGVQWLAGSASLRGRGALRLLTDAGKRTMRARQIVLATGARPQPLPVPGAELACTPEDVLTWDALPASLAIVGGGVIAVEMASTLVRFGVRVTLLVRDPRVLPDFDAALSEAAFRALAAHGVDVVPDADVVRVERDAVNGDGVAVYVAGPDGTAARVVRAQRVMAAIGRAPATDGLGLEAAGVTLDARGHIAVDRHFRTRARGVHAIGDVSGSPQLTPVAVAQGRYVAERLFGKGAKLPDMEHVPMAVFCEPAIAAVGLTEAQARERWPDRPERDARPVAERIDVVERRFVSLEQRFAGTGAESLIKLVCNARSGRVLGAHVMDNAAPEIVQALAVAVRMGVRLKHLRSTVGLHPTVAEELLCI

SEQ ID NO: 65989 - protein, 80 aa, Zea mays
MSDKGRPLPKFGEWDVNDPASAEGFTVIFNKARDEKKTGGKPGSPGKSTDGHAKSGGGGDTSKPQPKKWLCCMQSPAVDS

SEQ ID NO: 65990 - protein, 644 aa, Staphylococcus epidermidis RP62A
MILLQLNDISKSFDGEDIFTDVNFEVKTGERIGVVGRNGAGKSTLMKIIAGVENYDSGRISKIKNLTMSYLTQQMTLNSEATVFEEMSKPFEHIKKIENLIKDETDWLARNGQDYESDEYQSHIEKYETLTNRYEQLDGYQYESKIKTVLHGLNFTESDFNKPINDFSGGQKTRLSLAQMLLKEPDLLLLDEPTNHLDMETTKWLEDYLKYFKGAIVIISHDRYFLDKIVTQVYDVALGNVKHYVGNYEQFIKQRNQYYEKRMQEFEKQQEEIKRLETFVEKNITRASTSGMAKSRRKTLEKMERIDKPMIDARSANIQFGFDRNTGNDVMHIHDLKIGYDSPITLPINLEIFKGDHIAIIGPNGVGKTTLIKTIAEKKHKLGGQIIFGANLQIGYYDQKQAEFKSNKTILDYVWDQYPHMNEKDVRAVLGRFLFVQEDVKKIINDLSGGEKARLQLALLMLQRDNVLILDEPTNHLDIDSKEMLEQALKDFEGTIIFVSHDRYFINQLANKVFDLNINGGQMYLGDYQYYIEKTEEAAAIKAHETITQNNFENKEINQDANTSTYISQKQQKRQQRKLERQIEHCERQIEELEAQISHIDEQLTQPEVFNDPLKASKFANQKSDTEQKLEQIMLEWEKLQEKL

SEQ ID NO: 65991 - protein, 512 aa, Arabidopsis thaliana
MSSSPSLEILVREAEGFTVWNGPPFTNGQPTLKLERVSCSNTKFSVDGSKLMAMKSDGVISIYDATSLTEVRSFTIANVTAAELSPCGTYLQTFQKPTTPQEKNVSIWNTETGDLAHSHYQKSITKASWPSIRFCPDESSACRLATNEVQFFDPKDFSKGITSRIRVPGIAAFELSKTPASHVAVFVPESKGSPGSVQIFGCGEELQSQPSARRSFFRCSSVQFSWNHGSTGLLVVVQSDVDKTNQSYYGETKLHYLTDGTHEGLVPLRKEGPVHDVQWSFSGSEFAVVYGFMPACVTIFDKNCKPLMELGEGPYNTLRWNPKGRVLCVAGFGNLPGDMAFWDVVNKKQLGSNKAEWSVTSEWSPDGRYFLTASTAPRRQIDNGMKIFNYDGKRYYKKMFERLYQAEWKPESPERFGDISELIKSVESLKLGEGKSQGQGSAQKKTIAPNPIAQKPAAYRPPHAKHAAAVQAELPGISTTGEMSKNALKNKKKRENKKAAAAAAAASGSNNA

SEQ ID NO: 65992 - protein, 294 aa, Thermoanaerobacter tengcongensis MB4
MFKEKFKNLQQMVEEELHRILDVQEKPEIIYEAMRYSVFAGGKRLRPVLCLSACELLGGDLKKALPVACSIELIHTYSLIHDDLPAMDNDDLRRGKPTNHKVFGEAIAILAGDGLLNLGYEVLIRHALENPEDYEKILKAANEIATASGCKGIIGGQVEDILSQNTELTYEELKYIHEHKTAALIEASVCAGAHMAGASEKEVELLREYAGLIGLAFQIKDDILDVIGDEKTLGKKVGSDREKGKFTFVNIFGVEKSQEMVKELTDEAIKILDTFGERAQFLKDLSNYLIERVN

SEQ ID NO: 65993 - protein, 622 aa, Thermoanaerobacter tengcongensis MB4
MLEQINSPYDLKKLDIKDLPRLSEEIRQFIVEKVSKTGGHLASNLGIVELTLALHYVFNSPVDKIIWDVGHQCYVHKMITGRRDKFDTLRQFNGLSGYTKRTESIHDIFGAGHSSTSLSAALGIATARDLKGEKYHVIAVIGDGALTGGMALEALNNIGRSRKDVIVILNHNEMSISENVGSLSLYLSKLRTDPTYNKVKQEIDNLLNIIPPIGKSLHKYIEKIKDSIKQLVVPGMFFEELGFTYLGPIDGHNVEELIEVLERSKKMKGPLLIHVVTKKGKGYMFAEKRPDKFHSAAPFDIETGKFVGEGKDSYSDVFGKTLAEMALKDEKIVAITAAMPEGTGLIHFAKLIPDRFFDVGIAEQHATTFAAGLAVEGYKPYFAVYSTFLQRAYDQVIHDVCIQKLPVVFAVDRAGIVGEDGETHQGVFDISFLRAIPNIAIMSPKDANELVEMVKLSRNLDFPVAIRYPRGKAGEYDISRKPSFPLGKGEVLLEGEKIAVFALGRMVSKSIDAAEILKGHGINPFVVNLRFVKPLDEELILEISNKVDLVVTVEDNVIAGGVGSAILELLNDKKVYRPVLRLGFPDKFIEHGDVESLFKKYGLDSQSIADTILQRYKEMRGS

SEQ ID NO: 65994 - protein, 122 aa, Buchnera aphidicola (Schizaphis graminum)
MSITKEQILEAVSEMSVMNVVELISAMEKKFGVSANMSVNTNNNSEKSTIEEKTEFDIFLKSIGPNKVSVIKSVRSATGLGLKEAKDLVESAPTVLKENMSKNDAESLKKTLEDAGAEIEIK

SEQ ID NO: 65995 - protein, 471 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHEATSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKVR

SEQ ID NO: 65996 - protein, 115 aa, Glycine max
MGLEKNYFSLILFFHANRRFFQSHHPLCLAGDSHQERQFTGRLYDMVNATKGVFISCDIPMAQYIINMNASLPASDKFIIHILDNTHMFVQPHVEQMIRSQIAKFREDNTYVKPN

SEQ ID NO: 65997 - protein, 249 aa, Oceanobacter sp. RED65
MSEEKTTHFGYETVAREEKQGKVAEVFHSVAAKYDLMNDLMSFGIHRLWKRFTMEFTGVRKGDSVLDIAGGTGDLTMKFSDLVGPEGRVVLADINESMLRVGRDRLLDKGYSGNIECVQANAESLPFDDNSFDVITMAFGLRNVTDKDQALREFNRVLKPGGRLLVLEFSKTNNPLLSKAYDFYSFSALPLMGKIITNDADSYRYLAESIRMHPDQDTLKAMFEQAGFANCEYHNLTGGIVALHKGIKP

SEQ ID NO: 65998 - protein, 560 aa, Arabidopsis thaliana
MASSTALICDTEAWKDLKGHVEDIKKTHLRDLMSDANRCQSMMMEFDGLLLDYSRQRATVETMDKLLNLAKASQLTEKISRMFNGEHINSTENRSVLHVALRAPKDAVIKADGMNVVPEVWNVLDKIKEFSDKIRSGSWVGATGKPLKDVIAIGIGGSFLGPLFVHTALQTDPEALESAKGRQLRFLANIDPVDVARNISGLNPETTLVVVVSKTSTTAETMLNARTLREWITAALGASAVAKHMVAVSTNLALVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSIDGLPLPFETGEIDFGEPGTNGQHSFYQLIHQGRVIPCDFIGIVKSQQPVYLKGEVVSNHDELMSNFFAQPDALAYGKTPEQLQKENVSENLIPHKTFSGNRPSLSLLLPELTAYNVGQLLAIYEHRVAVQGFVWGINSFDQWGVELGKVLATQVRKQLHSSRTQGTAPEGFNYSTTTLLKRYLETSSEPQM

SEQ ID NO: 65999 - protein, 249 aa, Azoarcus sp. BH72
MSFSLEGQIALVTGASRGIGRAVAMELARLGAVVVGTATSEAGAADIDNALAEAGFKGAGLALDVTDVAACEGLIAEVEKRFGAVCILVNNAGITRDNLAMRMKDDEWDAVIDTNLKAVFRMSRLVMRGMMKARTGRIINITSVVGSAGNAGQANYAAAKAGVAGMSRALARELGSRNITVNCVAPGFIDTDMTRALPDSARDALLGSIALGRLGRPEEIAAAVAFLASPAAAYVTGTTLHVNGGMYMS

SEQ ID NO: 66000 - protein, 897 aa, Ustilago maydis 521
MASQLHQEAKPSLRQRGTNALKWTIGYNDTEMKRLGVPVVSSRDWLANIFNHPGSKAADYFDSLFPFRKWIASYNTQWLIGDVIAGITVALVVVPQSMSYAKLAGLKPEFGLYSSFVGVMVYAIFATSKDVTIGPVAVMSLQTFNVIQHVMNKTNAWSAEVIATALAFLCGVICLGIGLLRIGFIIEFIPTPAVAGFMTGSAFQIAAGQVPKLLGLSKVNTNGNPAYQIVIDTLKALPHTNINAAFGLPALFFLYFVKWLCGWLPTRYPRTARTMFFVSVLRNAFVIIVFTVASRIWLGHYKNPKQYPISVLLTVPRGFKHIGQPVLNTTLLSDLAPQLPVSVVVLLLEHIAIAKSFGRLNNYKINPNQELIAIGVTNLVGPCFGAYAATGSFSRTAIKSKSGVRTPLAGWFTGILVLIAIYALSGTFYWIPNAVLSAVIIHAVTDLLVPFSVSYKFWLISPFELIIFLGAVFATVFSNTENGVYVSVAASLALLLIRIARPRGRWLGLVRVHHGTTSPHSSAVTLSHRDVFVPLDDKDGLRDPSIHVEPPPPGVLIYRFEEAFTYPNASHLADLLIDRVKEQTRPGKPTSNSRLGDRPWNDPGAPNPALVKAFRAATCRGRKNDLNDADVAAHVVDRRPILRAMIFDFSSVSNVDTTSVQTLVDVRTAVERYADAKVEFHFANILSPWIRRGLLAGGFGLGFPSKRITEIAPVVSQPQNITLSADELRAREQAEAERRAKAIERMSHKSANEGSAYPFQGRPNKQLTELEAGLAGDGAVASRSRVDLHDDDDETDQIRKVTIGEALYDVHTLDQRNGEASSSNDNTPSRDSVEKNLEEGNYPAGRRPSEPASIGIPFIWGNDLTPFFHLDLSAALAAATEGLGEDSQLSSSIDNKL

SEQ ID NO: 66001 - protein, 79 aa, Azoarcus sp. BH72
MENIEQRVKKIVAEQLGVNESEIKNESSFVDDLGADSLDTVELVMALEEEFECEIPDEEAEKITTVQQAIDYVNAHLKK

SEQ ID NO: 66002 - protein, 133 aa, Oryza sativa
LELLKTAIEKAGYTGMVVIGMDVAASEFYSDKDQTYDLNSKEENHDGSQKISGDSLKNVYKCFGSEYPIVAIEDPFDQDDWVHYAKMTEEIGEHVQIVGDDLLVTNPTRVAMAITEKSCSALLLKDNQIGSVT

SEQ ID NO: 66003 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKFVGATGKQLKNVISIGIGGSHLGSEFVFESLRYEPVAKAAAEGRILRLLANVDPVDVARATSGLNPEETLVVVVSKTFTTAETMLNARTLRKWLVDDLTKKGSSEAGAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66004 - protein, 181 aa, Bacillus clausii KSM-K16
MTEKRMVGKQAPRFEMDAVLPNKEFGKVSLEENMKNDKWTVLFFYPMDFTFVCPTEITALSDRYDEFEDLDAEVIGVSTDTIHTHKAWINTSRDDNGLGDLAYPLAADTNHAISREYGVLIEDEGVALRGLFIISPEGELMYSVVNHNNIGRDVDETLRVLQALQTGGLCPANWKPGQATL

SEQ ID NO: 66005 - protein, 330 aa, Kluyveromyces lactis NRRL Y-1140
MWEEFDITKLPYYDPKVDNKVALVTGGNSGIGYYTVLHLYLHGFKVYLGGRNSSRVNHAIKEIKKEAEIRLRKGQDEKPHDGLMIRKTGKLEYLHIDLTDLNSVEKAATKFTVQEDHLDVLINNAGVMAIPYELTKDNFEIQMQTNYVSHFLLTMRLLPLIKARKGRVITVSSLGHNLIFFNCNPGAQFNYWPSMFFMWCRYALAKTASIQFTKMLAIKNPDILCMSLHPGLVMNTNLFSYCTRLPFVGIFFWILFQFVGYFFGVSNEQGAISTLKCALSSDLSAETDNGAYFTTGGYPSKPSRVANSLDNAASTWIWTVHELRDRGHEI

SEQ ID NO: 66006 - protein, 556 aa, Phytophthora infestans
MINDTPAWKAQAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKFVGATGKQLKNVISIGIGGSYLGSEFVFESLRYEPVAKAAAEGRILRLLANVDPVDVARATSGLNPEETLVVVVSKTFTTAETMLNARTLRKWLVDDLTKKGSSEADAVAKHMVAASSAVPLVQQFGIDRANIFGFRDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66007 - protein, 340 aa, uncultured bacterium
MKAVVFHGKDAGLKIEDIPVPQIKGDQILVKVAACGVCHTDLHYIEHGVPTFKKPPIVLGHEASGIVEKAGANVTNVKPGQRVLIPAVLTCGHCPACRQGRENICSNMTMLGNHFDGAYAEYVAVPAKDVLGLPEAIPLQEASIIADAISTPYHAVKNRAQVKPGDTVVVFGCGGVGINAVQMASAAGGYVIAVDINPRKLEWAREFGAAKTVDASKVDRVSKEIKKLTGGGADIAMEVIGNPRTIEQAFECVRVGGRLCVVGYTHEAISIVAGKIMFKELEIVGSLGCRPVDYVPLIRMVEQGKIDLKRQVTHRFGLDELGQAFEVMKEGLSLRSIVIP

SEQ ID NO: 66008 - protein, 360 aa, Triticum aestivum
MGSTATDIAASAHEEACMFALQLGSSSILPMTLKNSIELGLLDTLVAADGKLLSPAELAAKLPSTANPAAPDMVDRMLRLLASYKVVSCTLEEDKDGRLSRRYGAEPVCKFLTPNEEGVSMAPLALMNQDKVLMESWYYLKDAVLDGGSPFNKAHGMSAFEYHGTDPRFNCVFNEGMKNHSIIITKKLLELYKGFNGLDTLVDVGGGIGATVGAITAHYPTVKGINFDLPHVISEAPPFSGVTHVGGDMFQKIPSGDTILMKWILHDWSDEHCATLLKNCYDALPAHGKVVLVECILPVNPEATPEAQGGFHLDMIMLAHNPGGKERYEREFEALAKGAGFGAIKTTYIYANIWVIEFTK

SEQ ID NO: 66009 - protein, 435 aa, Ruminococcus albus 8
MKYTEREVLQFVEENDVKFIKLMFCDIFGALKSVSVPASELSGIFAKGLLFDASKLSGFMNFSSTDLILFPDPDTLALLPWRPQQGRVVRFFCTIKYTDGTVFEGDGRTFLRNAVEYARGKGYNFQIGTSCEFYVFEKNDNGHITKIPHDYAGYCDIAPADKGENLRRDICLTLEQMDIYPESSRHESGPGQNEIDFQYSNALNAADNLVTFKNVVKSVADRNGLYATFMPKPLCDRPGSGLHIMLFCMKGTENIFKPRLDELGHEAKSMIAGILERVREITLFLNSTASSYSRLGNSRAPKYITWSHENFAQLIRVPMINTDENAMILRSPDNTCNPYFALGLIIYAALEGALSGAELCSATNLSPDNIAELTERLPATLDEAIEAARSSSFLADRLPENLIEHVLNEKSREAKEYAECEDKEMFETVRYFYTL

SEQ ID NO: 66010 - protein, 556 aa, Phytophthora infestans
MINDTPAWKALAEHAAEIKSTHLRELLNDDARNAAMRTEQQGIYLDFSRQNATSKTLDLLLELAETAELKKKLQAIASGEHVNATEDRAVMHMALRAPKTEKIVVDGHDVVPDVHEVLDAIRAFTSNVRDGKFVGATGKQLKNVISIGIGGSYLGSEFVFESLRYEPVAKAAAEGRILRLLANVDPVDVARATSGLNPEETLVVVVSKTFTTAETMLNARTLRKWLVDDLTKKGSSEADAVAKHVVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLVHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66011 - protein, 403 aa, Bacillus clausii KSM-K16
MDWIARDNAAIMGTYGRLPLVIDRGEGNYLIDENGKSYLDLITGLAVNVVGHSHPEVIKALQEQGQKFLHISNLYVNKPAVELAEQLSEATLGGKVFFANSGAEATEAAVKLIHKWSMAQKTAKRGIVVLKNSFHGRTLGALKLTRQKGVYQDFPKHDLPVYEVERENVDELRAVIKKNKPAALLMEPVLGSGGVIPLSHSFLQEAQALCNQEGMLFCMDEIQTGMGRTGKLFAYMHADLSPDVVLFAKGVGGGLPLGGIIVKQDWSGLFSPGDHGTTFAPSPLSCALGLAVLRVLQQQGVLTASQQTAAYLHDTLTKLQREFPNILEAFRGKGMMIGLPTKLTAENTKKLQQMMMEQGVLIDVTQQTIVRLLPPLTLTKAEVDTFAGHFRNALAEIDGVVAS

SEQ ID NO: 66012 - protein, 240 aa, Bacillus clausii KSM-K16
MKMMDANEIIEFISKSEKKTPVKVYIKGQLDNLSFGEGVQSFINGNTGVVFGEWSEIEAVLNENAALIEDTVVENDRRYSAIPLLDLKGVEARIEPGAIIRDQVEIGKGAVIMMGASINIGAVIGEGTMIDMNAVLGGRATVGKNCHVGAGAVLAGVIEPPSASPVIIEDGVVIGANAVILEGVRVGAGAVVAAGAIVTEDVPANTVVAGTPARVIKEIDEKTKGKTEIKLELRRLNEDQ

SEQ ID NO: 66013 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETPVVVVSKTFTTAETMLNARTLRKWLVDGLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66014 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNTTEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDGLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFTAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66015 - protein, 215 aa, Chlamydophila pneumoniae CWL029
MSKKPLYVAHPWHSPTLTQDNYESLCCYIEITPYDSVKFELDKATGLLKVDRPQKFSNFCPCLYGLLPQTYCGTASGNYSGEQTRREGIQGDKDPLDVCVLTEKNIHHGNILLQARPIGGLRIIDSGEADDKIIAVLEDDLVFAEIEDISDCPGTVLDMIQHYFLTYKATPNHLIKGSPAKIEIVGIYGKKEAQKVIQLAHEDYLSYIGDTAEVN

SEQ ID NO: 66016 - protein, 210 aa, Oryza sativa Indica Group
MALAAIYSLFIINKSGGLIYYKDYGSAGRTDTNDSLRLASLWHSMHAISQQLSPTPGCEGIDLLQAHNFDLHCFQSLTGTKFFAVCETGAQNIETLLKVIYELYTDFVLKNPFYEMEMPIRCELFDLNLAQSHQPIQEVCFLIPAIQRGPNTIDLDSKECKRHSRGGTVLGTSRGGHDTMKIVDSIQDRGINQVYVIGGDGTQKGRRSDF

SEQ ID NO: 66017 - protein, 883 aa, Propionibacterium acnes KPA171202
MTDRYVYDLSEGSAEMKPLLGGKGAGVAEMKRLGVPVPDGFTVTTEACVDTMTRKGEWPEDLESQVWDGLKRLEERTGRVLGDDKKPLLVSVRSGAVISMPGMMDTILNLGISDDTVEAIAKEAGNERFAWDCYRRFIQMYGEVVEGIDAHIYEDALTALKEKKGVESDTDLSADDLKGLVDTFKKLSNEQLGGNWTTDPREQLMRAVDAVFRSWLNPRAFVYRKANKIPDDLGTAVNVMQMVFGNRGDTSATGVCFTRNPATGEKELYGEFLVNAQGEDVVAGIRTPRSLAEMEEVLPEAYHDLIDTMKKMESHYRDMQDMEFTVENGKLYLLQTRNGKRTAAAALKVARDLVDEGVITKEEALMRIEPAQLDQLLHEAIDPDHSEQPVAEGLPASPGAAVGEAVFDADVAAERGAKGEKVVLIRFETTPDDIHGVIVSQGVLTAHGGMTSHAAVVARGMGKPCVAGARGIKIDAKAATLTIGDTVIHEGDMITLDGSTGEVFASGLKLIPPQINADFQEVLSWADEIRRLGVEANADNATDAAKARELGAEGIGLCRTEHMFFGADRLPAMHEMITADTPEERQAAVDKILPMQQDDFEGIFTAMKGLPVTVRLLDPPLHEFLPNLVEQSLKVQKMENQGADAGELDKERRLLAQVKKLHEQNPMLGTRGCRLGMLYPEIPDMQARAIIRAVLSVLKKEGETVQIHIMIPLVFTPIELETHRRIVQQAIDEEFESAGTKVDVKIGTMIELPRAALVADKIAEVADFFSFGTNDLTQTTLGISRDDAENGFLTEYLRTKVLKDNPFASIDQEGVGQLVAGAVEKGRKTNPELSVGVCGEHGGDPDSIHFFNKTGLDYVSCSPFRVPIARFAAAQAVISQQEK

SEQ ID NO: 66018 - protein, 216 aa, Wolinella succinogenes DSM 1740
MDLVDRFSRTRVLFGEGFEKIQRSKVVIFGVGGVGSFVLDSLYRTGVGEITIIDCDEFDVTNQNRQIGSEALGEKKVEALARRYEGVTPIVANVDEAFLEGFSLEEFDVVVDAIDDIPAKVALAKRAHTKLLSSTGSAKKLNPLHIKVDSIWKSYGDKFARKFREALKKEGFEDDFLVVFSPEPPQCKGLGSFSAVTGSFGLQLASEAIRKILVKE

SEQ ID NO: 66019 - protein, 301 aa, Desulfitobacterium hafniense Y51
MKKYRIYQVDSFTRQRFHGNPAGVVPNADGLTEEQMQRIARELNNSETAFIFSSTSPDYDVEVRFFTPTTEVPLCGHATIAAHYVRAVEGDAVSGRVMQKTKAGILPVDIIQENSNYSIVMTQGTPEVGKPFRSEVVEWIADALGISVCDLHEHCPVAIASAGHAKVMVGLKSNSQLHSLQPNLAKLSAISEEIGCNGYYVFTLNPQDEVLVHGRMFAPAIGVAEDPVTGNANGPLGIYLVHYGICRNLESSDAFEFTIMQGEAIQRDGTMRVHVKKENNKPVLVQITGEAVVAFSTEIEI

SEQ ID NO: 66020 - protein, 497 aa, Ralstonia solanacearum GMI1000
MTRTDLPPAPITLNDPALWRTQAFLAGAWTDADDGSTRDVTDPATGRVIGTVPAMGAAETRRAIEAAQAAQRAWRKVTARERARILRKLADLMLEHQQDLARILTAEQGKPLPEATGEIAYAASFIEWFAEEARRVYGDTIPAPQGDRRIVVNKEPIGVTAAITPWNFPIAMMTRKVGPALAAGCAMVVKPALETPYSALAFAELAARAGVPAGLLSIVTGDAQGIGGELTANPVVRKLSFTGSTAVGRLLMRQCADDVKKLSLELGGNAPFIVFDDADLDAAVEGAMVAKYRNAGQTCVCANRFYVQRGIYDAFAARLSEAVRALRVGNGAEPGVQQGPLIHQRAMDKVRAHVDNAVAQGARVLVGGKPHALSAQGGAFFEPTVIVDARPGMLVAHEETFGPLAALIPFDTEDEAVAAANDTEFGLAAYFYTRDLGRAWRVSEALESGMVGVNTGLISTAEAPFGGVKQSGLGREGSKYGIDEYLEIKYVCMAGLG

SEQ ID NO: 66021 - protein, 175 aa, Triticum aestivum
MAPAVMASSATSVAPFQGLKSTAGLPVSRRSNGASLGSVSNGGRIRRMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 66022 - protein, 426 aa, Aspergillus nidulans FGSC A4
MARTRKSSNLGSDIRGDTSAPAMSTMNEVAPLAEKSSKSHSKRRRSRSFLRRFKDTCLKHTWVLPLLILIVLLAGYAVNPTPSNPLHYAIFLSYPEPPKTPGGPVMYGKGPKDIAFVSFYMVVLSFTREFLMQRMIRPFAVYCGIRGKGKTARFMEQVYTAIYFAIFGPYGLYVMSRTNIWYFNTTAMFEGFPHREHEGLFKAYYLLQASYWAQQAIVLLLQLEKPRKDFRELVGHHIITLALIALSYRFHFTYLGLAVYITHDVSDFFLATSKTLNYLDAYITAPYFGVFVCVWIYLRHFLNLKFLWAVLTEFRTVGPFELNWETQQYKCWISQYITFALLASLQAVNAFWLFLILRILKNYLFSNIKKDERSDEEDEEEEEIEQSTNSTAALATGTEPASLTARSVNVEKRTPHVLVNGQPVKR

SEQ ID NO: 66023 - protein, 338 aa, Neurospora crassa
MVVKVGINGFGRIGRIVFRNAIEHDDIHIVAVNDPFIEPKYAAYMLRYDTTHGNFKGTIEVDGADLVVNGKKVKFYTDADPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGAAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVDAKKA

SEQ ID NO: 66024 - protein, 303 aa, Arabidopsis thaliana
MEAFEKLEKVGEGTYGKVYRAREKATGMIVALKKTRLHEDEEGVPPTTLREISILRMLARDPHIVRLMDVKQGINKEGKTVLYLVFEYVDTDLKKFIRSFRQAGQNIPQNTVKCLMYQLCKGMAFCHGHGVLHRDLKPHNLLMDRKTMTLKIADLGLARAFTLPMKKYTHEILTLWYRAPEVLLGATHYSTGVDMWSVGCIFAELVTKQAIFAGDSELQQLLRIFRLLGTPNEEVWPGVSKLKDWHEYPQWKPLSLSTAVPNLDEAGLDLLSKMLEYEPAKRISAKKAMEHPYFDDLPDKSSL

SEQ ID NO: 66025 - protein, 426 aa, Ralstonia solanacearum GMI1000
MNARDPQHNAQWNARRLAATPRGVGVMTDRYAEHAENAQFWDVEGKRYIDFAAGIAVVNTGHRHPRLVQAVREQLERFTHTAFQIVPYASYVELAERLNTLTPGAHAKKTAFFSTGAEAVENAIKIARAHTGRPGVIALTGAFHGRTFMGMSLTGKVVPYKTGFGPFPGSIYHVPAPIALHGVSTQDSLDAIGRLFKADIDPRQVAAIIFEPVQGEGGFYQMPADFVRALRALCDEHGIVMIADEVQTGFARTGKLFAMEHTGVLPDLVTMAKGLAGGLPLSAVTGRAEIMDAPAPGGLGGTYAGNPLAVAAAHAVLDIIDEEKLCERSAALGRRLVDALDAAKAGQPRIAEVRGVGAMVAIEFNTPDGKPDADFTRTVQQRALEAGLLLLSCGVYGNVIRFLFPLTIEDAVFEEGLAILKHALEG

SEQ ID NO: 66026 - protein, 260 aa, Yarrowia lipolytica CLIB122
VDLVTETDKAVEDMIREKLSTAFPDFKFMGEESFSGGDNAALSDAPTFIVDPIDGTTNFIHGFPYACTSLGLSIDKEPVVGVIYNPFLDHLYTGVKDKGSYLITNAATDSPIKAALPLKKPAQKLTLQSSIIGIEWGSDRVGNNFDTKCATFRNLSGGHDGAGFCHGFRSLGSAAMNFSAVAAGYLDAYWEGGCWAWDVCAGWVILKEAGGFVAGGNKGVWNPPVDSRKYLAVRSAPEAEQKAFVEEFWGQIDGSLEYDP

SEQ ID NO: 66027 - protein, 175 aa, Triticum aestivum
MAPAVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 66028 - protein, 248 aa, Brassica rapa subsp. pekinensis
MSSKLIQPPPMAASREAISRRTGNAKMLLPFINLNGKTLSFSDNPFRLRPMCIGKVTEQSSASSPNEQQVEEEEEEDITVSQIKEELYEALQGINRGVFGVKSDKKAEIEGLVKLLECRNPTPEPTGELDKIGGCWKLIYSTITVLGSKRTKLGLRDFVSLGDLLQEIDIAQGKTVHVLKFDVRGLNLHDGEFRIVANFKIISKTSVEITYESSTIMPDQLMNIFKKNMNLLLGIFNPEGLFEISYPF

SEQ ID NO: 66029 - protein, 173 aa, Triticum aestivum
MAPAVMASSATTVAPFQGLKSTAGLPVSRRSSEPRPRHNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVNGFDNLRQVQCVSFIAFRPPGCEESGKA

SEQ ID NO: 66030 - protein, 1167 aa, Brassica rapa subsp. pekinensis
MRTIIKTSEGALIVTFLKGLLLERSLVYSSARPGRILYACGSLLNWEQQRLGGSDTYNGQEAGQIKDTETEEACLMWAPPMHISSELGSYLSLSLSLDRVPRESLIVFGKMNTGGRLIAGSHNRNEFVLINADESARIRSVEELSGQSCQICGDEIELSDDGESFVACNECAFPVCRTCYEYERREGNQSCPQCKTRYKRIKEVISGSPRVEGDEEDDGIDDLDFEFDYKSGLGGSEQASDTFSRRNSEFDLASAAHGSQIPLLTYGDEDVEISSDRHALIVSPSPSQVNRYQAHFADQTPHLRPMVPQKDLAVYGYGSVAWKDRMEEWKRKQTEKFQVVKHDGDSTLGDGDDAEIPMMDEGRQPLSRKVPIKSSMINPYRMLIILRLLILGLFFHYRILHPVKDAYALWLVSVICEIWFAVSWVLDQFPKWYPIERETYLDRLSLRYEKEGKPSELAGVDVFVSTVDPLKEPPLITANTVLSILAVDYPVDRVACYVSDDGAAMLTFEALSETAEFARKWVPFCKKYSIEPRAPEWYFWHKMDYLKNKVHPAFVRERRAMKRDYEEFKVKINALVATAQKVPEEGWTMQDGTPWPGNNVRDHPGMIQVFLGNNGVLDVENHELPRLVYVSREKRPGFDHHKKAGAMNSLIRVSGVLSNAPYLLNVDCDHYINNSKALREAMCFMMDPQSGKKICYVQFPQRFDGIDKNDRYSNRNVVFFDINMKGLDGLQGPIYVGTGCVFRRQALYGYDAPKKKKTPRMTCNCWPKWCFFCCGGRKNRKAKTADKKKKKEASKQIHALENIEEGATNNNNNNVKSPEAAQLKLEKKFGQSPVFIASAGMENGGLASEASPASLLREAIQVISCGYEDKSEWGKEIGWIYGSVTEDILTGFKMHSHGWRSVYCTPKIPAFKGSAPINLSDRLHQVLRWALGSVEIFMSRHCPIWYGYGGGLKGLERLSYINSVVYPWTSIPLLIYCSLPAICLLTGKFIVPEISNYASILFMALFASIAVTGILEMQWGKVGIDDWWRNEQFWVIGGVSSHLFALFQGLLKVLAGVNTNFTVTSKAADDGEFSELYIFKWTSLLVPPTTLLIINVVGVVVGISDAISNGYDSWGPLFGRLFFALWVILHLYPFVKGLLGKQNRMPTIILVWSILLASILTLLLGES

SEQ ID NO: 66031 - protein, 312 aa, Oryza sativa Indica Group
MVPHGRVHPAAAASSSDFSGEMNQSAASSDPSSSPPYSFHFEKPLPPTAAAPPPADARRYQQLLPAPQPGTYVVQMPKDKVFRVPPPENARLFQHYTRRARRRARCSCARVCSWLLLALVLLAAALAASAAVVYLVFKPRQPDYTLLSLAVSGLGGILGNASSTAAPAPVAFSPEFDATVRADNPNGKIGVHYEGGGSHVAVSYGGVRLADGAWPAFYQGPRNVTVLVATAKGLGIRFSERLLGDIAAAGRLRSVPFDVDVKVPVRLQVGGVRTWAVPVRVRCAVVVDRLAADAKVVSKSCRVKARFLFWKD

SEQ ID NO: 66032 - protein, 1051 aa, Oryza sativa Japonica Group
MLWARPKLATQQASGGAAAFALNSGGRRNSGGEDGAGGATEVDAARGWIQRKRNARRSRRSFISILPSPRPEISAPLLVASIGVPLPRIRPTFYLRVKFKKIYMAFGANDIVLHIKRLMLCPSLFNFLLSSSPVFLLTALLLGALLSYGEPAVLVLGENQQTLSFKSKISITDCSIDKVETVAVEEHLDKTTTSNEVYVRERNFEGNIHDTHWEEKNGTYMTVDTALNEEIHTKDGTSDYDLQDTHREGKGITSVETDTVPCVAPSSFAYSGVTVETEDVGENSKKNDELQELGSINPESDNNKVQYQYQLGEFMSSCWEPVMRQEPQDACSDSESDLTESSPDASMTDIIPMLEELHPLIDLQTGHPSLVSRDNLNTSSDDDEDDLEEEDASTDENQLEGKIDDFANWKDVIDLNYLDMDNNSKLEGMMDLQRAKNILKFELDKRLMDLQAADAVQKMEEASRFRVQVPSISTGRQNPFDSSNGSDEIIELPHVPDSAPSCLLPRKNLFDLAVNQNMAHDSPLQETWTPLSYFSARRHRKHGNLYVRHSTSLHHNSFKLEKDEISENDAHKSHNSQSDGDAKQERNNSTLFGSLEAHIGEEIKILGMAISEVGVLEVNSGMVSSNQNADFSDDISSSPFQKPRQSTFEAKDTVHAGIEQLTSCSPYKVNNFEAHIVEADSIDEFNSLFKCRMEEVLVQSISKSSISQPLTVKLEDELSEPLSPDSGTGTHFIDGSSVEDSDPRFAQLNDEALVSSTSNATCRNESIEEKSSEALLAGNEDYSELPNELLKSGDPQTADSSEIQVQEQQCDTVEHQLQFLGLTVKKQSLHKSPTTTTTRTRGKSVMSHRDATLFSSDVASLAAPNFLLDGVINFVMAHMTTELGDESLLLVSPSVASLLANLQDYEPETVADTAQALLLASRRMVLFPVNNSERLDKADDGSHWSLLVLDNITGRFVHHDSMDGANLPAATRLADALRPLLPAPPQGPPISGPTPQQSNGYDCGVYLLAVALAICRWWKKHPRTEEAAPCWFESVMDQVTCERFTRLCIKE

SEQ ID NO: 66033 - protein, 307 aa, Synechococcus elongatus PCC 6301
MQSSFLSAVLLPLALVIIMFGMGLTLTVQDFRRVWIAPKAVAIGLIAQLVMLPLPGSAIASLTPLSPELAVGVIILAACPGGPTSNLFTFLAAGDVALSITLTAISSLITVFSIPWVVNLGLQAFLDQTSTFQLPFGPTVVQIAVVAIIPVVLGMLVRHYAPQLAQRTDRSLRWISTAFLAAVIVGFFAQERQNILAFFQSVGGVVLLLNLLAMALGVGLASLTRLGYARATTIGLEVGIQNGTLAIAIAASPTLLNNPAMAIPAAIYSLVMFMTGGIFVWLRQRYQPTRAVQTAAEVPAAVGSHLE

SEQ ID NO: 66034 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDPKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66035 - protein, 224 aa, Pseudomonas syringae pv. syringae B728a
MQPFVIAPSILSADFARLGEEVDNVLSSGADFVHFDVMDNHYVPNLTIGPMVCSALRKYGVTAPIDVHLMVSPVDRIIGDFIEAGATYITFHPEATQHIDRSLQLIREGGCKAGLVFNPATPLNLLEYVMDKVDMILLMSVNPGFGGQKFIPGTLNKLREARALIDASGRDIRLEIDGGVNVNNIREIAAAGADTFVAGSAIFNAPDYREVIEKMRTELASSRA

SEQ ID NO: 66036 - protein, 581 aa, Zea mays
MASPPSIHGRSAPLRPKSRGWKGSRGSLSLDAPVAASKLRRERRPAPASVNPGPQCLRRRRGLAVRCQTGSTAPPVLRTEEAPAAAAGARNAQAGFTVVMKFGGSSLASAERMREVAGLILSFPDETPVVVLSAMGKTTNNLLLAGEKAVSCGAPKASEIPELAVIKDLHLRTVDELGLDRSIVSGLLDELEQLLKGVAMMKELTLRTRDYLVSFGECMSTRIFAAYLNKLGKKARQYDAFDIGFITTDDFTNADILEATYPAVAKRLHEDWMDDPAIPIVTGFLGKGCKSCAVTTLGRGGSDLTATTIGKALGLREIQVWKDVDGVLTCDPNIYANAIPVPYLTFDEAAELAYFGAQVLHPQSMRPARDGDIPVRVKNSYNRHAPGTVITKSRDMSKSILTSIVLKSNVTMLDIVSTRMLGQYGFLAKVFSIFEDLGISVDCVATSEVSISLTLDPSKLWSRELIQQELDHVVEELKKFAVVHLLQRRSIISLIGNVQRSSLILEKAFNVLRRNGVNVQMISQGASKVNISLVVNDSEAKQCVQALHSAFFENGFLSEVEGADVPQNGASLNSNGAVYGN

SEQ ID NO: 66037 - protein, 611 aa, Gibberella zeae PH-1
MAPSSSKEKRLAKKAAEGKLKGKKGAKKNEEPELDANGNPIQDDAPATSGDKLDEVKRLADQMDKHGISDRVTTGVLASTQTSKDVKITSTSLVFHGRVLITDSTLELSYGRRYGLLGENGCGKSTFLKAIAAREYPIPEHLDIYLLNEGAPPSDLGALEWVVREAELELERLDHQAEKLLEEEGPESPHMDKLDPSTFATRASLILTGLGFNKKTIHKKTKDMSGGWRMRVALAKALFVKPSVLLLDDPTAHLDLEACVWLEEYLKKWERTLVLVSHSMDFLNGVCSSMIDMRGKQLIYYGGNYDSYSKTRSENETNQMKAYQKQQDEIVHIKKFIASAGTYANLVRQAKSRQKILDKMEADGFIQPVEQDRVFSFRFADVDKLPPPVLSFDNVTFSYSGNPEDDLYRNLDLGFDMDSRTALVGPNGVGKSTLLRLMTGKLSPTGGVVTRHTHLKLGLYSQHSAEQLDLTKSALDFVRDKYSSKSQDYQYWRQQLGKYGLSGDSQTALMGTLSEGQKSRIVFALLAIESPNMLLLDEPTNGLDIPTIDSLADAINAFSGGVIVVSHDFRLLDKIAKQILVCENQTIRTWDGPISEYKNYLRKKMINAGAV

SEQ ID NO: 66038 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVIPIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSHALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKELDAFSTGQLLALYEHRTVVQGAIWGINSFDQWGVELGKVLAKQVRAQLSASRTENAPVKGFNSATTSMLEAYLAHKA

SEQ ID NO: 66039 - protein, 620 aa, Coccidioides immitis RS
MICSRAEGRSRRLKASEWEWEKREPPNTKPLKPSLGICHWPGDSQGLEHLPITETSFGSGYWTQTDNAGQSAVMTKESQIPVGEYLFRRLHQLGLRHILGVPGDFNLNLLDHIYNVPDMRWVGTCNELNAAYAADGYARTRGIPGAVITTYGVGELSAINGIAGAYSEYVPVIHIVGNTSRDMQRNHVKIHHTLWMDGWDHTTYQKMSEPVRKDSAFLMDPATAPEQIDRVIETCVKTRLPVYLFVPIDVPDLMTDSSRLSIPLDLEVRNDGREAHEDEVVSEIVRAIDQASSPGVLIDVLVQRHGLVGDAKELIEQINAPFYITPMGKSIVNESDPRFAGLYGGDKVIKLHPSYCSVGSKVWDGLDFRPVVKKLVQRLNKQPLTRKASSVPKSQPYKETAHVDDSCVDGLDHKRFWDRLSRYIQPNDFVIAEVGTSQFGSLDLKLPDNCQYFSQLYYSCIGFTVPALLGVLLARKETGAEGRVILLVGDGSLQMTVQEFGTIIREGLKPTIFVVNNAGYSIERLIHGPMQQYNDISTQWDYQKMLSFFGAPNAPTYVAKTYAELGKVLNDEAFKKGDRIQLLEVFFDMLDSPWNLTALLDLKEKRLRAAAAAAAAANGN

SEQ ID NO: 66040 - protein, 523 aa, Arabidopsis thaliana
MAAMNIVDFQNCFFFVLLSLFSLLCYSLFFRKPKEPRLHYDLPPSPPTLPIIGHLHLLLSVLVHRSLQTLSTKYGSILYLRVFSFPVALVSSASIAYEIFREHDVNISSRGFPPTDDSLFAGSFSFTSAPYGDYWKFMKKLLVTNLLGPQALERSRGFRADELDLFYENLLDKAMKKESVDICVEALKLSNNSICKMIMGRSCSEENGEAERVRALATQLDGLTKKILLANMLRAGFKKLVVSLFRKEMMDVSSRFDELLERILVEHEDKLDMHHQGTDLVDALLAACRDKNAEYKISRNHIKSFFADLLFASTDTFVQTTQWTVAEIINNPNVLERLRGEIDSVAGKARLIQETDLPNLPYLQAVVKEGLRLHPPGPLFARFSQEGCRIGGFYVPEKTTLMINAYAVMRDSDSWEDPDEFKPERFLASSRSEQEKERREQAIKYIAFGSGRRSCPGENLAYIFLGTAIGVMVQGFEWRIKEEKVNMEEANVGLSLTMAYPLKVTPVPRTLVPLTQNPLNRSS

SEQ ID NO: 66041 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKFVGATGKQLKNVISIGIGGSYLGSEFVFESLRYEPVAKAAAEGRILRLLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGERVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66042 - protein, 224 aa, Solanum peruvianum
FLMQKELDYLVGAVSNPQKPFAAIVGGSKVSSKIGVIESLLEKVDVLLLGGGMIFTFYKAQGYAVGSSLVEEDKLDLATSLMEKAKTKGVSLLLPTDVVIADKFAADANSKIVPASEIPDGWMGLDIGPDAIKSFGSALDTTKTIIWNGPMGVFEFDKFAAGTEAIAKKLAELSGKGVTTIIGGGDSVAAVEKVGLAEKMSHISTGGGASLELLEGKQLPGVLA

SEQ ID NO: 66043 - protein, 846 aa, uncultured bacterium
MTIDDCGLRSRVVMVGITLNGNACEAEEGATIISAAAANEVYIPSLCSHPDLPPFKDLPLAAQVFHGETCYANEPLSEDESANASNPQSSIVNRQSEGCGLCVVEVAGLPEPVRACQTPVTAGMSIQTESEALKELRRTNLMQILARHPHACLTCAQREGCSLEDCSTNVPKEERCCPKFHNCELRKVAEYVGVKEQTPRYRPAGLPVLNEEPLFARDFNLCIDCARCVRVCNQVRGVEALGIVHNAGRLIVGSVAPTLTDSGCRFCGACVEVCPTGCLTDKSTQTGDREHWLLPCVHTCPAGLDVPGYIRAVAAGDFKAAAALVWEKLPLANMLSHICFHLCEAECRRSEIDDPLAICALKRFALEAGDGAFLEDAVKPPETGKRVAVVGAGPAGLAAACFLRFKGHAVTVFEAAQSPGGMPALSIPKYRLPQAVLDKDLAVIRNLGVEIKTGCRLADGAAMADLLGKGHDAVLISVGLPSSKRIAVEGSHLERVFWGLEFLSGAKAGQTFDLGQQIVVVGGGNVAIDVAMTALRLSGGSVRLFCLESREEMPAHAHEIETAEAEGIEINSQWGPAAILDEQGRVSGVEFRRCLAVFDQQRNFAPTFDEQQRMTVAADTVILAVGQAPPQGIPGEQDGVFLAGDIVGGQLSAIHAIASGRAAAERIDRHLGGDGVVSLRPSDQASPKAWIGREEGFAPRARVPLPCAAPEQRRTDFREIERTYSAEQAMAEAKRCLQCDLRLMIAEPAAPPQRWLELNHSNVEQVPAVEGVFILTGPDKKPTVIKGMENIQAGLLERLESATEAGFFLWEEDRMYTKRESELIQQHLEQYGELPGGGDDELDDLF

SEQ ID NO: 66044 - protein, 286 aa, Wolinella succinogenes DSM 1740
MNLESVMEGFERFLEEEAPLFEGFHPHYNEYLWEMVRNGGKRFRPRLLLGVVSALAPLLVKSAYAPALALEILHTYSLIHDDLPAMDNAATRRGHPTLHVKYDEASAVLAGDALNTHAFYLLAQAPLGSDTKVALVRELASAGGAGGMVLGQALDCYFEHQKLEIEKLRFIHLHKTGRLIAASLKMGAIIAALSKEEQARLEEIGLKLGLLFQVQDDIIDATWSEEEAGKTTQNDGAKNSYVNLLGLEGARMEHARLKEEVRVLLGFFPEALSLTLLEILEKQFKS

SEQ ID NO: 66045 - protein, 264 aa, Oryza sativa Indica Group
MASPSSSSSLCSTFASPRAASLGRRLAFSSPRKAFRVRASSRVDKFSKNDIIVSPSILSANFSKLGEQVKAVEVAGCDWIHVDVMDGRFVPNITIGPLVVDALRPVTDLPLDVHLMIVEPEQRVPDFIKAGADIVSVHCEQSSTIHLHRTVNQIKSLGAKAGVVLNPATPLTAIDYVLDVVDLVLIMSVNPGFGGQSFIESQVKKIAELRRLCAEKGVNPWIEVDGGVGPKNAYKVIEAGANAIVAGSAVFGAPDYAEGMASFQ

SEQ ID NO: 66046 - protein, 556 aa, Phytophthora cactorum
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGLDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGLCESQNPVQLAGEPVSNHDELMSNFSAQPDALARGKSIEDLKAEGVPEKLQNHKLFPGNRPSISLLFKKLDAFSTGRLLALYEHRTVVQGAIWGINSFDQWGVELGKVLAKQVRAQLSASRTENAPVKGFNSATTSMLEAYLAHKA

SEQ ID NO: 66047 - protein, 556 aa, Phytophthora cactorum
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGLEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGLDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGLCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66048 - protein, 109 aa, Moorella thermoacetica ATCC 39073
MAASNIITLTDANFEEEVLSATTPVLVDFWAAWCGPCRMIAPIVDELAQEYAGKVKVAKLNVDEYPKIPADYGIMSIPTLILFKNGEVIARTVGYQSKEKLAQVLENNL

SEQ ID NO: 66049 - protein, 471 aa, Photobacterium profundum SS9
MTRDDLMSFASLGLSAPILEAVTKQGYETPSPIQAQAIPAVIEGKDVMAAAQTGTGKTAAFTLPVLERLSNGPRVKPNQVRALVLTPTRELAAQVAESVALYAKNLPLSSAVVFGGVKINPQMMRLRQGADVLVATPGRLLDLYNQRAVRFDQIEVLVLDEADRMLDMGFIRDIRKLLAAMPKQRQNLLFSATFSDEIRQLAKGLVNNPVEISVTPRNATAPTVKQWICPVDKSRKANLLTKLLKENNWGQVLVFTKTKHGANRLTTHLEGRGIKAAAIHGNKSQGARTKALANFKSNEIQVLVATDIAARGLDIEQLPQVVNFELPHVAEDYVHRIGRTGRAGCEGQAISLVCADEYKDLAAIERLIKQVLPREQVSGFEAVNKLPESRLDTRAIKPSKPKKPKTDHRDGQRSGENAKGHKPQGKNKRHVGGKSQNEGTGKPSNRSGAGTGAPKAKPAKRRTPRPASVTR

SEQ ID NO: 66050 - protein, 310 aa, Ralstonia solanacearum GMI1000
MTASVAAAPDPAGLDPELAHIAPALKAEILAQALPYIRKFHGKTIVIKYGGNAMTEEKLKHGFARDVILLKLVGMNPVVVHGGGPQIDDALKKVGKTGTFIQGMRVTDEETMEVVEWVLGGEVQQDIVMLINQYGGQAVGLTGKDGGLIRAKKLKMPDREQPGQFIDIGFVGDIETINPAVVRALQDDAFIPVISPIGFSDDGQAYNINADVVAGKMAEILKAEKLVMMTNIPGVMDKQGNLLTDLSAREIDELFADGTISGGMLPKISSALDAAKSGVNSVHIIDGRIEHSLLLEILTEQAFGTMIRSH

SEQ ID NO: 66051 - protein, 115 aa, Vitis vinifera
MAEEGQVIGVHSVEAWNDHLQKCNESNKLIVVDFTASWCGPCRFITPFLVELAKKIPTVTFLKVDVDELKSVATDWAVEAMPTFMFLKQGKIVDKVVGANKDSLQQTIAKHMATA

SEQ ID NO: 66052 - protein, 256 aa, Oryza sativa Japonica Group
MPGDPVPDQPDHRVPAPVRVGAVREALPPRVGSRRARRRSRGSSWESPTMCLPPLVLSAAASSSALRAAALLPGALYALHYVNRTLVHPLRLLRLRRAPAPVPILVAAFAFGFNLLNAYVQARSWALDAAAPHSTATATATPAAVARCLVGLALFAWGMRTNIAADKALLRLKEAGKGYQIPRGGLFDVVTCPNYFGEAVEWLGYALVAWTPAAWAFFLYTCSNLGPRARDHRRWYVGKFGDKYPASRKAFVPYIY

SEQ ID NO: 66053 - protein, 299 aa, Corynebacterium glutamicum ATCC 13032
MPAAGLGTRFLPATKTVPKELLPVVDTPGIELIAAEAAELGATRLAIITAPNKAGVLAHFERSSELEETLMERGKTDQVEIIRRAADLIKAVPVTQDKPLGLGHAVGLAESVLDDDEDVVAVMLPDDLVLPTGVMERMAQVRAEFGGSVLCAVEVSEADVSKYGIFEIEADTKDSDVKKVKGMVEKPAIEDAPSRLAATGRYLLDRKIFDALRRITPGAGGELQLTDAIDLLIDEGHPVHIVIHQGKRHDLGNPGGYIPACVDFGLSHPVYGAQLKDAIKQILAEHEAAERIADDSQVK

SEQ ID NO: 66054 - protein, 311 aa, Cryptococcus neoformans var. neoformans B-3501A
MPTITQPIANIFKAAHIPANELSIAASTSGLIITHSTTGKQYFTKTDRNVPEMRGEVASLVAMSKTSTGLVPELLGFEVSPDGKEGTMVTQWFDLSSARGGHTQRGLGSKIAQMHMPPPEGTEGYEGKYGFPVPTHCGATEQDNTWEESWEVFWRDRRLGNLVNRIGDKEINALWEDMKRKAVPLLLHSFSPAPQPVILHGDLWSGNAGYDETTSSPVIFDPASYYGHNEADLGITHMFGGFSYEFYDEYHQVHPRSSPYYDERQKLYELYHHLNHTYMFGGSYKHGAMGIMRSLIAWAEREGQEEAVEEC

SEQ ID NO: 66055 - protein, 461 aa, Aspergillus nidulans FGSC A4
MAATQAANLVEKAVGHSGTATVTTDISNYNNEHGVETGEKIRATVWQGKNSVGIVEMPKPRVVDAGDVIVRVTGSTVCGSDLHLYHDYLSDRAHAGVIPQLQKGDVLGHECCGVIESVGPESTKYKPGQRVVVSFPIACGTCKRCKAQLYSQCENTNENTITNAMYGKRTAGIFGYSHFTGGFAGGQAEYLRVPYGDVNLLPIPDDVPDEKALFLSDVISTSWHCVVDTGVNKGDIVAVWGAGPIGQMAVDFAFYHGAERVILIDGGDGAWRLEYVKSKLPKVEVIDFTNLPKGESVSSHLRKITDHNLDVCLECVGGEYAKGWIHFFEQMVGAETDTSEIVNEMITAVRPFGRVGLTGVYAGYTNHFNIGSLMQTGVRLIGNGQAPVQKYWGDLMNLIQKGDIDPLRMVSHRFRLEDIDKVYSLFNERNGGVQKVYLETRHSAPAAKEGPQLTNWHMIFI

SEQ ID NO: 66056 - protein, 492 aa, Yarrowia lipolytica CLIB122
MTVTEQEFLASYPQKVAPGGPTGYPGNLTAEQEQKLGELKMILLTKGYEDRTDDATLLRFLRARKFDVPLAQEMWENCEKWRKEFGTNTILEDFWYKEKKEVAKLYPQYYHKTDKDGRPVYVENVGKVNIHEMYKITTQERMLRNLVWEYESFVRHRLPACSRVVGHLIETSCTILDLKGVSLSSASQVYGFLKDASNIGQNYYPERMGKFYLINAPFGFSTVFSVIKRFLDPVTVSKIHVYGSNYKEKLLAQVPAYNLPIKFGGQSSSKIGVELSDDGPWRDPQFVGPEGLAPVAGERPTGAPSIVSNSSTYAKSTASTKVGADDKATDAKANGNGAAAAAAGAGTAAAGGAAAAAGASSSKQAAPAQAAPAQAAKAPVPAAAKTATAPAPTGKTAAPQTNSFPPEMLAMMEQNEKKAEKAAEAKTKGGAAPQANAFTDEQLAQLNSLPQQVATGGVSQPLPDSHVTQGVPTVAKIAEAAAGPHEDAHLPH

SEQ ID NO: 66057 - protein, 379 aa, Rickettsia conorii str. Malish 7
MRKRFYNVLFTEKFMTLKLGIVGLPNVGKSTLFNALTASQAADAANYPFCTIEPNSSKVLVPDARLHKLASLAGSGKIIPSYIEFVDIAGLVKGASKGEGLGNKFLSHIREVDAILHVLRCFEDEDITHVHNKVDPLHDLEIIETELILADIESVEKRLATSEKRLKSGDKAMAEQIELLKEVYKVLGEDKPARVLNEALRVDNLKQLQLITSKPVLYICNVLEKDAAIGNEFTKLVAERAKKENAKSVVISSKIEAEIALLESMEEKEEFLKFIGLDETGLNKVIKEGYNLLNLKSFFTIGPKEAHSWTFKDGTLAPAAAGIIHTDFEKGFIRAEVIGYKDYINLGSEAKAKEVGKMRLEGKEYKMQDGDIVHFRFNV

SEQ ID NO: 66058 - protein, 427 aa, Triticum aestivum
  misc_feature (164)..(164): Xaa can be any naturally occurring amino acid
  misc_feature (401)..(401): Xaa can be any naturally occurring amino acid
LLRLLASPHPPPATMAGSDDDEAAAAPIHCLPPDALRNVLLRLPLRDAVACRPVSRLFRETLTGPFLALLPALRLLLLRHPRPEGGGCLHAFDPDRRCWLRLPFTSFLPHQAFSPVASSASLLYLWIETGHSPSPSPAPLPSSSSSSSSSSPAAAHPPKALAVXPNPLAGTYRLLPPLGSAWARHGTVLAGPGGIVLVLTELAALSYSPSEGSGKWMKHPLSLPSKPRSPILAAGARAVFALCDVGTPWRSQWKLFSCPLARLTGGWAPVERASWGDVFEILKRPRLLAGAGGRRVLMIGGLRSSFALDAPCSTVLILRLDLATMEWDEAGRMPPNMYRCFTGLCEAAAQGSAMPAPVAGGNNKVKVFGGDGKVWFGGKRVRGKLAMWEEDDVGSSGGKWXWVDGVPGYGDGVYRGFVFDGGFTAMP

SEQ ID NO: 66059 - protein, 440 aa, Aspergillus oryzae
MESSSSSSESESEEEKPAKKEVKKAAKSSSESSSESSSESESDSDSDEEMEDASSSESEEEKPAKKQKQESKKESKKAKESSSESSDSSESESESESEDEKPAKKEVKKAAESSDSSESDSSDEEEAPKKAAKEASDSDSSESESDSDSEESPKKSESEDSEESAKDSKKRKAEEDVSATPKKTKTEEPAAGASANLFVGNLSWNVDEAWLQSEFEEFGELSGVRIMTERDTGRSRGFGYVEYTNAVDAAKAFEAKRDTEIDGRKINLDYATGRPANREQGGFQDRAQARARSFGDQASPESDTLFVGNIPFSANEDSLHEVFGQKGSILGIRLPTDPESGRPKGFGYVQFSSVEEAREAFNELNGAEIDGRPVRLDFSTPRANNGGGGGGRGRGGFGGGRGGPRGGGGRGRGGFGGRGGGPPNKARGGIPEYKGTKVTF

SEQ ID NO: 66060 - protein, 137 aa, Triticum aestivum
MAGEADGKTYQVSRMPPAALNERILSSLYQKHVAAHPWHDLYIGPGAPAVFNCVVDIPRGSKGKYELDKATGLIEGDRVLYSSVVYPHNYGFIPRTLCEDNDPMDALVLMQEQAAPGCFLRARAIGLMPMIDPGEKR

SEQ ID NO: 66061 - protein, 410 aa, Oryza sativa Japonica Group
MGVLSRPEEVLPLVKLRVAAGRIKRQIPPEEHWAFAYTMLQRVSRSFALVIQQLGPDLRNAVSIHHLFLLLPLLPSAVPEFSCVFTVSRARGDSDGRCADSAGGTKDYKLLMDKFRLVSTAFLELGQGYQEAIEEITRLMGAGMAKFICKEFHVQFLAVLSVETVDDYNEYCHYVAGLVGYGLSRLFHAGGTEDLASDSLSNSMGLFLQKINIIRDYLEDINEIPKSRMFWPREIWSKYVNKLEDLKYEENSEKAVQCLNDMVTNALSHAEDCLQYMSALKDHAIFRFCAIPQIMAIGTCAICYNNVNVFRGVVKMRRGLTARVIDETNTMSDVYTAFYEFSSLIESKIDNNDPNASLTRKRVDAIKRTCKSSCSLKRRGYDLEKSKYNSMLIMVVLLLVAIVLGMIYAK

SEQ ID NO: 66062 - protein, 207 aa, Zea mays
  misc_feature (156)..(156): Xaa can be any naturally occurring amino acid
  misc_feature (188)..(188): Xaa can be any naturally occurring amino acid
MASEINPKTEAFDAHDGSPRYDEKHGTTEPIQTPKGSWALRNGLTIESFKAHDDYAKGTVELSRDMKPRHLNMIAIGGSIGAGFFVGSGGALQTGGPGSLTIGFLIMGVMIFNVVYALGELAVMYPVSGGFYTYANRFVDPSWGFAMGWNYVMQWXFVLPLELTVCGTVIQYWAPDTSVAIWVSVFLXVIIIVNIFGTLGYAEEEFW

SEQ ID NO: 66063 - protein, 324 aa, Synechococcus elongatus PCC 6301
MQRTMADRLTNLFPFWLLLIGAIALRWPQIFIGLNQGNLPVLILTLVMLGMGLTLSLDDFQRVSRLPRAVLTGFCAQYLIMPFLGWAIGAALQLPTALAVGLILVGTCPGGTASNLITYIARADVALSVVMTLASTLAAVVMTPLLTQFLAGAYVPVNGWLLFAQTLQVVILPVAIGVALNRWTPRLVRQVLPIAPLLSVVGICLICAATFSANAEAIVQQGRQMLLGVFLLHSLGFALGFGFAKLFGYSQAIARTIAIEVGMQNSGLAIILARQAFPLLPLAAAIGAISGVMHSLVGSFLAVIWRSQAQRQSEAVQPHNSLTM

SEQ ID NO: 66064 - protein, 242 aa, Moorella thermoacetica ATCC 39073
MESFWTRTEMLIGAAGRKRLAAARVAVIGTGGVGSFAVEGLARAGVGYLELVDPDVVKPSNLNRQLPALGSTLGQPKVAVLAARCRDINPEATIIPRQEAYSPATSLKFVRPDLDFLVDAIDSVKAKIDLLATAVTAGRPIVSSMGAGNRLDPTLLRVADISATRGCPLARAVRRGLRARGIAGGLTVVYSEEPPLEVRTKPQLAPGERQPPGSMIFVPAVAGLILANLVVRALLQGDSYSK

SEQ ID NO: 66065 - protein, 183 aa, Zea mays
  misc_feature (46)..(46): Xaa can be any naturally occurring amino acid
MMSRERKKAAALQEKLKILRSITHSHAFDLFPLRINYLAYGHVHRXLSNTSIIMDASAYIKELKQKVVRLNQEIACAQDALRHKASSYPTVTVEALGVQGSSFLVNVFSDKSCPGLLVAVLEAFDELGLSVLQATASCADSFRLEAVGGENVADNVDEHVVKQAVLQAVRSCSEGGSEHDDEE

SEQ ID NO: 66066 - protein, 415 aa, Tradescantia virginiana
TTPISIEDVRREVKILKALSGHKHLVKFYDACEESLNVYLIMELCEGGELLDRILSRGGKYTEEDAKAIVMQILNVVAYCHLQGVVHRDLKPENFLFINRDENAPMKLIDFGLSDFTRPDERLNDIVGSAYYVAPEVLHRSYSMEADIWSIGVITYILLCGSRPFWARTESGIFRSVLRADPNFDDSPWPTASPEAKDFVKRLLNKDYRKRMTAAQALSHPWLRDKEPQIPLDILIYKQTKLYLRATPLKRAALKALSKALTEDELVYLRLQFKLLEPNNDGRVSLENFHTALAQNATEAMKESRVLDILNSLESLAYRRMDFEEFCAAAISCYQLEALEHWEQIASTAFEYFEQDGNRVVSVEELAQDLNLPQNAYAILKDWIRQSDKKLSFLGYTRYTRYLHGVTPRPNTRQH

SEQ ID NO: 66067 - protein, 78 aa, Pseudomonas putida KT2440
MSTIEERVKKIVAEQLGVKEEEVTVEKSFVDDLGADSLDTVELVMALEEEFETEIPDEEAEKITTVQAAIDYVKAHQA

SEQ ID NO: 66068 - protein, 453 aa, Glycine max
  misc_feature (142)..(142): Xaa can be any naturally occurring amino acid
MATHAALASTRIPTNTKFPSKASHSFPTQCASKRLEVTEFSGLRSTSCVTYANDARESSFFDLVASQLTPKQTNGSSTPVRGETVAKLKVAINGFGRIGRNFLRCWHGRKDSPLEVVVVNDSGGVKNASHLLKYDSMLGTFXADVKILDNETITVDGKRIIVVSSRDPHKLPWAELGIDIVIEGTGVFVDGPGAGKHIQAGAKKVIITAPAKGADIPTYVVGVNEGDYTHQISNIISNASCTTNCLAPFVKILDEEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSQRVVDLAHLVASKWPGAAKAGSGDPLEEFCETNPADEECKVYE

SEQ ID NO: 66069 - protein, 286 aa, Moritella sp. PE36
MDIEVLLVNSFTANGKGGNPAGVVLNADKLSDTQKLKIAQAVGYSETAFVSNDDEVDFEVSFFTTTNEVDFCGHATLATFSIMYQMNLLTAGDYVQRTKAGILPVVIDSDGQVTMDLQLPETLGGFSYQEIAPVLGIDSAILASTNLPIEVVSTGLADLIIPVPIGQLDLINPNDLAITDFCKKHDIVGFHVFERCAPGSLFTASCRNFAPLFGIPEESATGSASGALACYLAEHLPLDNKYIFEQGRAMNCASVITVSVGFQDAKIASVKVGGVANQIGSMFVPI

SEQ ID NO: 66070 - protein, 269 aa, Klebsiella pneumoniae subsp. pneumoniae MGH 78578
MQSQESEALQARYRLACELAKAGAELAFEYYQQREALTVDHKGDDLQDVVSVADKRVEAFVKQRIQSAFPEDGFLGEESGARLPDARVLWVVDPIDGTSCFLNGLHTWCLSLAIVADGEPVIGVVYDPNHRELFHALRGHGAWLNDAPIRPHPATTVKEGVMGVGTSHRVTPADFLPFLQALLSDGGMFIRNGSGALMSAWAAAGRLIGYYEPHMNPWDALPGLVLMREAGGASNDFLAQEGIQRGNPLLLASQTLYPQLKKMIPQPLH

SEQ ID NO: 66071 - protein, 354 aa, Nostoc punctiforme PCC 73102
MNTLLFPVILAGGKGERFWPLSRKDRPKQFLSLDGSSRSLLQATADRLIKLGDGWDSLWVITSSQIAEGVRQQLPDLPVENLLIESEGRDTAAAVAWTSLEIKQRYGEDAVIGFFPADHWIADEEAFAHTLSAATQLAASTAAIVTLGIKPTFPSTGYGYIEQGEKIGSFNELPAYHVNRFTEKPNRETAETFLSTGRFSWNSGMFVFRAGVVLEELHTHAPEIIEPLEQQGLDIYPQLPKKSIDYALMEKTTLAYVLPVDFGWDDLGDWNAIERLLKTEENPNVELATHVGLDTQGAIIYASNPEDVVVTIGLEDVVIVRDRNVTLVVKKERTQEIKQILKILQSDSRFTDLL

SEQ ID NO: 66072 - protein, 609 aa, Xylella fastidiosa Ann-1
MSNPSSTPLLFADLGLSDAVMQAVTKIGYETPSPIQAATIPALLAGRDVLGQAQTGTGKTAAFALPLLTRTVLNQVKPQVLVLAPTRELAIQVAEAFQRYAASISGFRVLPVYGGQSYGQQLAALKRGVHVIVGTPGRVIDHLERGTLDLSELKTLVLDEADEMLRMGFIEDVEEVLRKLPASRQVALFSATMPPQIRRIAQTYLQDPIEVTIATKTTTAANIRQRYWWVSGLHKLDALTRILEVETFDAMIIFVRTKAATEELAEKLQARGLTAAAINGDMQQAQRERTIHQLKDGKLDILVATDVAARGLDVERISHVLNYDIPYDVESYVHRIGRTGRAGRSGEAILFVTPREKGMLRQIERATHQPIEAMQLPSVDAVNDTRVTKFFGRISNALVVGAEIDFYRKLLQRFESEHNVPAIEIAAALARLLQGDSPFLLSVPTRPQRERSELASEHHVKRPSSFKQTERPNNTEHPKRPQRNAPARNVPEFGMESYRIEVGRMHGVKPANIVGAIANEAGLESRYIGRIDIRDDHSVLDLPAEMPHEILQHLKKVWVSGQQLQMRRIDTTETTAPAREFKSKSGGAGKFPPKPHHNKSTKPKPPYSG

SEQ ID NO: 66073 - protein, 347 aa, Staphylococcus epidermidis RP62A
MSYKIVALPGDGIGPEILSGTLELLKLISEKYHFEYHLESHHFGGVSIDYYGTPLTNETLQSCKNADAILLGAIGGPKWTDPNNRPEHGLLKLRKSLNLFANIRPTFVTKGASHLSPLKQDIVEGTDLVIVRELTSGIYFGEPSYVKKTEALDSLKYSSQEIERIVRIAFNLANRRRKKLTSVDKENVLSSSKLWRQIVNDVKKDYPEVEVNHMLVDACSMHLITQPTQFDVIVTENLFGDILSDEASVIPGSLGLSPSASFGQTGTRLYEPIHGSAPDIANEDKANPFGMVLSLALCLRESLNQNDAANELESIVYSFIQSNKTTADLGGQYRTSEIFKLLKEKYL

SEQ ID NO: 66074 - protein, 363 aa, Oryza sativa Indica Group
MSSFDSVAAVAGDGDADDDDVLPPAPFDPAADGAQGGLGALRRGHRFATSYSSFGTAASEDDLAGAGAGTDGGVGAGIPLGSSSNGGAAYGYGGSGDVMNGHVDQIGDVMGGGVVVGDGGGIDDDLFAGAGDGDDGPVLPPPEAMKEEGILRREWRRQNALMLEEKERKERERRGEIIAEADEFKRSFAEKRKLNGDTNRAQNRDREKLFLAKQEKFHGEAEKQYWKAIAEMVPHEIPGLEKRGKRREKQSAEANAKAKQPGVVVVQGPKPGKPTDLSRMRQVLMKLKQTPPPHMAPPPPQPAKDTGGDTDANKDGEAEKAAGEIEKKAAGGEKEAAAGPPVTAAAAADAQANKAAAEETAKK

SEQ ID NO: 66075 - protein, 313 aa, Klebsiella pneumoniae subsp. pneumoniae MGH 78578
MATFDAVFVGLTILDIAGRPVVAIPPRGGVAFIEQIRLNPAGTAAGANINAAKLGIRTAAVACLGEDEKADFILASYARLGIDCSLIQRTALKETSATILPIRPNGERPALHCRGASDALFVSEAEFDAVLDCRFLHHGGTGLLAAMDQGQSARLLQAAKARGVTTSFDLIAPNEETLELLRPLLPSVDYFMPSLEEAAFLSGETQPEAIGRFFLALGVGTCILKDGENGSWLIGRDGGPQHIAPWPVEAVDTTGCGDSYCGGFIAALARGLSVKAACDVASAVAALVATGMGSDAGVVDWEQTQAFMAAHRP

SEQ ID NO: 66076 - protein, 325 aa, Solanum tuberosum
MAGEKIGIAKDVTELIGNTPLVYLNNVVDGCVARVAAKLESMEPCSSVKDRIGYSMITDAEEKGLIKPGESVLIEPTSGNTGVGLAFMAAAKGYKLIITMPSSMSLERRIILRGFRSELVLTDPAKGMKGAISKAEEIKAKTPNSYILQQFENPANPKIHYETTGPEIWKGSNGKVDALASGIGTGGTITGSGKYLREQNPNVKLYGVEPVESAILSGGKPGPHKIQGIGAGFIPGVLEVNLIDDVVQVSSEESIEMAKLLALKEGLLVGISSGAAAAAAIKVAKRPENAGKLIVVIFPSFGERYLSSVLFETVRREAENMTVEP

SEQ ID NO: 66077 - protein, 422 aa, Staphylococcus epidermidis RP62A
MTVRTKVSTKDIDEAYLRLKNIVKETPLQFDHYLSQKYNCNVYLKREDLQWVRSFKLRGAYNAISVLSNEEKNKGITCASAGNHAQGVAYTAKKLNLKAVIFMPVTTPRQKINQVKFFGDSNVEIVLIGDTFDHCLAQALNYTKQHKMNFIDPFNNVYTIAGQGTLAKEILNQAEKEDKTFDYVFAAIGGGGLISGVSTYFKAHSPHTKIIGVEPTGASSMYQSVVINHSIVTLENIDKFVDGASVARVGDITFDIAKDKVDDYVQVDEGAVCSTILDMYSKQAIVAEPAGALSVSALEQYKKQIENKTIVCIVSGGNNDINRMKEIEERSLLFEEMKHYFILNFPQRPGALREFVNDVLGPQDDITKFEYLKKTSQNTGTVIIGIQLKHHDDLIQLKDRVCQFDPSNIYINENKMLYSLLI

SEQ ID NO: 66078 - protein, 292 aa, Oryza sativa Japonica Group
MPPPPPAAPLKAIDLEVTVVSGKHLKNVNWRRGDLRAYVVAYLDPSRRAATRPDDVGGCKPAWNERVVLPLPPHLSPHDPSLLLSLDVFHSKPSDSPKPLVGSARSPLRDLLFSTNPNPSPDSPASALITLPLLRPSGRPQGKLRIRLALRERSPPPPEPQYPPPSSSPYYFPPPPPPAYSAPPPPQYGSEQYYRSGGYYSAPPPPPQYEYTAGPSAPVEYNRQYDPRAGSGSGNGRYGVGTGIAVGTVTGALGGLAIDEGVKYKEEKSADRVEDKVVPAGRDDDSRGYREY

SEQ ID NO: 66079 - protein, 494 aa, Bacillus cereus ATCC 10987
MLTKNIELKPKVKAFLNEEIKMFINGEFVPSISGKTFETYNPATEDVLAVVCEAQEEDINVAVKAARSAFESGPWAEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPKGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKETEMGPLVSKKQQERVLHYIEQGKAEGATVAAGGERAFEKGYFVQPTVFTNVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 66080 - protein, 328 aa, Salmonella typhimurium LT2
MGQLIDGVWHDTWYDTKSSGGKFQRSASAFRNWLTADGAPGPSGEGGFAAEKDRYHLYVSLACPWAHRTLIFRKLKGLEPFIPVSVVNPLMLENGWTFDDTFPAATGDTLYQHEFLYQLYLHADPHYSGRVTVPVLWDKKNHTIVSNESAEIIRMFNSAFDGLGAKAGDYYPPALQSKIDELNGWIYDNVNNGVYKAGFATSQQAYDEAVDKVFTALARLEQILGQHRYLTGDQLTEADIRLWTTLVRFDPVYVTHFKCDKYRISDYLNLYGFLRDIYQISGIAETVNMDHIRHHYFRSHKTINPTGIISVGPWQDLLEPHGRDVRFG

SEQ ID NO: 66081 - protein, 181 aa, Arabidopsis thaliana
MASSMLSSAAVVTSPAQATMVAPFTGLKSSASFPVTRKANNDITSITSNGGRVSCMKVWPPIGKKKFETLSYLPDLTDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTDA

SEQ ID NO: 66082 - protein, 190 aa, Azoarcus sp. BH72
MSFNIPNSLTWARIALIPIFVGIFYAPDGWIGPAQKNLVATAIFIVAAITDWFDGYLARALRQTSAFGAFLDPVADKLMVAAALILLVQLARVDAIIAVVIIGREITISALREWMARVGESSSVAVAYVGKLKTAAQMTAIPLLLYNGQLLSIDLRFIGSVLIYVAAALTLWSMGYYLHRAAPRLARHKD

SEQ ID NO: 66083 - protein, 531 aa, Bordetella parapertussis 12822
MSLPFDWSFPYASRKMPVLASNAVATSQPLAAQAGLRMLLAGGNAVDSAIATAIALTVVEPVMNGIGGDLFALVWHGGRLHGLNSSGCAPAAWTPEYFAGRETMPPTGWGAVTVPGQVAGWKALSERFGKLPFAALFEPAIAYAEQGFPVSPTIARQWATQAPKLAGEPGFADAFLPQGQAPQAGQWWRFPAQARTLREIAETGGASFYQGELARRIADFARQTGGALREQDLAEHRPEWVEPISQSFRDYELHEIPSNGQGIAALMALGMLEQFDLEAMGHDSADYYHVSIEAMKLAFADLHQHVTDPRHMRVNAAALLDPAYLAERARLISMDRSSVPAAGAPATGGTVYLTAADADGTMVSFIQSNYHGFGSGVVVPDTGISLHNRGMNFVLTPGHVNQVAPRKKPMHTIIPAFMTRKGQPAMSFGVMGGSMQAQGHLQMATRLAAFGQNPQAMSDAPRFRVENGPVVNVEAHLPADVVQTLRDRGHNVAVAPADSLEFGSAQLICRLPEGGYLAASDSRRDGQAVGF

SEQ ID NO: 66084 - protein, 419 aa, Yarrowia lipolytica CLIB122
VAKTQTRNLSLHEFRSAQILQNYGIDVPKGGAATTPQQAEDIAKKLGCEDMVIKAQALTGGRGKGHFDNGLKGGVKLISSPTEAKMYAEQMLNHKIFTKQTGPQGKPVTAVYVVEREFVRREAYVAILMDRATQKPIIVASSQGGMDIEGVAAENPDAIHTFPVDIHTGVTDTQAIEVAKALGFSSKATQEAADDIKKLYKVFTDKDATQIEINPLSETTDHRVVAMDAKLGFDDNASFRQEEVWSWRDLTQEDPEEIEAAKHGLNFIKLDGNIGCLVNGAGLAMATMDIIKLYGGEPANFLDCGGGATADAIKKAFELITSEPGVTAIFVNIFGGIVRCDNIAKGLIAVAQNMNLNIPIVARLQGTNLAEAQKLISDSGLKIFSFGDLDEAAQKVCQLSKVVEMAREIDVNVSFELPL

SEQ ID NO: 66085 - protein, 508 aa, Zea mays
MAALPASAPAPAPAPSEAAELVPTLSSLEPVYGAGAQLDEARLRFARLGDRFHAVYGARPALFARSPGRVNLIGEHIDYEGYSVLPMAIRQDMIVAIRRANGAQVRVANVDDKYPLCVYPADPDKEIDVKNHKWGHYFMCGYKGVYEYCRSKGIDLGKPVALDVVVDGTVPQGSGLSSSAAFVCSATIAIMGILDKNFPKKEVAQFTCLSERHIGTQSGGMDQAISIMAKPGFAELIDFNPIHATDVQLPSGGTFVIAHCLAESKKAETAATNYNNRVVECRLAAIVLAIKLGMDRKKAISSVTTLSDVEGLCVSFAGREGSSDPAVAVKKLLHEDPYTAGEIEKITGEGLTSVFQGSQTSLDVIKAAKHYKLFQRATHVYSEARRVYAFRDTVSSKLSEEGKLKKLGDLMNESHYSCSVLYECSCPELEELVKVCRDNGALGARLTGAGWGGCAVALVKEPIVPQFILKLKEMYYKSRIDRGVIKQGDVGLYVFASKPSSGAAILRL

SEQ ID NO: 66086 - protein, 135 aa, Synechococcus elongatus PCC 6301
MPMARPLARLFAIVLVAVIGLTACTGGGDSAISGNYRQDTLAVVTSLRNAITLPDDAPEKSAAQAEARQLINDFAARYRRDSRVSGLSSFTTMQTALNSLAGHYSSYPNRPVPEKLKKRLEKEFRMVELALNREA

SEQ ID NO: 66087 - protein, 534 aa, Oryza sativa Indica Group
MARGSGAGGGGGGGGGGLELSVGVGGGGGARGGGGGEAAAAVETAAPISLGRLILSGMVAGGVQYGWALQLSLLTPYVQTLGLSHALTSFMWLCGPIAGMVVQPCVGLYSDRCTSKWGRRRPYILTGCVLICLAVVVIGFSADIGYAMGDTKEDCSVYHGSRWHAAIVYVLGFWLLDFSNNTVQGPARALMADLSGRHGPGTANSIFCSWMAMGNILGYSSGSTNNWHKWFPFLKTRACCEACANLKGAFLVAVIFLSLCLVITLIFAKEVPFKGNAALPTKSNEPAEPEGTGPLAVLKGFRNLPTGMPSVLIVTGLTWLSWFPFILYDTDWMGREIYHGDPKGTDPQIEAFNQGVRAGAFGLLLNSIVLGFSSFLIEPMCRKVGPRVVWVTSNFLVCIAMAATALISFWSLKDFHGTVQKAITADKSIKAVCLVLFAFLGVPLAVLYSVPFAVTAQLAATRGGGQGLCTGVLNISIVIPQVVIALGAGPWDELFGKGNIPAFGLASGFALIGGVAGIFLLPKISKRQFRSCAW

SEQ ID NO: 66088 - protein, 517 aa, uncultured bacterium
MKSRETVAILDFGSQYSQLIARRVRENHVYSELLSPQASPARLREMGVRGIILSGGPASVYAADAPTCDPGIFELGIPVLGICYGMHVACRLLGGDVGAGQSREYGRVRLQIDRPEGVLAHLPGEISVWMSHGDVVTRVADCFESLAHTEGCPTAAVRHKTRAVFGVQFHPEVTHTPQGAQMIRNFLYDVCRCTGDWKVDSVIEDSVETTRQRVGPDERVICGLSGGVDSSVVAALLHRAIGDRLVCIFVDNGLLRRREAELVEATFHGHFGMQLRAVDARQRFLTRLAGVVDPQEKRRIIGHEFIEVFKDEATRIEGARFLAQGTIYPDVIESGHGPTGHAAVIKSHHNVGALPKELGFELIEPLRLLFKDEVRQVGLALGLPEDLVWRHPFPGPGLAVRIAGDITPERLELLRSADEILLEEITVAGWYQKIAQAFAVLVPVPSVGVMGDGRSYEGQHLIVLRLVESSDFMTADWVHVDYDVLARISNRIINEVPGVNRVTYDVSSKPPSTIEWQ

SEQ ID NO: 66089 - protein, 494 aa, Bacillus anthracis str. A2012
  misc_feature (307)..(307): Xaa can be any naturally occurring amino acid
MLTTNIELKPKVKAFLDEEIKMFINGEFVPSISGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAETIKHVTLELGGKSPNIILEDADLEEAINGAFQGIMYNHGQNCSAGSRVXVHRKHYETVVNELVKMANNVKLGAGMEKDTEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 66090 - protein, 357 aa, Glycine max
MEEINKNPSGTSLLVPSVLELAKENLTTVPQRYIQPQHQDMVLISEEDHSTLEIPVIDMHRLLSVESGSSELDKLHLACKEWGFFQLVNHGVNSSLVEKVRLETQDFFNLPMSEKKKFWQTPQHMEGFGQAFVVSEDQKLDWADLYYMTTLPKHSRMPHLFPQLPLPFRDTLEAYSQEIKDLAIVIIGLMGKALKIQEREIRELFEDGIQLMRMNYYPPCPEPEKVIGLTPHSDGIGLAILLQLNEVEGLQIRKDGLWVPVKPLINAFIVNVGDILEIITNGIYRSIEHRATVNGEKERLSFATFYSPSSDGVVGPAPSLITEQTPPRFKSIGVKDYFKGLFSRKLDGKAYIEVMRI

SEQ ID NO: 66091 - protein, 491 aa, Blastopirellula marina DSM 3645
MLSPTRDDTSGNVMTTVPPCIVGSSAPEFTLPAALPDLGQQRLQSADYRGRWLAILFYPRDFSFVCPTELTGFSAEKSRFDERGCDLLGISIDSVESHLKWLQTPSSAGGVEGLQFPLASDPHGELCKRFGVWREQDGLPNRGLFLIDPSGQLRYAASYDLSVGRNVEDVLRSLDALQAGGVCPANWKRADGVLDVASLLQPGRVLGHYRIERELGRGAFGQVLQADDLRLERKVALKVISKQDGQTETKLLREARSAASINHPNVCTVYSADTIDTLPTIVMEYLEGRPLVEVIGHGFDQRRFRRMAHKIALGLSAAHAQGVVHGDLKPANILLRENNEPVLVDFGLAQSLRQNGVESAAEVTPSKDAGESPLDPSKTLEFAAATATTSRPGGISGTPAYMSPEQASGERLNESSDIFSLGLIFAQMLTGKSPMSDLSVIEIITSLRRKDFVESLVEKIPSTYRADLVDMLAMKPEERPSAGDVCQRMAQ

SEQ ID NO: 66092 - protein, 467 aa, Xylella fastidiosa Ann-1
MNDILPVILSGGSGTRLWPLSREAYPKQFLPLVGHHSMLQATWLRAAPVTTHSPIIVANEEHRFIAAEQLQHLGVYPSAILLEPTGRNTAPAIAVAALEATRTGNDPLLLVLPSDHVIRDETAFQTAVHVAAEAAAQGKLVTFGITPNTPEIGYGYIKATGNDTIRPVERFIEKPDLATAQSYLASGDYFWNSGMFLFRASRYLAELSTFQPAIAEACQRAWSAAKRDTDFIRLDKEAFESSPADSIDYAVMEHTADAVAVPLDAGWNDVGSWSALHEVSKQDNDGNAHQGDVIQIDCRNTYAYGSRLIAMVGLENVVVVETDDALLVGHRDSIQTVKEIVGKIKANGRPEATWHRKVYRPWGAYDSIDTGQRFQVKRITVKPGGTLSLQMHHHRAEHWIVVSGTAEVTRGSEILLLTENQSTYIPLGVTHRLRNPGKLPLELIEVQSGSYLGEDDIVRFEDTYGRT

SEQ ID NO: 66093 - protein, 337 aa, Desulfococcus oleovorans Hxd3
MKKVLLTGGAGYIGSHTCVSLLESGCEVLVVDNLCNSSAVALERVKAITGRAVMFEKVDMRDRAELDRVFKTFAPDAVIHFACLKAVGESTTDPLTYYANNVAGSVVLFEAMEAAGVKNIVFSSSATVYGDPETVPVTEAAAICPCNPYGRTKRMIEEMLEDIHAAGKGWNIAILRYFNPVGAHASGLIGEDPRDVPNNLAPYIAQVAVGRRQQLNVYGDDYPTKDGTGVRDYIHVCDLAEAHVKALEKLAQNPGLVTYNLGTGTGHSVLEVVAAFERACGRPIARTVTGRRAGDVAEYYADPSRAEKELGWKARRTLDDMAADTWRWQSGNPEGYR

SEQ ID NO: 66094 - protein, 158 aa, Aegilops tauschii
EGEAFINEVATIGLIHHANIVQLLGFCSEGMRRALIYEFMPNESLEKYIFSGDSNIFQNLLVPEKLLDIALGIARGMEYLHQGCNQRILHFDIKPHNILLDYNFNPKISDFGLAKLCAGDQSIVTLTAARGTMGYIAPELYSRNFGGISYKSDVYSFG

SEQ ID NO: 66095 - protein, 487 aa, Populus trichocarpa
MKMGENTATKNHLPPQAFGVSVDTDPQSDSKWFDDDGRPKRTGNVWTASAHIITAVIGSGVLSLAWAIGQLGWIAGPAVMLLFSFVTYYTSILLSACYRSGDPDNGKRNYTYMEAVRANLGGVKVKICGFVQYVNLFGVAIGYTIASSISMMAIKRSNCFHQSGGKDPCRMNANPYMIGFGIAEILLSQIPGFDQLHWLSLVAAVMSFTYSTIGLGLGIGKVIENKRVRGSLTGISVGTVTQTQKIWRSFQALGDVAFAYSYSVILIEIQDTVKAPPSEAKTMKKATLISVVVTTLFYMFCGCFGYAAFGDQSPGNLLTGFGFYNPYWLLDIANTAIVIHLVGAYQVYCQPLFAFIEKEAARRFPDSDFVTKDIKISIPGLSAFNINLFRMVSRTIFVVLTTVISMLLPFFNDIVGLLGAFGFWPLTVYFPVEMYISQKKIPKWSTRWLCLQILSVACLIITIAAAAGSIAGVIDDVKTIKPFKTSY

SEQ ID NO: 66096 - protein, 335 aa, Agrobacterium tumefaciens
MPSSRRVRSRCCAFGITKRFACIRPACQRARMDAQMTNFETRLRENAAKTEALLGHLLSGEARADEITRPQNLLEAMRHGVLNGGKRLRPFLVIESVALLGGDAEAGLHVGAALECLHCYSLVHDDLPAMDDDDLRRGQPTVHRKFDEATAILAGDSLLTLAFDIIASDDNPLAAERKAALVISLARAAGIGGMAGGQALDLAAEKKAPDEDGIITLQAMKTGALLRFACEAGAIIAGSNQAERQRLRLFGEKIGLSFQLADDLLDLTADAATMGKATGKDAARGKGTLVALRGEAWAREKLQEQVAEASELLAPYGEKAAILIAAARFIAERKS

SEQ ID NO: 66097 - protein, 176 aa, Aegilops tauschii
FGKVYKGVLSGSTPIAVKRLDGARQGEKQFRAEVSSLGLIQHINLVKLIGFCCEGHNRLLVYEHMLNGSLDGHLFKSNFGVLSWSTRYQIALGVARGLFYLHQSCHKCIIHCDIKPENILLDASFAPKVADFGLATFLGRNFSRILTTFRGTVGYLAPEWLSGVAVTPKIDVYSFG

SEQ ID NO: 66098 - protein, 386 aa, Klebsiella pneumoniae subsp. pneumoniae MGH 78578
MNNNPLIPESKLPALGTTIFTQMSALAQQHQAINLSQGFPDFDGPRYLQERLAYHVAQGANQYAPMTGVPALREAIAGKTAELYGYQPDVNSEITVTAGATEALYAAITALVRRGDEVICFDPSYDSYAPAVALAGGELRRIALQPPHFRVDWRQFAAALSEKTRLVILNTPHNPSATVWQREDFAALWQAIAEREIYVLSDEVYEHICFAEGGHASVLAHPQLRERAVAVSSFGKTFHMTGWKVGYCVAPTAISAELRKVHQYLTFSVNTPAQLAIADMLREAPEHYRELPAFYRERRDLFIEALRPSRLEILPCEGTYFLLADYSAISDLDDVSFCRWLTTQIGVAAIPLSVFCADPFPHKLIRLCFAKQPATLLAAAARLCQL

SEQ ID NO: 66099 - protein, 108 aa, Oryza sativa
KTDDQVRAEGTPEELVPHKRFLGNRPTTSILVGGAIGPAELGTLIVYYEHLTFTEGAIWDINSFDQWGVELGKVLAKKILKELDEAGNGEGHDASTGGLIGAFKKYGN

SEQ ID NO: 66100 - protein, 356 aa, Cryptococcus neoformans var. neoformans B-3501A
MPRPPEDPDVRNSKTLAYILRHGAEKEGLYIRSDGFIKLADVLARPKLKGVDEPTILHLVQTNAKKRFELFWGYDPSPPRPKKKPTQGKTKKQLQRDRETAAAAAASAAVAASGTGEGQEKGKEPDAATIDIIASSLASTNLTAPSSSLSINSTAPAPAQSSTSVDPPELPLISLPDPHTSASDSDANAKASASANSDNPKGEYFIRATQGHSIQLESTAHLEQVKDDEEGKRKVGLMVHGTRWELWDTLKEQGLQKMTRQHIHLAPGFSGPITPRPNSTLYIYLDLSKLVAAGIPVYVSANGVVLTPGSKGGENGEGAGVGKEFWRRAVRRKEGKRWVVWEDGREVEREELSGEE

SEQ ID NO: 66101 - protein, 355 aa, Burkholderia xenovorans LB400
MKIAVLPGDGIGPEIVKEAVKVLNVLGEKFELEEAPVGGAGYEAKGHPLPDSTLALAKEADAILFGAVGDWKYDSLERALRPEQAILGLRKHLQLFANFRPAICYPQLTGASSLKEEIVSGLDILIVRELNGDIYFGSPRGVREAPDGLFAGSKEGFDTMRYSEPEVRRIAHVAFQAAQKRGKKLTSVDKANVLETSQFWKDVMIDVSKEYADVELSHMYVDNAAMQLVKAPKSFDVIVTGNMFGDILSDEAAMLTGSIGMLPSASLDKNNKGLYEPSHGSAPDIAGKGVANPLATILSAAMMLRYSLNKAEQADRIENAVKKVLEQGYRTGDIVTPGCKQVGTVAMGDAVVAAL

SEQ ID NO: 66102 - protein, 439 aa, Neurospora crassa
MVCLQGQNWEKYRKTFGDDEVEEKKITPLSDEDIQVLKTYGAAPYGAAIKKLEQQIKEKQQSVDEKIGVKESDTGLAPPHLWDVAADRQRMSEEQPLQVARCTKIIPDEKDESKSKYVINVKQIAKFVVQLGERVSPTDIEEGMRVGVDRNKYQILLPLPPKIDASVTMMTVEEKPDVTYGDVGGCKEQVEKLREVVEMPLLSPERFVNLGIDPPKGALLYGPPGTGKTLCARAVANRTDATFIRVIGSELVQKYVGEGARMVRELFEMARTKKACIIFFDEIDAIGGARFDDGAGGDNEVQRTMLELITQLDGFDARGNIKVMFATNRPSTLDPALMRPGRIDRKIEFSLPDLEGRANILRIHAKSMSVERDIRWELISRLCPNATGAELRSVCTEAGMFAIRARRKVASEKDFLSAVDKVIKGNLKFNSTAAYAQYN

SEQ ID NO: 66103 - protein, 479 aa, Oryza sativa
  misc_feature (175)..(175): Xaa can be any naturally occurring amino acid
MSVQEYLEKHLLSRKIEEAVNAAVRAKAPDPVLFISNHMRRAAPAVITSVRARQILDGRGEPAVEVSLHTNKAVHRASAAAADAPEGAAADAVRDAEKRKLLARAVADAVRVINDKVSEALVGMDPQQQSQIDQAIMDLDKAHHKAEIGVNSMLAVSIAACKAGAAEKEVPLYKXHIAELVGKSATTLPIPAITVINGGTHAGNSLPIQEIMILPVGAKNFEEAMQMGSETYHHLKDIILEKYGSNSCNIGDDGGFAPNISSITEGLDLVIEAINRAGYNGRIKLAIDVAATDFCMGNKYDMEFKFAEKSGQGFKTADDLIEIYSQLCSEYPLVSIEQPFDKDDWEHSKKFTTLELCQVVGDDLLMSDPERIKRAVNEYTCNALVLKANQVGTVTEAIEVVRQAKDAHWGVMVSHRSGDTDDSFIADLAVGAAAGQIKAGAPCRGECLSKYNQLLRIEEELGSDGVYAGENWRTTASTS

SEQ ID NO: 66104 - protein, 120 aa, Chlamydomonas reinhardtii
SGKKAVSRSAKAGLQFPVGRIARYLKKGKYAERIGAGAPVYLAAVLEYLTAEVLELAGNAARDNKKNRIVPRHIQLAIRNDEELGKLLGEVTIASGGVLPNIHAVLLPKKTKGGKGEETA

SEQ ID NO: 66105 - protein, 303 aa, Streptococcus agalactiae 2603V/R
MSNIVIIGSISMDLVMETNRIAKEGETVFGQRFSMVPGGKGANQAVAIGRLSQERDNITILGAIGEDSFGPILLDNLNKNHVTTDFVGTIPSSSGVAQITLYNNDNRIIYCPGANGKVDTKKWSQEWSIIKEADLVVLQNEIPHQANMKIANFCKEHSIKLLYNPAPSRETDIEMLDKVDYFTPNEHECQELFPNQKLEDILATYPEKLIVTLGTKGAIYSDGKESHLIPALETKAVDTTGAGDTFNGAFGYAISKKFKIAKALRFATLAAHLSVQKFGAQGGMPTIKEMEDNQHYEKDWYIK

SEQ ID NO: 66106 - protein, 303 aa, Candida glabrata CBS 138
MTLLSDNAKQEIAKNIELIDDSCLNCDCQNEEGLDEIQSGEKVFDKLVIDHETELFNSSKIPKVHFIVPTSQMDWQFDACMEKPNSVQYKISTWCSENTERLSAITGCGGVSMNCNVTSMPLNILDIEAMRGTKNNVLVLPFGIWIQDLRSDNVEAILDELVPAILDPKTDIKQLIASKEYLYESHKKAFIFICSHKTRDKRCGITAPILKKIFDRELQNHGLFRDNSDLRGDGVNVSYINHVGGHKFAANVQIYLKDQHTLVWFGRITPKDIPHIVNHLIVPDHGKLPFPEKIRCVKKYDSW

SEQ ID NO: 66107 - protein, 403 aa, Picea sitchensis
MGNWQEIANSVFLAIVFAFMVAKLISIVVSFRDDNLRVERDHYTPAAVEDDVGFRTPDPPAPDVQDRGVPSSEREELAGVSSENEELLDQVEFTEKNEDKTLEIAESETEVKVEEEVTGSGYAVKEIDVKGKETEGFGGSLLSDEDEWEGVESTELDEMFGVAASYVASMEANLSQKIPNEAQMELYGLYKVATEGSCNIPQPSPLKITARAKWHAWQRLGNMNPEAAMEQYIGLLNKIFPSWNESLLEKNRTKDPDSSQLSASSGGMTSVFSSFMHQEGSDDEAKLEMIHSYAREADTAGLLQAIEQGVPVDLRDSQGRTPLHWAVDRGHMEVVEHLLSKGADVNAKDMEGQTALHYATVCEREGIAKYLIKHGADPSSKDNDGVTPYNLCPKDWDWLSENA

SEQ ID NO: 66108 - protein, 315 aa, Salmonella typhimurium LT2
MNITIATLGELLVEFLAKKENQGFSSPGEFWGPYPSGAPAIFADQVAKLGFRSLLFSCVGNDAFGVMNITRLSRDGVNVQGISVLPNATTGSAFVSYRSQAQRDFIFNMPDSACGLLSADHLDETLLRQYRHFHIMGSSLFSFRLIDAVRKAISIVKENGGTISFDPNIRKEMLKIREMSQAFEYILDYTDFFLPSDGELDYFGLSKSRDEEKIVARLHKRGIAHVIIKRGARGASYYSKDEQHHVAGYPVKVVDPTGAGDCFGATFVSLFLAGYSVPDALAHANAAGSLAISARGPMEGTSTLAQIKELMRQQN

SEQ ID NO: 66109 - protein, 214 aa, Brassica napus
MSEEVKENQSGKLQKPTPRLNERILSSLSKRSVAAHPWHDLEIGPGAPVIFNVVVEISKGSKVKYELDKKTGLIKVDRILYSSVVYPHNYGFIPRTLCEDNDPLDVLVIMQEPVLPGCFLRARAIGLMPMIDQGEKDDKIIAVCVDDPEYKHYTDIKELPPHRLTEIRRFFEDYKKNENKEVAVNDFLPNGPAVEAIQYSMDLYAEYILHTLRR

SEQ ID NO: 66110 - protein, 486 aa, Oryza sativa Indica Group
MAASSSSLLLRRGATGGAGRRGGPGEALRRLVSSSEAAPAEKVPARSPPVMPPFEHRPRPYAGWSGDEILAKRKQFLGSSVFYYYQKPLNIVEGKMQYLYDENGKRYLDCFGGIVTVSCGHCHPDIVNAVVEQTKLLQHTTTIYLNQPIVEFAEALASKMPGNLKVVYFVNSGTEANELAMLMARLYSGNLNMIALRNAYHGGSAGTIGLTGLQTWKYPIPQGEIHHVMNPDPYRGTFGSDAIAYAKEVEEQINYGTSGRVAGFIAETFQGVGGAVELAPGYLKLAYDTVRKAGGVCIADEVQSGFGRTGSHYWGFQTQDVIPDIVTMAKGIGNGLPLGAVVTTPEIANVLAQKIQFNTFGGNPVCSVGGLAVLKVLDKEKRQAHCADVGSHLVNRLKELQQKHEIIGDVRGRGLMLGVELVTDRKEKTPAKAETNLLFEKLKDLNILVGKGGLHGNVFRIKPPMCFTRDDADYLVDAMDYAMSGL

SEQ ID NO: 66111 - protein, 546 aa, Desulfococcus oleovorans Hxd3
MRTSRLTDLDLWKQLKAHAEKMALPENHLKHLTMAPERLAEFSIQALDMVYDFSRQRVDRQAIDLLMELAWERKVTQRFQAMTTGAVVNTTENRAALHTACRDFSKAKRVVNKIDVTAEMARVRKEIREFSEAVHAGQITGATGKPFAHVVVVGIGGSYLGTEFVARALAAYADKGICLHFLANVDIHNFGEIAEAIDPETTLWVIVSKSFTTAETMANANQAAAFMKEQGLDPARHFVSVTSKGSPGDQTGQDAPFPVLRSFHMFDFIGGRYSVTSAVGGVPLSLYLGYDRFETFLKGAHQMDVHAATAPPTTNMPLTAALLGIWNNNFLEYPAQAIIPYASPLARLAPHVQQLYMESNGKSVTAEGKPLGVRSGVIIFGEPGTNAQHSFFQLAHQGAPFPIDFIGVIKPQYDAFQALSRGVTNHQELWANLISQPRALAEGKESEDGHRSFSGNRPSSTILLEDLSPASVGKLLAFYEARTVYEAFVWGINPFDQYGVELGKKLASEIRSQMAAKNRDAGHTFENVDSISRFYLEKLMGKGNDE

SEQ ID NO: 66112 - protein, 70 aa, Kluyveromyces lactis NRRL Y-1140
MIVPVRCFSCGKVVGDKWEAYLNMLQEEELEEGTALTRLGLKRYCCRRMILTHVDLIEKFLRYNPLEKRD

SEQ ID NO: 66113 - protein, 386 aa, Thermotoga maritima
MSLDALELHRFLKGKIRTALPVEKVDRETLSLLYTPGVADVARACAEDPEKTYVYTSRWNTVAVVSDGSAVLGLGNIGPYGALPVMEGKAFLFKAFADIDAFPICLSESEEEKIISIVKSLEPSFGGINLEDIGAPKCFRILQRLSEEMNIPVFHDDQQGTAVVVSAAFLNALKLTEKKIEEVKVVVNGIGAAGYNIVKFLLDLGVKNVVAVDRKGILNENDPETCLNEYHLEIARITNPERLSGDLETALEGADFFIGVSRGNILKPEWIKKMSRKPVIFALANPVPEIDPELAREAGAFIVATGRSDHPNQVNNLLAFPGIMKGAVEKRSKITKNMLLSAVEAIARSCEPEPERIIPEAFDMKVHLNVYTAVKGSAEGHHHHHH

SEQ ID NO: 66114 - protein, 483 aa, Lactobacillus plantarum WCFS1
MAEKQHQEVHRSLQTRHLSMIALGGSIGTGLFVASGSAISTAGPGGALLAYVGIGVMVYFLMTSLGEMATYLPVSGSFSTYATKFVDPALGFAMGWNYWFNWAITLAVDISTAAIVMQFWLPSVPGWVFSLIALVLIFTINALSVRSFGETEYWLSLIKVVTVLVFLVIGVLTIVGIMGGHATGLSNFTYKKAPFVGGIPTILSVFVVAGFSFQGTELIGITAGESATPEKSIPAAIKQVFWRILLFYILAIFVIAAIIPYTSKDLLGSSASDIAISPFTLVFKRAGLAAAASVMNAVILTSVLSAANSGMYASTRMLYSLSLQGYAPKTFGRVNRRGIPIMALLGTTVIGLLTFLSSLFGERIYIFLVSASGLTGFIAWLGIAISHLRFRRAFVKQGHQLSELRYHAKWFPFGPWFAFILCVVVIIGQDLHSFATLDWQAIGVTYMSIPLFIILYVYYKIRYHTKMIPLDKVDLTRKRHHQD

SEQ ID NO: 66115 - protein, 449 aa, Bacillus cereus G9241
MKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPEIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKKEIYEEFKGKGEYEFFRHINTFGGNPAACALALKNLEIMENENLIERSAQMGSLLLEQLKEEIGEHPLVGNIRGKGLLVGIELVNDKETKEPIDNDKIASVLNACKEKGLIIGRNGMTTAGYNNVLTLAPPLIISSEEIAFVVGTLKTAMERI

SEQ ID NO: 66116 - protein, 387 aa, Bacillus cereus G9241
MEFEFFFQIALILLSTKLAGDLSVRLGQPSVLGKLIVGIVIGPAVLGWIENSELLTQLSNVGVILLMFMAGLETDLDELNANRNSSLAVALGGIILPFVGGYVSGLVMGMEQGNAVFLGLLLCATSVSISVQTLRDLGKMKTRESTTMLGAAVFDDILVVILLAFAMSFLGTDDVNLTMVILKKVVFFASIILIGWKGVPAIMRWLSPLRVSESIVSAALIICFSFAYFGERLGIAGIIGAFAAGIAISQTNYKHEVEKKVEPIAYAMFVPVFFVSIGMNITFDGIGNQIWFILALTVIAVLTKLIGCGFGARMTGFDAKSSAIIGAGMVSRGEVALIIAGTGLSSGLLAQDYFTAIVIVVILTTMITPPMLKYTFGAKDKAMKASK

SEQ ID NO: 66117 - protein, 418 aa, Mycobacterium sp. KMS
MGALPVIEHTRSHVAKWMRRTTLLRPARLAGLRAEVEPVPVGVVGIVGPWNFPVNLVVLPAAAAFAAGNRVMIKMSEITAHTAELLEARAPEYFDAAELTVVTGGPDTAAAFTALPFDHLFFTGSPAVGVHVQRAAAANLVPVTLELGGKNPAVVGPRADLRRAAVRIAQGRMVNGGQVCVCPDYVLVPEYLVDEFSATVLATWRRMFPSITGSEDYCSSVNDANFDRVVGLIDDARAGGARVNSVVPPGETLPDRRSRKIAPTLIRDVTPTMRIASEEVFGPVLSVLGYSTTDEVIDHINSRPAPLVAYWFGPDDQDFRTFVRRTRSGGVARNDFAAQMIPSDAPFGGVGRSGMGAYHGKAGFDTFSHHRSVVGSDLPFSITGSAAPPFGAAMRRSTEFRLRMARRRNHRRLRRSHG

SEQ ID NO: 66118 - protein, 412 aa, Moritella sp. PE36
MNLCIESIRQAFPALQQQVNGEPVYFFDGPGGSQVPQSVLDAMTAYLSKYNSNLGGRFFSSEKTVDVMRNARLSGQALLNTESPDNIVFGANMTSLTFQLSRAISRDWQAGDEVIVTSLDHYSNVSTWQQAADDKGAVVHQARVNEVDCTLDSEHLISLISNKTKLVALTFASNTTGSLVDVKPIIEAAHAVGAKVYIDAVHYAPHKLVDVQALGCDFLACSAYKFFGPHVGIAYVAPKWLHTLSPYKVEPATNQGPGRFETGTQSFEALAGFSAAVEYLAHAGDQVLPLRERLVQSFELYQTHEQKLSQHFLAKLAQYSNVTLYGIDDMDRLAERTPTFSIRIDHASPEDVSGLLGQHNMCVWNGHFYAIGLCKQLGILDKGGVIRIGFMHYNTTSEIDALFDVLSAVLVK

SEQ ID NO: 66119 - protein, 231 aa, Stevia rebaudiana
MATSSSCYTSPIPTGIFPKQQSTLLPSTSFLTCFNRRSPISLRPVSRPVVVAASANAVEVEKPAVTGTPSKILPFRVGHGFDLHRLEPGYPLIIGGINIPHERGCEAHSDGDVLLHCVVDAILGALGLPDIGQIFPDNDPKWKGAASSVFIKEAVRLMHEAGYELGNLDATLILQRPKLSPHKEAIRDNLSLLLGADPSVVNLKAKTHEKVDSLGENRSIAAHTVVLLMKK

SEQ ID NO: 66120 - protein, 187 aa, Klebsiella pneumoniae subsp. pneumoniae MGH 78578
MSLINTKIKPFKNQAFKNGEFIEVTEKDTEGRWSVFFFYPADFTFVCPTELGDVADHYEELQKLGVDVYSVSTDTHFTHKAWHSSSETIAKIKYAMIGDPTGALTRNFDNMREDEGLADRATFVVDPQGIIQAIEVTAEGIGRDASDLLRKIKAAQYVASHPGEVCPAKWKEGEATLAPSLDLVGKI

SEQ ID NO: 66121 - protein, 254 aa, Oryza sativa
PLVPLPPPTFSAFQPPRALPRPPPMASAAAPTTSSLSLAARRAAAVGPAAASPLRRGGLAAGCQPARSLAFAAAADPRLATHVASRCRQAASSSARGTRAVATMAKKSVWDLTAADLDGKRVFVRGELNVPLDDNQNITDDTRVRAAIPTIQYLIKNGAQVVLSKHLGRPKGGTPKVNLAPPVPGLGGPFRHTRELKGKNCIWKKKVNKLGNPNWSKRGKGFCPCEKGKNFYKGKKKKKRTPKIFGAKKVLPPL

SEQ ID NO: 66122 - protein, 416 aa, Thermoanaerobacter tengcongensis MB4
MSTESLNPLVIAQKQIKKACDILGVEESVYELLKEPMRVLEVSIPVQMDDGSIKVFKGYRSQHNDALGPTKGGIRFHPDVTLDEVKALSMWMTFKCGVVGLPYGGAKGGVVVNPKELSNDELQRLSRGYIRAIASIIGPEKDIPAPDVGTNAQIMAWMVDEYNKIVGYNSPAVITGKPLIYGGSKGRVAATGYGVALMAREAVKRLNMDFKDCTVAIQGFGNVGSHAGLSLQRLGAKIIAVSDVYGGIYNEKGIDAEKLVEHVNKTGTVCNFEGTTPITNEELLTMKVDILVLAALENQITSANANEVKAKIICEGANGPTTPEADKILSEKGVFVVPDILANSGGVIVSYFEWVQNLMNYYWTEKEVEERQEIMMVNAFNSIYDLAQQYKVDMRTAAYMISIKRVYEAMKVRGWL

SEQ ID NO: 66123 - protein, 309 aa, Synechococcus sp. RS9917
MGWSAADIPDQRGRLALVTGANSGLGLETTRALLAHGATVLMACRNRERGETARRSLSDQSASKGGSIELLDLDLADLESVDRCAQTVRQRFGRLDLLINNAGVMAPPRQCSRQGYELQFATNHLSHMALTRALLPLMEGQPDARVVTVTSGAQYFGRIAWEDPNGEQRYDRWQAYGQSKLANVMFALELDRKLRDRGSSIRSLAAHPGLARTNLQPASVSANGSRLEALAYRLMDPLFQSAAMGALPQLHAATAASAQSGEHYGPNRLGGLRGYPKRQRVAPAAEDPQQRERLWDLSLKLIEAGPALR

SEQ ID NO: 66124 - protein, 401 aa, Cryptococcus neoformans var. neoformans B-3501A
MSTSTRRHVPDDKLANHKADPNAAANAGQVQERTTKGSSSSAPRKVRFNVGNNYHVVDVIGEGAYGVVASAVHRPSGTKVAIKKIAPFDHSMFALRTLRELKLLKYFAEEGVSENIISVLDIIKPPSYDTFKEVYLVQELLETDLHRVIRTQDLSDDHCQYFLYQTCRALKALHSAEIIHRDLKPSNLLLNANCDLKVCDFGLARSTQTAFPAEGNNQGFMTEYVATRWYRAPEVMLSFRMYTKSIDVWSVGCILAEMLSGKPLFPGKDYHNQLALILDVLGTPTIDEFHAITSKRSKDYIRSLPFRKKRTFESIYPSANPLAIDFLRKTLTFDPRKRYTVEQCLAHPYLDAYHDPEDEPSAKPLPPSFFEFDMMKDDISREELKRLLYEEIMGFRPVLEG

SEQ ID NO: 66125 - protein, 313 aa, Arabidopsis thaliana
MDEGVIAVSAMDAFEKLEKVGEGTYGKVYRAREKATGKIVALKKTRLHEDEEGVPSTTLREISILRMLARDPHVVRLMDVKQGLSKEGKTVLYLVFEYMDTDVKKFIRSFRSTGKNIPTQTIKSLMYQLCKGMAFCHGHGILHRDLKPHNLLMDPKTMRLKIADLGLARAFTLPMKKYTHEILTLWYRAPEVLLGATHYSTAVDMWSVGCIFAELVTNQAIFQGDSELQQLLHIFKLFGTPNEEMWPGVSTLKNWHEYPQWKPSTLSSAVPNLDEAGVDLLSKMLQYEPAKRISAKMAMEHPYFDDLPEKSSL

SEQ ID NO: 66126 - protein, 206 aa, Thermoanaerobacter tengcongensis MB4
MVTRLYIARHGQSKWNLESRMQGMKDIELTQLGLEQAELLAKRLKGENIDCIYSSDLKRAYTTAEIISKEINAPIVKIEEFREMSFGVWEGLTAKEIEENYQELYDLWKTDPRHVLIENAETLKEVQKRMLTKTKEIVEENWGKNILIVSHGTSIKALILGLLEIDLSFYPSFRMDNASLSIIDIKENKKAVLVLYNDTCHLGERK

SEQ ID NO: 66127 - protein, 69 aa, Arabidopsis thaliana
  misc_feature (26)..(26): Xaa can be any naturally occurring amino acid
STKYPNIFGGLLTAGIVAFSRSATIXTRAGKGYNSSTCYMVALRQDRKFSTLAPFGGFAFIAAWATLLF

SEQ ID NO: 66128 - protein, 572 aa, Glycine max
MEAGRKSVSLRREFCKYGSTIGFDHHSTRSFDVEVGGSRNHHLSRSGVERFHVEKEEGEIYVEHELASVVPPPEKKRKFSPIIWDLAVKEERVSSKSRISQIAALSPPRPSLPSSPGAYVVDCGNVMEEFLPDSRSYKQDVEEENDVQGWTIKKSRWDCDDVPSPRGADEKQKHGKVSSSPEIGGGSSESTITRSSGSNGRDHYSGASSDDTDSEKDFLLDSMVDVEEQSDDDYSLSDSDETGGLMHGQRNINMLQSCRSVCEFEMIKKINEGTYGVVYKARDKKTGELVALKKVKMNIERDGFPMSSLREINILLSFNHPSIVNVKEVVVDDFDGTFMVMEHMEYDLKGLMEVKKHPFSMSEIKSLVRQLLEGVKYLHDNWVIHRDLKSSNILLNHDGELKICDFGLSRQYGSPLKPYTPVVVTLWYRAPELLLGAKEYSTSIDMWSVGCIMAELIVKEPLFRGKSELEQLDKIFRTLGTPDEKIWPGLSKLPGAKANFVKQPINTLRKKFPAASFTGLPVLSELGFDLLKRLLTYDPEKRITAEDALLHDWFHEAPLPKSDFKPIFPSWQ

SEQ ID NO: 66129 - protein, 499 aa, Escherichia coli
MTEPHVAVLSQVQQFLDRQHGLYIDGRPGPAQSEKRLAIFDPATGQEIASTADANEADVDNAVMSAWRAFVSRRWAGRLPAERERILLRFADLVEQHSEELAQLETLEQGKSIAISRAFEVGCTLNWMRYTAGLTTKIAGKTLDLSIPLPQGARYQAWTRKEPVGVVAGIVPWNFPLMIGMWKVMPALAAGCSIVIKPSETTPLTMLRVAELASEAGIPDGVFNVVTGSGAVCGAALTSHPHVAKISFTGSTATGKGIARTAADRLTRVTLELGGKNPAIVLKDADPQWVIEGLMTGSFLNQGQVCAASSRIYIEAPLFDTLVSGFEQAVKSLQVGPGMSPVAQINPLVSRAHCDKVCSFLDDAQAQQAELIRGSNGPAGEGYYVAPTLVVNPDAKLRLTREEVFGPVVNLVRVADGEEALQLANDTEYGLTASVWTQNLSQALEYSDRLQAGTVWVNSHTLIDANLPFGGMKQSGTGRDFGPDWLDGWCETKSVCVRY

SEQ ID NO: 66130 - protein, 287 aa, Oryza sativa Japonica Group
MAERGGERGGERGGFGRGFGRGGRGDRGGRRGGRRGPRQEEEKWVPVTKLGRLVKEGRFSKIEEIYLHSLPVKEHQIVETLVPGLKDEVMKITPVQKQTRAGQRTRFKASQTRAGQRTRFKAFVVVGDNNGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPDFWRDTKFVKSPFQEYTDLLAKPTKALMIDAPVENVEA

SEQ ID NO: 66131 - protein, 360 aa, Pseudomonas syringae pv. phaseolicola 1448A
MSKQILILPGDGIGPEIMTEAVKVLELANEKYQLGFELTHDVIGGAAIDKHGVPLADETLDRARAADAVLLGAVGGPKWDTIERDIRPERGLLKIRSQLGLFGNLRPAILYPQLADASSLKPEIVAGLDILIVRELTGGIYFGAPRGTRVLDNGERQAYDTLPYSESEIRRIAKVGFDMAMVRGKKLCSVDKANVLASSQLWREIVEQVAKDYPEVELSHMYVDNAAMQLVRAPKQFDVIVTDNLFGDILSDQASMLTGSIGMLPSASLDTANKGMYEPCHGSAPDIAGKGIANPLATILSVSMMLRYSFNLTDAADAIEKAVSVVLDQGIRTGDIWSEGKVKVGTQEMGDAVVAALRNL

SEQ ID NO: 66132 - protein, 111 aa, Oryza sativa
MSLSNKLSITDVDVKGKRVLIRVDFNVPLDADKNITNNQRIVGALPTIKYALENGAKSVILMSHLGRPNGSPNEKYSLKPVVPELEKLLGKKVTFAPDCVGPEVEEIVNKA

SEQ ID NO: 66133 - protein, 515 aa, Oryza sativa Indica Group
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDAQIASGGGRILSLKNAQNDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 66134 - protein, 444 aa, Bordetella parapertussis 12822
MRQYHYITEMMRVALQDLSTLRIKGRVVQVVGTIIKAVVPMVKIGEVCLLRNPGEDFEMHGEVVGFVRDAALLTPIGDMYGISSATEVIPTGRTHMVPVGPGLLGRVLDGLGRPLDVAESGPLHAHKFYPVFADAPDPLTRRIIHAPLELGVRVLDGLLTCGEGQRLGIFAAAGGGKSTLLGMLVKGAAVDVTVVALIGERGREVREFLEHELGPEGRRKSVIVCATSDKSSMERAKAAYVATAIAEYFRDQGQRVLFLMDSVTRFARAQREIGLAAGEPPTRRGYPPSVFATLPKLMERAGMNQTGSITALYTVLVEGDDMNEPVADETRSILDGHIVLSRKLGAANHYPAVDVLASASRVMNAVVSPRHKYLAGRMRELMAKYQDVELLVKIGEHKQGADASTDEAIQKIGQINAFLRQLTDEREAFEDTVLRMAEIIGPES

SEQ ID NO: 66135 - protein, 306 aa, Moorella thermoacetica ATCC 39073
MKIARDVTQLIGQTPILRLNRLVEDGMEVYLKIEFFNPGGSVKDRIALSMITAAEADGRLKPGDTIVEPTSGNTGIGLAMVAAVRGYRLILVMPETMSIERRKLLAAYGAEFVLTPGNLGMKGAVDKANELVRENPGYFMPQQFENPANPAIHRQTTAREILEQMDGKVDAFVAGVGTGGTLTGVGEVLKKEIPGVRIVAVEPAASPVLSGGQPGPHKIQGIGAGFVPPVLRREVVDEIITVTNEDAMETARRLAREEGLLVGISSGAAAFAALQVARRLGRGKRVLAIAPDTGERYLSTELFKIG

SEQ ID NO: 66136 - protein, 509 aa, Oryza sativa Indica Group
  misc_feature (361)..(361): Xaa can be any naturally occurring amino acid
MTKISVEFCIISARGLGRRSTLLNPQWFSVAWIDPNSKYCTKIDASGNSDVNWGTKFSLSVDEHDMSMQQMELTVEVYRREPVFLREHLQGTAVIQMKEYFDKFSQGKDPSGVTEETSSFQLRRKKSDKPHGFVDISIRICKEENNRATFSGSQEGLKYPDQVGITLAIEDGPVYNYPPMPSSHFKGYTQDVDHYSNSMPVTAATRPGQSPPGSNYSYQPTMVPPILPHPTSNPSFFTPQYPTRGPVPQTYINVPPRMGGQNSTPNFGMGLGAGALAAGTMIFGENLLSGKYLASHSLSSDTKNIDCETVKFGHVTFFWNGNRSGYFDETKEEYVEIPSDIGITFNVKPNMKALEIAEKAXDAILSGKFDQVRVNLPNGDMVGHTGDIEATVVACKAADEAVKIILDAIEQVGGIYLVTADHGNAEDMVKRNQSGQPLLDKNGGIQILTSHTLQPVPVAIGGPGLHPGVKFRSDIQTPGLANVAATVMNFHGFEAPADYEPTLIEVVDN

SEQ ID NO: 66137 - protein, 224 aa, Desulfitobacterium hafniense DCB-2
MIKIAPSILSADFAHLGDQVALVEKAGAEVLHIDVMDGHFVPNITIGPLVVKALRPYSQMRFDVHLMIEHPERFIEEFAKAGADHITVHLEATPHIHRAIQQIKGLGLTAGVSINPATPLDGIKYILDELDMVLIMSVNPGFGGQKFIPAVLPKIEVLHRHLDQMQSSCEIEVDGGINLDTAPAVVKAGANILVAGAAVFACADPARAVQELREAAQGYKGDPK

SEQ ID NO: 66138 - protein, 611 aa, Arabidopsis thaliana
MIERQSVNRRNKDMVKIHTPVVRKVSPPYKVSHFSVALSNKCSKYLFTENLFSHVMDYLSSMGSQTARFCHNYTVLYIDNNNNSVTLGLSRQDFSGPFCSASFSSTLLSSGLFQNLPSYKSLTVFYACDPRRHFLGNFTCPVKGLGSIIQNSTYGILCDGSFSVPVPTSFVSEEEVLDLTHLESVLRKGFEVKLNIDEIPCPLECFSSRANCLFLAGSCCKYHDRTTTCGGDTGDLLREIIPNTRSILITIGQVVGFHVFIIVVMIIAFLFWRRKKVNDLRKQNLEALVTSRRYSYRQIKKITKSFTEVVGRGGFGTVYKGNLRDGRKVAVKILKDSNGNCEDFINEVASISQTSHVNIVSLLGFCFEKSKRAIVYEFLENGSLDQSSNLDVSTLYGIALGVARGIEYLHFGCKKRIVHFDIKPQNVLLDENLKPKVADFGLAKLCEKQESILSLLDTRGTIGYIAPELFSRVYGNVSHKSDVYSYGMLVLEMTGARNKERVQNADSNNSSAYFPDWIFKDLENGDYVKLLADGLTREEEDIAKKMILVGLWCIQFRPSDRPSMNKVVGMMEGNLDSLDPPPKPLLHMPMQNNNAESSQPSEEDSSIYSEV

SEQ ID NO: 66139 - protein, 492 aa, Pseudomonas putida KT2440
MAVFASDSFGQLKVEKIMTAQWNHYINGEYVSPESEEYIHEFIPTTALPGDSIARGSAADVDKAVRAAAAAQPAWNARKPIERGRILLAIARLVRANAAAFCAKEAEETGKPLKMAAFEIEACAQYFEYYGGLATAIQGETINLGPSYHAYTTREPFGVVGVILPWNSPLNQAGRAIAPALVSGNTVVVKPSEFTSVTMLQFAELVVKEAGLPPGVLNVVTGTGKETGEPLVKHPLIRKVAFTGSVRAGREIGKLAADRIIPLSLELGGKSPNIVFEDADLDRAVAGSVFAFTVNTGQVCLAGTRCLVHESIFEKFSKKLAGAVEALQFSDGESFGLGPLTTKAQFEQVHRYNELAIQEGAHCLVGGEAPSDKTGWYVRPTVYTNVNNSMRIAREEIFGPVLVLIPFKDENEAVAIANDSDYGLAAGVWTTDLARAHRVSAQIEAGQVYVNEYPSGGVETPFGGFKQSGHGREKGIEALHHYTQTKTTIIRI

SEQ ID NO: 66140 - protein, 474 aa, Escherichia coli
MSSPLIPVILSGGNGTRLWPLSREEYPKQFLKLTDSISMLQSTISRLDSLNTSSPVVICNELHRFIVAEQLRHLNKLDNNIILEPSGRNTAPAICIAALILKMKHPNENPLMLVLPADHSVKKVKTFCNTIKSAIPFAEAGNLVSFGIKPTHPETGYGYIQKGKVLSDSDIYEVSEVRTFVEKPNLKTAESFIEKDEYYWNSGMYLFSVERYLQELSLYRPDIVKVCQETVKNIHYDMDFIRLDDKIFRNCPQESIDYAVMEKTKDAVVATMDIGWNDVGAWSSLWELGKKDSSGNVITGDIVCHETENSYIYTESGLVATIGIQDLVIIHTKDSLLVSRRDSVQNVKNIVQHLDLSGRKEHKEHREVFKSWGRCDSIDSSEKYHYQVKRITVNPSEKLSLQLHHHRAEHWVVVMGIAKLTVAEEIKILKENESVYIPAGIKHSLENIGTIPLVLIEVWTGSYLADDDILRFED

SEQ ID NO: 66141 - protein, 243 aa, Prochlorococcus marinus str. MIT 9303
MRKPVIAGNWKMHMTCAQAREYTAMFLPLIEATPNDRHVVIAPPFTAISSMAEAVGGTRLELSSQNVHWEDDGAYTAEVSPTMLLEHQVRYAIVGHSEPRKYFSESDEQINRRARSAQAHGLIPIVCVGESDEQRERGEAERVIRRQVEQGLEDTDPDKLVVAYEPIWAIGTGKTCEASEANRICGLIRGWVGASELIIQYGGSVKPGNIDELMAMSDIDGVLVGGASLDPESFARIANYQTS

SEQ ID NO: 66142 - protein, 469 aa, Corynebacterium efficiens
MTEHYDVVVLGAGPGGYVSAIRAAQLGKKVAVIEKQYWGGVCLNVGCIPSKALIKNAEIAHIFNHEKKTFGINGEVTFNYEDAHKRSRGVSDKIVGGVHYLMKKNKITEIDGFGTFKDAKTIEVTDGKDAGKTVTFDDCIIATGSVVNSLRGVEFSENVVSYEEQILNPVAPKKMVIVGGGAIGMEFAYVLGNYGVDVTLIEFMDRVLPNEDPEVSKVIAKAYKKMGIKLLPGHATTAVRDNGDSVEVDYQKKGSDKTETITVDRVLISVGFRPRVEGFGLENTGVKLTERGAIDIDEHMRTNVDGIYAIGDVTAKLQLAHVAEAQGIVAAETLAGAETQTLGDYMMMPRATFCNPQVASFGYTEEQAKEKWPDREIKVSSFPFSANGKAVGLAETDGFAKIVADAEFGELLGGHIVGANASELLNELVLAQNWDLTTEEISRSVHIHPTLSEAVKEAAHGVNGHMINF

SEQ ID NO: 66143 - protein, 500 aa, Oryza sativa Indica Group
MDQLTSSTVFWLTTAVAFLLINTVILRALQKRKSSPAAAAAAPPPPVVQGVGLVRFVRAMARDGPLEAIREQQAKLGSVFTASAPLGTFLIGSEVSSHFYVAPDSEISMGRLYEFTVPIFGPGVLYGVDLETRKEQIRFNWDILKPRSLKASVGAMAEEVEMGRSGYGRSEARTGAGTDADRESVPAGKGVARESVPGKLCELFGELDNGLHLISGLLPYLPIPAHRRRDRARQRLGEIITEVIRSRRNSSRGAAGTDENNDDMLQCLINSRYKDGCAMTDAETAGLVVALMFAGKHTSSGVSIWTGVHLLSNPNHLAAVVAEQDRLMASCPGRTDDYHRLDYDTVQEMRSLHCCVKEALRLHPPVAAVSQAYKHFTVQTKEGKEYTIPGGHMVVSTILVNHYLPHIYKDPHVFDPQRFAPGREEEKVAGRFSFLSFSAGRHACAGESFSYTQIKVLWSYLLSNFEIKMVSPFLETEWSTVIPEPKGKVMVSYRRRTAPK

SEQ ID NO: 66144 - protein, 378 aa, Wolbachia endosymbiont of Tunga penetrans
MSDLAKRMSLIKPSPTIAVTDKANRLKSEGKKICVLAAGEPDFDTPGHVKKAAIQAINEGKTKYTAVDGTLELKEAIINKLKKDNSLKYTPSQICVGAGAKQVLFNLFMATVNPGDEAIIPAPYWVSYVDMVSLFGGLPVVVECKQSFKLTPELLKSKITKKTKWLILNSPNNPAGVIYTYDELKGIAQILLEYPHVNVVTDDIYEHIIYDEKFFTIAQVEPKLYDRIFVVNGVSKAYAMTGWRIGYIAGRSDVIKAISTLQSQSTSNPNSIAQAAAVEALNGDHDFLKERTKIFKSRRDFVVEKLNSVPGLSASTPQGAFYLFVSCEGLLGKSTRSGKVINNDLDFAEYLLEDHLVAVVPGIAFGLKNFVRISYATS

SEQ ID NO: 66145 - protein, 125 aa, Escherichia coli
MSKQQIGVVGMAVMGRNLALNIESRGYTVSIFNRSREKQEEVIAENPGKKLVPYYTVKEFVESLETPRRILLMVKAGAGTDAAIDSLKPYLDKGDIIIDGGNTFFQDTIRRNRELSAEGFNFYRY

SEQ ID NO: 66146 - protein, 494 aa, Oryza sativa Indica Group
MSWVAATVALLLTTAVILTALQKRKISSPAAAAPPVVRGAGLVRFARAMARDGPLEAIREQQAKLGSVFTAIAPFGLFKVTFLIGPEVSSHFYLAPESEMGQGSIYRFTVPLFGPEVGYAVDPDTRAEQMRLFWDVLKPRSIEARVGAMAEEVQNYFSRWGEQGTVDLKKELERVLMLIASRCLLGREVRESMVDEVYELFRDLDNGLHLISTMLPYLPTPAHRRRDRARQRLGEIFTEVIRSRRNSGTAGNGDDVLQRLIDGRYKDERALTDVEVVGLLVALVFAGKHSSSSVSTWTGINLLSHPNHLAAVIAEQDRLMASRARTDDDHDRVNYDTVQEMTTLHRCIKEALRLHPPAVAMFRQARKHFTVQTKEGKEYTIPGGHTVLSTILVNHHMPNVYKDPHVFDPSRFARGRGEDKAAGPFSFLAFGAGRHSCAGESFAYTQIKVIWSHLLRNFELKMVSPFPETSWRMVTPEPKGTVMISYRRRNLTCK

SEQ ID NO: 66147 - protein, 268 aa, Bouteloua hirsuta
ASYAAAAMPALDVLPEKPHHGWESNGAAAVAPTPAPRRLDGKVAIVTGGARGIGEAIVRLFARHGARVVIADVDAAAGDALAAALGPQVSCVRCDVSVEDNVRRAVEWAVARHGRLDVLCNNAGVLGRQTRAAKSILSFDAGEFDRVLRVNALGAALGMKHAARAMAPRRAGSIVSVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 66148 - protein, 597 aa, Vitis vinifera
MVYVSTEVDHSVCERENRIGSLKKKANNASSKFRHSLTKRGRRSGKVMSVDIEDVHDAEELQAVDALRQALISEDRLPSRHDDYHMLLRFLKARKFDLEKTKQMWIDMLQWRKDFGADTIMEDFEFKELNEVIEHYPQGHHGVDKEGRPVYIERLGKVDANKLMQATTMDRYVKYHVQEFERTFVIKFPSCSISARKQIDQSTTILDVQGVGLKHFTKSARELIVNLQKVDGDNYPETLNRMFIINAGSGFRLLWNTVKSFLDPKTTSKIHVLGNKFQSKLLEIIEASELPEFLGGTCTCADQGGCMRSDKGPWKDPEILRMVQNGYAICRTKCESQSTAEKTISEDEIVYPKVSREVEDIQSLSPEVPRSYIEHPNLSPVHEEVSIVNSGTKRSKKEINQNFHKSYNYEDFIPIIDKSMNAPWQNVMENDRYALSKADCFTIHDAYKAPDGFSTQIFTGVMALVMGIVTMIRLTRTMPKKFTDANLYPGPIYCVDAMIKSHPYAHQLSAPVITGTEFLAFMKRMAEMEDRVSVLSVKPTAMPADKEDLLNAALIRIDTLERELAATKKTLEEAMAQQEEVLAYIEKKKKKKKLVFY

SEQ ID NO: 66149 - protein, 475 aa, Rhizobium leguminosarum bv. viciae 3841
MDIQMLIGSRFEKGTETEEHVLNPKTGETVLDLAEASLSQVDAAVDAAEKAFKTWSQTTPGERSGYLLKIADAIEKDAAGFAALEALNCGKPINAVLNDEIPAIVDCYRFFAGAVRNLHAPAAGEYLPGHTSMIRRDPIGIVGSIAPWNYPLLMMAWKLAPAIAGGNTVVFKPSEQTPLTALKMAKLLSEILPEGVVNVILGRGESVGNALINHAKIGMVSITGDVATGKKVLQAAAKTVKRTHLELGGKAPVIIFDDADIDAVVAGIRTFGYYNAGQDCTAACRIYADAKVYDNFVADLSSAVSSIRFNQADDTENEIGPLISKRQRDRVESFVARASEHKHMEITAGGKVSGDKGFFFTPTVIAGALQDDEIVRREVFGPVVSVTRFSDADDAVAWANDSDYGLASSVWTKDIGRGMKTAARLQYGCTWINTHFMLTNEMPHGGLKQSGYGKDMSVYALEDYTAVRHVMINHG

SEQ ID NO: 66150 - protein, 368 aa, Arabidopsis thaliana
MARRSVSIFNRLLANPPSPFTSLSRSITYMPRPGDGAPRTVTLIPGDGIGPLVTGAVEQVMEAMHAPVHFERYEVLGNMRKVPEEVIESVKRNKVCLKGGLATPVGGGVSSLNMQLRKELDIFASLVNCINVPGLVTRHENVDIVVIRENTEGEYSGLEHEVVPGVVESLKVITKFCSERIARYAFEYAYLNNRKKVTAVHKANIMKLADGLFLESCREVAKHYSGITYNEIIVDNCCMQLVAKPEQFDVMVTPNLYGNLIANTAAGIAGGTGVMPGGNVGAEHAIFEQGASAGNVGNDKMVEQKKANPVALLLSSAMMLRHLRFPTFADRLETAVKQVIKEGKYRTKDLGGDCTTQEVVDAVIAALE

SEQ ID NO: 66151 - protein, 507 aa, Vitis vinifera
MNNAINFFSETKLASAKTVFSTAASLLATAMVFRSVLQDFLPYEAQQIFCSGIRRLFNRFSPQMTMVIDEFDGIAYNQIFEAAETYLGSKVCSSQRLRVSRPAKERKFNINVERDQEIVDVFRGVKFRWLLICIKTESRIRSFELSFHKKHLDMVLNSYFPYILKESVSLIQEKKTLKLFTVDFEKMFGKMSDAWSSISLDHPSTFDTIAMDSELKSKILEDLKRFVRRRDYYKKVGKAWKRGYLLYGPPGTGKSSLIAAIANYLNFDIYDLELTELRCNSELRRLLLATANRSILVVEDIDCTIQLQDRSAESQVMNPRSFQFEKQVTLSGLLNFIDGLWSSCGDERIIIFTTNHKDKLDPALLRPGRMDMHIHMSYCTPYGFKILAANYLGIINHYLFSYIENLIQTTEVTPAEVAEHLLQSDEPEKALRDLIKFLEVKKEEARVQKEKEELEEEEEEEEEEEEEEEAKPEKELELQQGGSVGENDEVMMMNKRMPQLGFTLGDG

SEQ ID NO: 66152 - protein, 607 aa, Arabidopsis thaliana
MVRVKQKNLESYRSNGTYPPTWRNPTTSFAPDQHRVSIHSSLKSKTKRRRLYKEADDNTKLRSSSSTTTTTTTMLLRISGNNLRPLRPQFLALRSSWLSTSPEQSTQPQMPPRVPNLIGGSFVESQSSSFIDVINPATQEVVSKVPLTTNEEFKAAVSAAKQAFPLWRNTPITTRQRVMLKFQELIRKNMDKLAMNITTEQGKTLKDSHGDIFRGLEVVEHACGMATLQMGEYLPNVSNGVDTYSIREPLGVCAGICPFNFPAMIPLWMFPVAVTCGNTFILKPSEKDPGASVILAELAMEAGLPDGVLNIVHGTNDTVNAICDDEDIRAVSFVGSNTAGMHIYARAAAKGKRIQSNMGAKNHGLVLPDANIDATLNALLAAGFGAAGQRCMALSTVVFVGDAKSWEDKLVERAKALKVTCGSEPDADLGPVISKQAKERICRLIQSGVDDGAKLLLDGRDIVVPGYEKGNFIGPTILSGVTPDMECYKEEIFGPVLVCMQANSFDEAISIINKNKYGNGAAIFTSSGAAARKFQMDIEAGQIGINVPIPVPLPFFSFTGNKASFAGDLNFYGKAGVDFFTQIKTVTQQWKDIPTSVSLAMPTSQKQ

SEQ ID NO: 66153 - protein, 445 aa, Bacillus pumilus SAFR-032
MSANQEQQELKKLLSPRHIRMIALGGVIGTGIFKGSADTIGLAGPGVIFSYVFAGLLLLIVMAALAEMAIVYPGNNLRDLIQIALGQRFSFVVGWVYCFMWLTVCVIEIIAAGSLLQYWLPNVPLWSLCLLCSLLVIGINLNNVKYFGEIEFWFAGMKIFVIIVFIILGAALLFGIIPNEQSTSALTNYQNFVPNGWGAIFASLLVVIFSYGGSELIGLTITETKDAEKVLPGVVKSMMWRIILFYTLPILIICGLIPWNQIDPNNSPFVQVFSAAGMQGASHFINFVLITAVLSAANSGIYGTTRMMHSLSKSDGGPKKLAQVNKRGVPILSLWVTVLFLLIGTFFAYLYPEQIFSYMLAIPGFAVSLIWISICMAHLKLRPKYPQEPYFKVWLFPYLTLFAGLVLSVSFVMFLFRQENLPSSIISIGFLIAAIIASFLMKKKA

SEQ ID NO: 66154 - protein, 162 aa, Azoarcus sp. BH72
MKCPFRVGQGFDVHALVPGRALIVGGVDIPFSAGLLGHSDADVLLHALTDALLGAAGLGDIGRLFPDTDPAHAGADSRVLLREAYARVKAAGWEAVNVDATLICRAPRILPHAPAMVVNIAADLGMDAAAINIKGKTTEKLGFTGRGEGIAAQVVALLARAD

SEQ ID NO: 66155 - protein, 579 aa, Desulfitobacterium hafniense DCB-2
MSKILSNRYEIIEKIGSGGMAIVYKAKDLLLNRIVAIKILHEQFTADEEFVRRFRREAQSAASLSHANIVSIYDVGKDGETEYIVMEHIEGQNLKDIIRNYAPLSTEQTLELGIQIAEAIRHAHEHHIIHRDIKPHNILVTEDGRIKVTDFGIARAVSAATMTHTGDIVGSVHYLSPEQARGIQTNEQSDLYSLGIILYELLTGKVPYDGETPISIALKHLQELAVPPSKLNARVSPALENLVMRSIAKSPDQRYATAKDLLQDLRKVQAGLPVDKTVDEDQDLESTRVHSSLRAGVNSALASEEKEAGRKKAKVPLFRKRWPWVALLALVLIMGGGWVALSQWFNVGTTTVPPLVGKTIQEAGYFAEQKGLSLDPNTQEEYNNDMEKGKITRTDPEEGAVVKKERGIKVWVSLGPEQARIPNLKTGDITQEAAINFLESQGFKRDNIVAQEDQNSSLPKGIVVEQDPAPGSDWPKNGKITLTVSAGKVDEPKPMPNVISRSPADAKAILEQQYELKVIVDSENSTEYPSDVVMATDPKPGDMVKKGDTVRIIISRGPGPIAFNPVILGHVAKLDKIAQ

SEQ ID NO: 66156 - protein, 311 aa, Bacillus pumilus SAFR-032
MANKKKLILDVDTGIDDAIGILLAVKSQQFDMLGMTTVCGNVSVDAATLNTCKVLELVEADDIPVIKGSATPLLRAPHYEHRVHGEDGIGGALKDVEPKKTADAGFAPDFIIDQVMQYSKQVTLVLTGPLTNLALAVKKCPELIHHVKEVIFMGGVVQGQGNVTPVAEFNTYADPEAAKLVLDAGFPTLTQVGLDVTRKVLLTDERIDAIQNETLAHYIRESTSIYRQRYFERNGLWACAMHDPLAVSLAIDKQLVSTQAFHVDVETKSEFCDGQMICDFQHQWKKERNVQVCTDVDADAFFDLLINTMNA

SEQ ID NO: 66157 - protein, 410 aa, Streptococcus agalactiae 2603V/R
MTLLDSYKLKQDFPILNQLVNDEPLIYLDNAATTQKPNQVLEALRDYYQNDNANVHRGVHTLAERATAQYENAREKARQFLNAKLSKEILFTRGTTTGLNWVAKFAESILERGDEVLISIMEHHSNIIPWQQACERTGAKLVYAYLKDGSLDLEDFYNKLSSKTKFVSLAHISNVLGCVTPVKAIAERVHQVGAYMVVDGAQSAPHMAIDVQDLDCDFFALSGHKMLGPTGIGVLYGKESILDKMPPVEFGGEMIDFVYEQSATWKELPWKFEAGTPNIAGAIAFGEALDYLTDVGMDEIHQYEQSLVSYVLPKLQAIDGLTIYGPSDAESHVGVIAFNLEGLHPHDVATAMDYEGVAVRAGHHCAQPLINHLGIHSAVRASFYFYNTKEDCDKLVDAIQKTKEFFNGTL

SEQ ID NO: 66158 - protein, 481 aa, Citrullus lanatus
MKVTMTSGGMPSIPSSISPPPVTLPLRNIPGSYGLPLFGSIGDRLDYFWFQGPEKFFRSRMEKNQSTVFRTNVPPSFPFFFTDPRVIAVLDCKSFAHLFDMEIVEKKNVLVGDFMPSTSFTGNMRVCAYLDTSESQHSKIKNFVMDVLRRSSRIWIQELESNLSTMWDSIESEIAKDTKSSFRNHLQPTLFNFFSKTLAGADTAKSPEVAKSGYIDVIIWLGLQLVPTIHIGILQPLEEIFLHSFRLPFFPIASRYQRLYDFIQKEGEEVVERGVSEFGLTKDEAIHNLIFTMGFNAYGGFSLFFPVLLDRILNDKTGLQQRILEEVKAKTGSGLTFESVKEMDLIYSVVYETLRLDPPVPTQYARARKDFKLSSYDSAYSIKKGELLCGYQPLVMRDPKVFNKPKTFNPGRFRGEKGAALLDYLFWSNGPQTGLPSEHNKQCAGKDLVVLTAVVFVAYIFRRYDWIAGEGGSITAFQRTN

SEQ ID NO: 66159 - protein, 278 aa, Arabidopsis thaliana
MEIKVKAKDVESTMMSTKEEDEIKKMKECVVIQKADEEVTKGQETMKILDGSRQNQDETRQADSKNIDSPSSSSLEMKKKLEIDQNEENTKKEEDNNNNLSNMKHKKTSSHVWDCGSTLYDSFELNSFKRQLDSAISASSARTMSMSHLPDRRIPSLSSLSPEYSPPLPPPPTTSSSSSSGGKKHSNKISRSLQRFLKSMFKPKQHQSLTTPSSPVYKAVGHGGGDKDRYYVVYDKSGSLTTIPESTEKEVSPEINSLVRKTVSERFPASRVVGISCA

SEQ ID NO: 66160 - protein, 386 aa, Chlamydophila pneumoniae CWL029
MHLHEYQAKDLLASYDVPIPPYWVVSSEEEGELLITKSGLDSAVVKVQVHAGGRGKHGGVIVAKSSAGILQAVAKLLGMHFTSNQTADGFLPVEKVLISPLVAIQREYYVAVIMDRKHRCPVLMLSKAGGMDIEEVAHSSPEQILTLPLTSYGHIYSYQLRQATKFMEWEGEVMHQGVQLIKKLAKCFYENDVSLLEINPLVLTLEGELLVLDSKITIDDNALYRHPNLEVLYDPSQENVRDVLAKQIGLSYIALSGNIGCIVNGAGLAMSTLDILKLHGGNAANFLDVGGGASQKQIQEAVSLVLSDESVKVLFINIFGGIMDCSVVASGLVAVMETRDQVVPTVIRLEGTNVELGKEIVQQSGIPCQFVSSMEEGARRAVELSM

SEQ ID NO: 66161 - protein, 552 aa, Zea mays
MDTFPQPAAARGRRALVDVGNLMNGRPSLVNHQKQAVAAAATSHKPLNVGNKKPLVPQAAARGMRPLADVTNLMINDRAAPANRQKPLDAVFNRNGKAVKLKECKVKPEVIVTIPDSEKEKKGKLPGGQRVCRRVPTLFDNLTKCSRYEHKQNSKASDGITTPKKKDPYDIDAPDSCNELAVVEYVEDIYRFYKSTEGTCRPLSSYMSSQAEISERMRAILIDWIIEVQYRLTLMPETLYLTVYIIDQYLSMESVPRKELQLVGISAMLIASKYEEIWAPLSILRLAFTTSSDILQVKDLMCLCDNAFTRDQVLTKEKAILDRLHWNLTVPTMYMFIVRYLKAAMCDTELENMAFFYSELALVHYAMLVYPPSVTAAAAVYAARSTLGMNPPWTDILEHHTGLAEPQLLSNLLVAEDDAFNRNHRECARRLISFHTLAPESKQKAVYRKYSKPKLGSVALQSPVKKLLSGGLFHGVRSLTFGVDLMKIQLMGILETDLEEEKARELSKLQSSLEELQAKLDETSKMLAKEREAANTIEEACARETQSYRPKH

SEQ ID NO: 66162 - protein, 268 aa, Bouteloua hirsuta
ASYAAAAMPALDVLPEKPHHGWESNGAAAVAPTPAPRRLDGKVAIVTGGARGIGEAIVRLFTRHGARVVIADVDAAAGDALAAALGPQVSCVRCDVSVEDDVRRAVEWAVARHGRLDVLCNNAGVLGRQTRAAKSILSFDAGEFDRVLRVNALGAALGMKHAARAMAPRRAGSIVSVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 66163 - protein, 261 aa, Aegilops tauschii
MAEGGDELKLLGSWSSPFVTRAKLALAIKGLSYENVDEDVHNKSDLLLGSNPVHKKIPVLIHNGVPVCESMIIVQYIDEAFAGTGPPILPADPHERAVARFWAAYVDDKLVSQWTNSSRSKSRAGAEAMTEMLVAVEALEGALRECSKGKGFFGGDGVGLVDIALGSMHSWLMAIEAMSGAKVFDPARTPLLAAWMERFGSLDAARAVLPDVGRVVELAKIKHGQACRSFNFKQQVASRHGGMTYVCVCVNCEVEWPVFTF

SEQ ID NO: 66164 - protein, 268 aa, Bouteloua hirsuta
ASYAAAAMPALDVLPEKPHHGWESNGAAAVAPTPAPRRLDGKVAIVTGGARGIGEAIVRLFARHGARVVIADVDAAAGDALAAALGPQVSCVRCDVSVEDDVRRAVEWAVARHGRLDVLCNNAGVLGRQTRAAKSILSFDAGEFDRVLRVNALGAALGMKHAARAMAPRRAGSIVSVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 66165 - protein, 268 aa, Bouteloua hirsuta
ASYAAAAMPALDVLPEKPHHGWESNGAAAVAPTPAPRRLDGKVAIVTGGARGIGEAIVRLFARHGARVVIADVDAAAGDALAAALGPQVTCVRCDVSVEDDVRRAVEWAVARHGRLDVLCNNAGVLGRQTRAAKSILSFDAGEFERVLRVNALGAALGMKHAARAMAPRRAGSIVSVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 66166 - protein, 268 aa, Bouteloua hirsuta
ASYAAAAMPALDVLPEKPHHGWESNGAAAVAPTPAPRRLDEKVAIVTGGARGIGEAIVRLFARHGARVVIADVDAAAGDALAAALGPQVSCVRCDVSVEDDVRRAVEWAVARHGRLDVLCNNAGVLGRQTRAAKSILSFDAGEFDRVLRVNALGAALGMKHAARAMAPRRAGSIVSVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 66167 - protein, 268 aa, Bouteloua hirsuta
ASYAAAAMPALDVLPEKPHHGWESNGAAAVAPTPAPRRLDGKVAIVTGGARGIGEAIVRLFARHGARVVIADVDAAAGDALAAALGPQVSCVRCDVSVEDDVRRAVEWAVARHGRLDVLCNNAGVLGRQTRAAKSILSFDAGEFDRVLRVNVLGAALGMKHAARAMAPRRAGSIVSVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 66168 - protein, 380 aa, Clostridium perfringens ATCC 13124
MNCNKTIYTPGPTNLRENVRRARALKTTNPDVDVDFVEFYKETCDRFGEIINTKNDCYILSGEGILGLEAACASLTEKGDKVLVLDNGLYGRWFDGFVTMYGGEVTYFSGDYTKEIDVEALSKFLENNNDFKYATVVHCDTPTGVLNPVDKICPLLKSYGILTVVDSVSAMVGEEFKVDEWQIDIALGGSQKAFSAEPGLTMVSISDDARKVMENRETPIVGFYCNLNIWKNYYKDKWFPYTMPISDIISLRVAIDNILEEGKEKVIERHRKIGEATRKAVKEYGLDLFLKNGYSNTVTAVEIPEEIGALNLRNHLNKKYNVLISTSLDKYENKLLRIGHMGENANIEDITYVLNAIDKALKDLGFSSEKQLDKLFIENI

SEQ ID NO: 66169 - protein, 382 aa, Pinus radiata
MDSNMNGLAKSNGCEISRDGFFESEEEELQGQAEAWKCTFAFAESLAVKCVVLLGIPDMIAREGPRATLSLGEIVAKLPTESPDAACLFRIMRFLVAKGIFRASKSAREGGAFETRYGLTPASKWLVKGRELSMAPMLLMQNDETTLAPWHHFNECVLEGGVAFQKANGAEIWSYASDHPDFNNLFNNAMACNARIVMKAILSKYQGFHSLNSLVDVGGGTGTAVAEIVRAYPFIRGINYDLPHVVATASSLSGVQHVGGDMFETVPTGDAIFMKWIMHDWNDEDCIKILKNCRKAIPDTGKVIIVDVVLDADQGDNTDKKRKKAVDPIVGTVFDLVMVAHSSGGKERSEKEWKRILLEGGFSRYNIIEIPALQSVIEAFPR

SEQ ID NO: 66170 - protein, 96 aa, Zea mays
  misc_feature (35)..(35): Xaa can be any naturally occurring amino acid
  misc_feature (55)..(55): Xaa can be any naturally occurring amino acid
NAAPLSTKGAGASLLASYCAVTAFSAPALALVDQXMSTEGTGLSLGLPNNLLGWXILLGVFGLICSPYTIYTSEPDHDKDSARPLALHSPPLLIMI

SEQ ID NO: 66171 - protein, 336 aa, Pseudomonas syringae pv. phaseolicola 1448A
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDIKIPESTQEFAINMSNQRHWEAPVQRYVNELLAGEEGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 66172 - protein, 524 aa, Synechococcus sp. CC9311
MADQRFDLVVIGGGASGCSVAYEAVRRGLRVALLEGHDLGSGTSCRSTKLLHGGVRYLELAFKTADLAQLHLVREALLERGHWLNQAPFLAQRLELALPSDCRLGQAYYRIGLGLYDALSGRAGIGSSRLLSSKQLQQALPLLRPDVRRGVAYSDGQFDDARLNLLLALTAERAGAVLRTRTKVRELERNSQGQICAAISENHKGEQERWEARAVVNATGIHADAIRRMAAPNCSMRMLTSRGVHLVLRANLCPDGLGLLLPSTDDGRVLFMLPFFGRTLVGTTDTPCTQASAAAPSEDEQNYLLDYVRRWFPDLSQPDVGSCWAGGRPLLKPAGAEVNSSRVVREHEVERLNCGLISVMGGKWTTCRPMAIDTLKAVEAQFGSPLPDPASLPLIGADQDPKRTPTLLQEQVCALERLLPETPLRDQQRAHLQATFGLEAAALVASWNESDREPLSDVIPVCRGEFRHAIRAEHACTATDVLARRCRLAMVDQDEAERLLPQVQALLEEAGVDAPYTPELNLSC

SEQ ID NO: 66173 - protein, 338 aa, Desulfovibrio desulfuricans G20
MRQVTVTEHLLLHQTKSPAATGQFTALLYDLILAAKIISKSVNKAGLLDVLGGTGQVNVQGEHVQKLDEYANRVLIHRMERTGVLCAMASEENADLIRVPERFEAGDYILIFDPLDGSSNIDVNINVGTIFSILKRKPGASGSKDVTLGDVLQSGVEQVAAGYFLYGPSTMLVYSSGQGVHGFTLDPSVGEFLLSHPDIRYPEQGRIYSVNESYWHYWDEPTREVVSYFKGPDNPLGKPYSLRYVGSLVADFHRNLFYGGIFMYPMDYRLPEKPQGKLRLMCEASPLAFLAEQAGGRATDGTKRILDIVPGELHQRVPLFIGSAGDVDAVEAIYRRHS

SEQ ID NO: 66174 - protein, 480 aa, Ustilago maydis 521
MSQTKIKYSDLEELLKNDNKVKVAGVDVDGIVRGKYVSKKKFLSAAKPDSDFGFCSVIFGWDMHDQVYPTELLVSNKANGYRDLSAKIDLDTYRRIPWEDNLPFFLIRYFNADGSALAVCPRNLLRSVTSKVEAQLGLLCMAGAEFEYFQFAETAQTLDDKRFVKLNALTPGNHGYSMLRTSLNKDYFLQLFDAAEAFGIDVEGHHTETGPGVYETALAYTEVTRMADMAVLYKLLAKSIGMQHGITPTFMAKPWANLAGCSGHIHVSLRDASTGKNVFGLSAEQIAAGGRADAEYDDVKYLSEIGEQFLAGLMTGLPDIMPLLCPTINSYKRLTTGEAYWAPNICSYGYDSRLASVRILGPPDVPDYGTRFEVRVPGADLNAPYAFAAVFALGLYGIQNKLKLPFAPMDASRSVKEQKLVYLPTSLEAATHRFMHAHSLARKVLGDTLVDHFGGTRLHEVSLFNQTVTNWEMERYMELI

SEQ ID NO: 66175 - protein, 268 aa, Bouteloua hirsuta
ASYAAAAMPALDVLPEKPHHGWESNGAAAVAPTPAPRRLDGKVAIVTGGARGIGEAIVRLFARHGARVVIADVDAAAGDALAAALGPQVSCVRCDVSVEDDVRRAVEWAVARHGRLDVLCNNAGVLGRQTRAAKSILSFDAGEFDRVLRVNALGAALGMKHAARAMAPRRAGSIVSVASVAGVLGELGPHAYTASKHAIVGLTKNAACELGAHGIRVNCVSPFGVATPMLINAWRQGHADAVPSDEEVEKMEVVVRGLATLKGPTLRP

SEQ ID NO: 66176 - protein, 268 aa, Bouteloua hirsuta
ASYAAAAMPALDVLPEKPHHGWESNGAAAVAPTPAPRRLDGKVAIVTGGARGIGEAIVRLFTRHGARVVIADVDAAAGDALAAALGPQVSCVRCDVSVEDDVRRAVEWAVARHGRLDVLCNNAGVLGRQTRAAKSILSFDAGEFDRVLRVNALGAALGMKHAARAMAPRRAGSIVSVASVAGVLGGLGPHAYTASKHAIVGLTKNAACELGAHGIRVNCVSPFGVATPTLINAWRQGHADAVPSDEEVEKMEEVVRGLATLKGPTLRP

SEQ ID NO: 66177 - protein, 183 aa, Desulfovibrio desulfuricans G20
MLTLANKITLFRIVIVPLIVVFLYFPGRITCLLAMLGFILAALSDMVDGHIARRSNTVTSFGKFLDPLADKLLISSVLVMLSALGWVPAWVVIVIICRELMVTGLRAIAADEGVVIAADKFGKMKTVLQMLALTPLLLHYPWFGFDPNPAGQFLLYMALILTVFSGGNYLYAFYKNWRTADAG

SEQ ID NO: 66178 - protein, 298 aa, Desulfovibrio desulfuricans G20
MSSCKSRPDSVKDGDIAKNAFGVSQQELNIQSVLQRIRYKLFVMSGKGGVGKSSVTVNTAAALAAKGFKVGILDVDIHGPSVPNLLGIKSGLEVDEKTRRICPAPYSENLFVVSMDSLLRDKDSAVLWRGPKKTAAIRQFVSDVEWGELDFLLIDSPPGTGDEHMTVLKTIPDALCVVVTTPQEVSLADVRKAINFLQYAQSNVLGIVENMSGLVCPHCGGEISLFKKGGGKALAERYGLPFLGAVPLDPATVVAADVGRPVVLLEEDSHAKKGFLDLAENIVHACENSLEVIASVHA

SEQ ID NO: 66179 - protein, 268 aa, Bouteloua hirsuta
ASYAAAAMPALDVLPEKPHHGWESNGAAAVAPTPAPRRLDGKVAIVTGGARGIGEAIVRLFARHGARVVIADVDAAAGDALAAALGPQVSCERCDVSVEDDVRRAVEWAVARHGRLDVLCNNAGVLGRQTRAAKSILSFDAGEFDRVLRVNALGAALGMKHAARAMAPRRAGSIVSVASVAGVLGGLGPHAYTASKHAIVGLTKNAACELGAHGIRVNCVSPFGVATPMLINAWRQGHADAVPSDEEVEKMEEMVRGLATLKGPTLRP

SEQ ID NO: 66180 - protein, 449 aa, Crocosphaera watsonii WH 8501
MRVCVIGTGYVGLVTGVCLSHIGHHVICIDNNEEKVKLMKSGQSPIYEPGLSELMHGCMEAGRLEFTSDLAAGVNHGEILFIAVGTPALPNGESDTRYVEAVARGIGENLNGGYKVIVNKSTVPIGSGDWVRMIVMDGFAQRENAPADVDFDVVSNPEFLREGSAVFDTFNPDRIVLGSNNDKAITMMQELYQPLVDRKFGDDQSLPPVPVVVTDLNSAEMIKYAANAFLATKISFINEVANICDRVGADVTQVAAGIGLDSRIGNKFLQAGIGWGGSCFPKDVLALIHTATDYNYETELLNAAVNVNKRQRLIALEKLQQELKILKGKTIGLLGLTFKPDTDDMRDAPALIIIEQLNRLGAKLKAYDPIVSQSGLSHGLSNVIIETDAEMLADSCDALVLVTDWKEFLSLDYGKMAQVMANPVIIDGRNFLDRSKLEMAGFHYVGIGR

SEQ ID NO: 66181 - protein, 164 aa, Musa acuminata AAA Group
DAGLSEIADGCPLLEKLDLCQCPLITDKVLVAVAKKCPNLTSLTIESCANICNEGLQVIGRSCPKLKSLTIKDCLHVGDQGIVSLVSSASSCLERIKLQALNISGIVLAVIGHYGKNLIDLSLNGLQNVGEKGFWVMGNALGLQKLRSITINCCNGLTDKGLQA

SEQ ID NO: 66182 - protein, 299 aa, Vitis vinifera
MKPRNDETYTKIALTSLSAMVAETSTFPIDLTKTRLQLHGESLSSARSTTAFRVAAEIVRRDGPLGLYKGLSPAILRHLFYTPIRIVGYEHLRNAVDGHDSVSLSGKALVGGISGVIAQVVASPADLVKVRMQADGRMVSQGLQSRYSGTFDALNKIIRTEGFRGLWKGVFPNVQRAFLVNMGELACYDHAKHFVIQNQICGDNIYSHTLASIMSGLSATALSCPADVVKTRMMNQAVSQEGKSMYNNSYDCLVKTVRVEGLRALWKGFFPTWARLGPWQFVFWVSYEKFRELAGLSSF

SEQ ID NO: 66183 - protein, 173 aa, Fusobacterium nucleatum subsp. vincentii ATCC 49256
MGKEGEMSLQAIIKTNKGEIKLNLFPDVAPVTVLNFITLAKTSYYNGLKFHRVIEDFMIQGGDPTGTGAGGPGYQFGDEFKEGIVFNKKGLLAMANAGPNTNGSQFFITHVPTEWLNYKHTIFGEVVSEKDQDVVDNIKQGDTINEVIIVGNTDRLIEDNKEFYTQLKNFLKI

SEQ ID NO: 66184 - protein, 312 aa, Oryza sativa Indica Group
MEPDADELVFDSSYLRIYKNGKVDRLHRPPLLAAGVDDATGVVSKDVVLDDGTGLFVRVFLPKVQDQELGKKLPVLVYFHGGGFIIESADSATYHNYLNSVSAAAGVLVVSVDYRLAPENPLPAGYDDSWAALQWAVSAHADDWITEHGDTARVFVAGDSAGGNIVHDVLLRASSNKGPRIEGAIMLHPFFGGSTAIDGESDEAVYIASKVWPFACPGAVNGVDDPRMNPTAPGAPALEKLGCERLLVCTAQEDWLVARGRAYYGAVAASAWRGSAAWHETEGEGHVFFLRDPGCDKAKQLMDRAVAFISAS

SEQ ID NO: 66185 - protein, 222 aa, Triticum aestivum
NKFVQKSRLVPVRNSRDIVDPRVRSSKIGVIESLLAKVDILILGGGMIFTFYKAQGLAVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTGKGVTTIIGGGDSVAAVEKAGLADKMSHISTGGGASLELLEGKPLPGVLALDEA

SEQ ID NO: 66186 - protein, 258 aa, Ralstonia solanacearum
IANFKDIEVVAINDLLEPDYLAYMLKYDSVHGRFDGEVSVDGNTLVVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELEKAASYDEICAEMKAQSQGALKGVLGYTEDK

SEQ ID NO: 66187 - protein, 258 aa, Ralstonia solanacearum
VANFKDIEVVAINDLLEPDYLAYMLKYDSVHGRFDGEVAVDGNTLIVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPELNKKLTGMSFRVPTSDVSVVDLTVELEKAATYDEICAEMKAQSEGALKGVLGYTEDK

SEQ ID NO: 66188 - protein, 273 aa, Oryza sativa Indica Group
MAASLVHAAAASASPAPAARVGAFHPLASSSPFLRLACATASSPSTRRRRCLDAPLRALSAGSRLAAGWGAPRTRRVIATFAGEESVGSESGDDKEKGKGEMKPEEAQEVWKEMLKQFKDEAQRMHGLTLQAYGVYSQRAREVLLEASEKLKIHADKAQKDLSVIATEVGEEGQEYLKLAAQNSPDSIKDINETFNSLGKLKISEYEDYHVGIPFGTFLTVGGFLNFMLTGRTSAIRFGIILGFALLAMGISSLRSQRAGGRRPRLLLKGQAG

SEQ ID NO: 66189 - protein, 467 aa, Bradyrhizobium sp. HW13
MSIVNIAEVIESQTLNRKVVSLLLLSFLIMLCDGYDLQTISFASPSIVADWGIEKSAFGFVFTAGALGIMVGGFLFGSLADRIGRRPSFIIGTLLFSVMTLSTVLATTVTHLAVFRFIAGLGIGGVTPICFALNVEYVPKRFRATVVAVVMIGYMIGTGIGGILAAWLVPQHGWHVLFYIGGVAPLALMPLLVFALPESIKYLLLSNEHSKSVPLLVNALCPAAGATSDTRFVLDDTEDQAKLGSWKEIILSLFKGRLRRVTPVLWISFIASNMTVFLLAFWIPLITVSTGRSASLAAIGLTLYSLGGAFGGLLASRIVDMRGVAAVALIPLIASAVIIATGALEFSDAGFLTMMGVIGFFVFGGHLALMSVTGMFYPNSNRASGAGWALSVGKLGAIFGPALAGFVIASHPPLIDLFLIAAAPLPIVALGFFMLGRLGGAQAVATRAEDGGQANVEKPVLVHGSAS

SEQ ID NO: 66190 - protein, 478 aa, Bacillus anthracis str. A2012
MKIAGRNLNHHGTSAAFVKNKLLWKVEEMMKTKQTDELLAKDEQYVWHGMRPFSPNSTMVGAKAEGCWVEDIQGKRYLDGMSGLWCVNSGYGRKELAEAAYKQLQTLSYFPMSQSHEPAIKLAEKLNEWLGGEYVIFFSNSGSEANETAFKIARQYYAQKGEPHRYKFMSRYRGYHGNTMATMAATGQAQRRYQYEPFASGFLHVTPPDCYRMPGIERENIYDVECVKEVDRVMTWELSETIAAFIMEPIITGGGILMPPQDYMKAVHETCQKHGALLISDEVICGFGRTGKAFGFMNYDVKPDIITMAKGITSAYLPLSATAVKREIYEAFKGKGEYEFFRHINTFGGNPAACALALKNLEIIENENLIERSAQMGSLLLEQLKEEIGEHPLVGDIRGKGLLVGIELVNDKETKEPIDNDKIASVVNACKEKGLIIGRNGMTTAGYNNILTLAPPLVISSEEIAFVIGTLKTAMERI

SEQ ID NO: 66191 - protein, 144 aa, Brassica napus
  misc_feature (10)..(10): Xaa can be any naturally occurring amino acid
  misc_feature (37)..(37): Xaa can be any naturally occurring amino acid
FTTTHKDRLXDPALLRPGRMDMHIYMGHCTFQGFKTXLASNYLCLNDTTMPHRLYPEIERLMEGDVITPAQVAEELMKSEDADMALEGLVSVLEKMRFKADESSQVIMKKEGRLEMDEMALKRDAEGSPRKNGKRIKKLVLFWT

SEQ ID NO: 66192 - protein, 298 aa, Synechococcus sp. CC9311
MPALPNAGQIVETSLMELCLGGCAANTAYDLAKLGVDVCLGGCIGEDPFGDFLLRTLEEAGVQTTGVSRCSQATTATSAVINVEGGDRRLISVVGANRLFKCSMIPEGLIESAAVIHIGGFLLLDALESVQTQERLQQARANGALVVLDVIEVKDPLAMERVQRVLPFTDVVLPNRDEAALLTGRKNPWDQAQMFGDAGASTVVITDGAQGTYVVTDGLRLRSDAYSTSFLGGTGAGDAFDAGFIAGYLNGEDLKGCVRWGSAMGASCVRSTAATSSVFSKEEALRFMGNHTLHIHEV

SEQ ID NO: 66193 - protein, 319 aa, Bacillus anthracis str. A2012
MAGLETDLEELNANRNSSLAVALGGIILPFVGGYVSGLVMGMEQGNAVFLGLLLCATSVSISVQTLRDLGKMKTRESTTMLGAAVFDDILVVILLAFAMSFLGTDDVNLTMVILKKVVFFASIILIGWKGVPAIMRWLSPLRVSESIVSAALIICFSFAYFGELLGIAGIIGAFAAGIAISQTNYKHEVEKKVEPIAYAMFVPVFFVSIGMNITFDGIGDQIGFILALTVIAVLTKLIGCGVGARMTGFDAKSSAIIGSGMVSRGEVALIIAGTGLSSGLLAQDYFTAIVIVVILTTMITPPMLKYTFGAKDKAMKASK

SEQ ID NO: 66194 - protein, 342 aa, Hypocrea jecorina
MPTTTAETLSLVTRNVSVAPLVLLSAVDHYNRTVTSKTKRRVVGVLLGQNDGKNVRVSNSFAVPFEEDEKDPSVWFLDHNYVESMNDMFKKVNAREKLVGWYHTGPKLRASDLEINELFKRYTPNPLLVIIDVQPKESGVPTDAYFAVEEIKDDGTTTSRTFVHTPSIIEAEEAEEIGVEHLLRDIRDVAVGTLSTRVTNQLQSLQGLHLRLRDIGAYLQKVLDGQLPVNHAILGNLQDVFNLLPNLSTPEDDSRTGGHELSHAMSIKTNDQLMAIYLSSLIRAITAFHDLIENKIQNRQQQDEKEPKKDEAKDKDEKKDAGATNANGESKESSDKEKSKKK

SEQ ID NO: 66195 - protein, 535 aa, Desulfitobacterium hafniense DCB-2
MLYDPLYHPYPSKRSLSFASRGMVATSQGLAAQAGLDILKKGGNAIDAAIATAACLTVVEPTSNGMGGDAFALVWTKGRLHGLNASGTAPASLSGHDLIKAGHQEMPQYGWIPVTVPGAPAAWAALSERFGRLPLTEVLKPAIDYAEQGYPVSPVLGQNWQIAYTKYAQELKGEEYESWFKTFAPQGRAPFIGEIWRSPDHARSLAQIAASKAQAFYKGDLADRIDAFSQKYGGYLRKRDLEDYQPLWVDPIHLHYRGYDVWEIPPNGHGLVALMALNILKGFQFSAKDSIETYHKQIEAIKLAYVDGRKYIADPRSMEVKISDLLSEGYALERRKLIGQTALLPEPGTPPKGGTVYLAAADDEGNMVSMIQSNYMDFGSGLVVPGTGISLHNRGNNFSLDPHHANFLEPKKRPYHTIIPGFLTKDGNTVGPFGVMGGFMQPQGHVQVLMNAIDFHLNPQAALDAPRFLWVQDRHVQVERSLPSHIGDGLSRMGHEIEWSANTGLFGRGQIIWRNDKDVLVGATEPRTDGVVAAW

SEQ ID NO: 66196 - protein, 272 aa, Physcomitrella patens subsp. patens
MCTTYATDIYAHLRMAEMKRRPSANFMESMQQDINPSMRGILVDWLVEVAEEYKLVPDTLYLTVSCIDRYLSAHVVTRQRLQLLGVACMLIAAKYEEICAPQVEEFCYITDNTYGREEVLEMERGVLRVLKFELTTPTIKSFLRRFIRAAQAGCEAPALVLEFLGNYLAELTLVEYGFLPFLPSMIAASCAYLARVTLDSSRRPWDATLQHYTGYRPSELEQCVRAMHELQCNTRGCTLPAVREKYRHHKFKCVAALVPPAVLPEEYFRELE

SEQ ID NO: 66197 - protein, 268 aa, Bouteloua hirsuta
ASYAAAAMPALDVLPEKPHHGWESNGAAAIAPTPAPRRLDGKVAIVTGGARGIGEAIVRLFARHGARVVIADVDAAAGDALAAALGPQVSCVRCDVSVEDDVRRAVEWAVARHGRLDVLCNNAGVLGRQTRAAKSILSFDAGEFDRVLRVNALGAALGMKHAARAMAPRRAGSIVFVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 66198 - protein, 268 aa, Bouteloua hirsuta
ASYAAAAMPALDVLPEKPHHGWESNGAAAVAPTPAPRRLDGKVAIVTGGARGIGEAIVRLFTRHGARVVIADVGAAAGDALAAALGPQVSCVRCDVSVEDDVRRAVEWAVARHGRLDVLCNNAGVLGRQTRAAKSILSFDAGEFERVLRVNALGAALGMKHAARAMAPRRAGSIVSVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 66199 - protein, 440 aa, Oryza sativa Indica Group
MEPHADEVVFDGPYFRIYKNGKVDRLHRPLLVAAGVDDATVVVSKDVVLDAGTGLFVRVFLPKVQDQETGKKLPVLVYFHGGGFIIESADSATYHNYLNSVAAVAGVLVVISIQSLIGSADATPSLVAMEPHADEVVFDGPYFRIYKNGKVDRLHRPLLVAAGVDDATVVVSKDVVLDAGTGLFVRVFLPKVQDQETGKKLPVLVYFHGGGFIIESADSATYHNYLNSVAAVAGVLVVSVNYRLAPENPLPAGYDDSWAALQWAVSAQDDWIAEHGDTARVFVAGDSAGGNIVHEMLLRASSNKGPRIEGAIVLHPFFGGSTAIDGESDDAVPKGSKLWAVACPGAANGVDDPRMNPTAPAGAPALEKLGCERLLVCTAQEDWLVARGRAYYGAVAASAWRGSAAWHETEGEGHVFFLRDPGCDKAKQLMDRVVAFISGA

SEQ ID NO: 66200 - protein, 352 aa, Desulfovibrio desulfuricans G20
MSNPMNFAFLRKSPLPPNGRKVGIIGAGPSGLAACGYLACLGYEVVVYDKLPQPGGLMVFGIPRKRIPPERIRAGVRRMERQFGVVFRTKTKICCSAPLHEEEGDHFSCDIRGLGELVEEHDAVMICTGSWKSRKLGIPGENLAGVHSGLEFLFPIRAAKYASPNVTMPDVRGKRVAVVGAGHSAVDVVDSAHALGAAKIYMIYRRTAREAPCGSFEIDRICEMGAEWLERRTPLRVEGECGVQRLELANGMTGEAEHLDVDMLITAIGEIPTPPFQQELGLENVRKGEVRWLHMTSIENVFVAGDVLTGPSKIGKAVYSGLRASRSLTNWLDLKAQNREGEYRYDEDRIVP

SEQ ID NO: 66201 - protein, 389 aa, Neptuniibacter caesariensis
MKMVFRPSQRVAEIESFKVMDLLKRAKQLDAEGFDVIHMEAGEPDFATAAPIAEAAKAAIDKGLTQYTPAAGIPELRTAISQWYKTKYNLEISPERIIVTTGASSALLMVFSLLADAGQSFMMADPGYPCNRQFLQFLDAKSQLVAVNAEQNFQLNAQLIRDNWCPETAGALLASPANPTGAVVHKDELRAISNQIKQLGGHLVVDELYHGLTYGDDAPSVLEVDPDAFVINSFSKYFGMTGWRLGWLVAPEAAAPELEKLAQNLMISPHTVSQYAALAAFKPESLAIFEERKAQFELRRDLLVSGLRELKFDLPISPEGAFYVYAGAQHLTDNTYDYCWSMLEEDHIATTPGLDFGRHRCNEFIRFSYTTGYDRIELMLDRLQKRIHG

SEQ ID NO: 66202 - protein, 387 aa, Oryza sativa Indica Group
MATPSPNPHLSMSINGGATVSAGWAATQPRRRRTVDHSSRSCLLRPSYGSTRGFGTRRIAVRSASQKNSSPPLMTTEQEAEDEVVLESPAHFRIYKSGKIDRLNRPPVLPAGLDEATGVTSKDVVLDADTGVSVRLFLPKLQEPSKKLPVVVFFHGGAFFIESAGSETYHNYVNSLAAAAGVLVVSVDYRLAPEHPLPAGYDDSWAALQWAASAQDGWIAEHGDTARLFVAGDSAGANIAHEMLVRAAASGGRPRMEGAILLHPWFGGSKEIEGEPEGGAAITAAMWYYACPGAAAGADDPRLNPLAAGGPVLEELACERMLVCAGGKDVLAARNRAYYDAVAASAWRGSAAWLESEGEGHVFFLGNSECENAKQLMDRIVAFIAGG

SEQ ID NO: 66203 - protein, 268 aa, Bouteloua hirsuta
ASYAAAAMPALDVLPEKPHHGWESNGAAAVAPTPAPRRLDGKVAIVTGGARGIGEAIVRLFTRHGARVVIADVDAAAGDALAAALGPQVSCVRCDVSVEDDVRRAVEWAVARHGRLDVLCNNAGVLGRQTRAAKSILSFDAGEFDRVLRVSALGTALGMKHAARAMAPRRAGSIVSVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 66204 - protein, 701 aa, Prunus salicina
QLQLALALRLSSEATCADDPNFLDLVPDVSASRSSGSVDAVSHRFWVNGCLSYFDIVPDGFYLIHGIDPYVWTVCTDMQENGRIPSIESLRSVDPGIGSSIEVVLIDRRSDPSLKELQNRVFSLSCTCITTKEIVDQLAKLVCNRMGGSASVGEDEFVPIWRESSDDLKDCLGSVVVPIGSLSVGLCRHRALLFKVLADRIDLSCRIAKGCKYCTRDDASSCLVRFGLDREYLVDLIANPGYLCEPDSLLNGPSSISISSPLRFPRLKPVEPTIDFRSLAKQYFSDCQSLNLVFDEASAGSAVDEDNKEFSMYPEQLDRKITGGNNLLLVSSLNDNTSMHAKVSRPSFEDRNPQLFNPSQNIVHTPGMVKDPIPLKRIPPIGHRDVSRVDTTKGSRFVEGVQLVPSKPSKELTFDIEDLDIPWNDLVLKERIGAGSFGTVHRADWHGSDVAVKILMEQDFHAERFKEFLREVTIMKRLRHPNIVLFMGAVTKPPNLSIVTEYLSRGSLYRLLHKPGAMEALDERRRLNMAYDVAKGMNYLHRRNPPIVHRDLKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDLNPQVASIIEACWAKEPWKRPSFATMVESLMPLNKLPVNLPSPPIQTLPTE

SEQ ID NO: 66205 - protein, 326 aa, Clostridium perfringens ATCC 13124
MDKRKVIVDCDPGIDDALAIILALKSKEIEVIGITTVSGNVKSLQGAKNALKVLKLLGRLDIPVYLGESKPIKRELVTAQDTHGEDGLGETFLEEVSSEYIRENSVDFILNTLKNHENVSIIALGPLTNLCRAIEKDSETFHRVKEIVSMGGAYKSHGNCSPVAEFNYWVDPHGAREFLKKFNGEFTMVGLDVTREIVLTPNLREMIHQFKDEIGDFIYDITRFYVDFHWEQERTLGCVINDPLAVEYFINRELCEGFKAYVDIACEDISMGQSVVDVADFYKRRKNVFVLDKVNSKEFMVSFLNKIFPSHKEDIKNVLNNPKYGI

SEQ ID NO: 66206 - protein, 268 aa, Mycobacterium avium subsp. paratuberculosis K-10
MVNELAGKVAIVTGGASGIGRGIVERFVAEGARVVIADIETERGERLAAELGGEAVFRRTDVSDIEQVGALVAAAVEKFGGLHVMVNNAGISSPLRRLLDDDLADFHRVMGVNVLGVMAGTRDAARHMADNGGGTIINLTSIGGIQAGGGVMTYRASKAAVIQFTKAAAIELARYDIRVNAIAPGNIPTPILGKSAGDMDPEQRERFEARIREGMREDRPLKREGTPDDVAEAALYFATDRSRYVTGTVLPVDGGTSAGKAMRSKRQG

SEQ ID NO: 66207 - protein, 868 aa, Oryza sativa Indica Group
MSQASLSPSSSGDEEEEDEGVEGYRKGGYHAVRPGDQFAAGRYVAQRKLGWGNFSTVWLAFDVHTQMLDKFFWLVMAGSFKCCDKKFVALKIQKSAPEFAQAAFHEIEFLSEITKRDPSNCKCIIQLIDHFKHAGPNGQHICLVFEFLGDSLLKLVQYNRYNGIGFGPVREICRSILIGLDYLHRELGIIHSDLKLENILLISTIDPSKDPIRSGLKPNLERPEGNPNGEVMLNPIEKKLKMRARRVLAKLAEKKKSAAEYARAERSLDGIDMTCKIVDFGNACWADKQFTDFIQTRQYRAPEVILGSGYSFPVDMWSFACIAFELATGEMLFTPKEGQGYSEDECIYATEKRLNEMKLKGGSKGSLGFDDGSPWEDTEKAQIATMGTKSKEYFDRHGDLKRIRRLKFSSIERVLVDKYKISESDAREFAEFLCPLFDFAPEKRPTAAQCLQHKWLQYSDGKNYGTLNISDVKNASVTCSPGTTASSDSKSIDVTRNIGDKPDSYAERADAKCNTSKKSIINSNSENSDVQPNTASVGNRNSKIDDVNSNTGSITNKDSKNTVIKPSIGSFANRNAETVDVKPNIGSITSRGDSSSDTKSNIGSVASKDAKTIDAKPSTSSITSQDSKIGDGRSNIDGIANRDAKTADVKHNIRSVVNTYLRNFDVKHNTGNIVDGGVKHSDLKPGTVSAANVDSKSISAKPSTGSFENSDAKSISAKTSTGSFENSDAKSISAKTSTGSFDNSDARNIMKANTGIVANNDVKDTDVQTNTESVTSGDDLNDIDRKPNIGRVAASIQRLESSIGKVQSGKYRIHMEILLTFKGVLRGIHGSCECRGDSSASCTHVGSVLMAFIPVLRKGYKDPILRPV

SEQ ID NO: 66208 - protein, 274 aa, Fusobacterium nucleatum subsp. vincentii ATCC 49256
MDKIYIRDLEFIGYHGVLEEEKKLGQKFFISLELTTNLREAGLNDDITKTTHYGEVAETIKKIFFQKKYDLIETLAEDIAREVLLNYPLISELKLEIKKPWAPVGIALKDVSVEITRKWNEVYISLGSNMGNKKENLEKAIKEIANIEDTFIIKESKIIETEPFGYKEQDDFLNSCIGVKTLLAPREILKELLSIEQKMGRERKIKWGPRIIDLDIIFYGKEVIEEDDLIVPHPYMEYREFVLKPLEEIIPNFVHPLLLKRVSTLKKELENEKN

SEQ ID NO: 66209 - protein, 378 aa, Cryptococcus neoformans var. neoformans JEC21
MPSFTTSSSPQIPAHSTKLHRHSVQDEASEFAVATSSSTYAIAEEEFESESEERTLRGRLRDIMSDNQMVINTFIAGGLAGAASRTVVSPLERLKIILQVQASGSKSGVGQAYAGVWESLGRMWKDEGWRGFMRGNGINVVRILPYSALQFTSYGAFKGVLSTWSGQEALSTPLRLTAGAGAGVVAVVATYPLDLVRARLSIATANMAVRQPGAAFTNEDARLGIVGMTKKVYKAEGGLRGLYRGCWATALGVAPYVSLNFFFYESVKTHVLPDPPSPPLSETDLALRKLFCGAVSGASSLIFTHPFDVLRRKLQVAGLSTLTPHYDGAIDAMRQIIRNEGFWKGMYRGLTPNLIKVTPSIAVSFYVFELVRDSLEAL

SEQ ID NO: 66210 - protein, 258 aa, Ralstonia solanacearum
VANFKDIEVVAINDLLEPDYLAYMLKYDSVHGRFDGEVAVDGNTLIVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPELNKKLTGMSFRVPTSDVSVVDLTVELEKAATYDEICAEMKAQSQGALKGVLGYTEDK

SEQ ID NO: 66211 - protein, 451 aa, Coprinopsis cinerea okayama7#130
MQVQQPIQQPSVPMNPPKAPLPTVPQALQSTYASRMKTGVSLLVQPIFQSTTLALLSGTGRPSRRGAVINYADPGSGDDLPDAGELDSDDSEFQANGGGRSSSRQQQGRGYASPAPQANARPENEELDQSYLGMQPPARFIKAKPIPIGLGGPTMHEYPPPDRVIAQAQKRASLVPIRVEFETETHRIRDCFAWNINEDLIKPETFARIFCNDLDLPLIPWAETVANQIKAQIEEYQDVASMEIGMDSALSPEEMAEPGDELPECRVIVSIDVQIANHHLLDHIEWDLLSPLTPEEFARGLCADLGLTGEAAPLIAHAVHEELVKHKRDAVEWGVIGGPTAHDGKEATPALGEPAQPEKRDRSGYSLLKDKTGLGLGWGRAPRDGRGPKVLRSVWRDWQEAEEFSTSFDLLTAEDLEKREIERERASRRLRRETSKFQSIATGRMRNLRYR

SEQ ID NO: 66212 - protein, 429 aa, Escherichia coli
  misc_feature (274)..(274): Xaa can be any naturally occurring amino acid
MTTDDLAFDQRHILHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGKTGKLFACEHAEIAPDILCLGXALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 66213 - protein, 485 aa, Magnaporthe grisea 70-15
MPSIKRVAVIGAGPSGAITLDALAKEQAFDVIRVFERREGPGGCWIGDSAEPPHLSGFKRLADRTADLPVPIPEQIPAHGVAALTQPRFADSSIYPYLETNVQDLSMQFSQEPIPADRSELSVSLYGPSTPFRHWEVLKRYVSNVIHATPGHSEVVSYDTTVELVEKVGDEWRVVLRKADGRGGDHWWDERFDAVVVANGHYNVPYVPEVEGLEEMQRAMPGSILHSKYFRGRDQFRDKRVVVVGASVSAADIAFDIVKVAKSPVHAVFLGHTANPYFGDEAFRHPNVKMQPSIARVEVPPGGQGATVYFVDGTSASGVDYLIFGTGYSWTLPFLPQIQPKKNRVPGLYHHVVWQQDPTLLFVGAVGAGLTFKIFEWQAVLAARILAGRTSRPLPSLDEMQRWEVNRIAETGDGPKFTVIHPYFEEYFETLRELAGDGEPGLGRKLPKFDQKWLDAFMDGHELRKGMWKRINDQARDEIRPIPRL

SEQ ID NO: 66214 - protein, 525 aa, Arabidopsis thaliana
MSPLNDLKINLNGQYTFFLNQNVISKYSGSLRKMIKQSKKKRNKKKRIITIEINDFPGGPDGFELVSRFCYHNGEILIDVSNVSTLYCCSVFLGMSEKFCFSNLFLQTEKFLEEVFYGSWSDIVSCLKNCEQVFFQADSYGLVDKLIFAALNKISQNSDDFSSSSLSSFASSLSPEMAKNTSESDGRYISRSVACGRSNEWWFEDMTNLSPKIILKLVMIIGAYKTNIKSLVLTRFLLHYLKTKLQTKSRTTTELMRNKLEYSDLADTAVRGVISAGTRTFSCRKLFWILRVLSSFSLSRESRIGLETLIGEMLEQATLDDLLISARGSRESGFYNVDLVIRLLKVFVKNREEEEEESRERNMKEIGKLIDKYLREISPDQNLKVPKFLGVAESLPDSARDCFDGVYRAIDIYLQSHPNLTPQDRTEICRCLNYKKLTMETCKQLARNPKIPPEIAIEALKSRCGNQEHTTSDVKVANKSFSCRYSEEKKKPVVLHLEITEKLAERLKTKGGYNLKVMDSFREGL

SEQ ID NO: 66215 - protein, 429 aa, Escherichia coli
MTTDDLAFDQRHILHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGATGKLFACEHAEIAPDILCLGKALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 66216 - protein, 414 aa, Bacillus cereus E33L
MNTSRKVAIIGLGYVGLPLAVHLAERGHTVLGLDKDTRKIESIIKGESYIPDVSSKELQSLLTKKKLIVNTPDQGIAEFQNSDYVIVTVPTPINEQREPDLSALISASHYIQQNLQKGQTFIFESSTYPGTLEEVIIPIISQTGKKAGEDFYIGYSPERIDPANSQYSVQTIPKVISGQTEKCKQKVQALYSTIFDVVVPVSSPKVAEMCKLFENIQRLVNISLVNELNILCESLGIDFYEALEAASTKPFGFTPYWPGPGIGGHCIPVDPLYFQWRIKKNGAMSQLIEAAHVINEEMPEKMVQKVKGVVQPPATVLIVGIAYKKDVNDLRESPALPIIELLIKEGYEIEYHDPYISSAKFGDKVYQSVSLNEQAVNQAGCILILTDHSNIDWKLFKGIKQVVDTRGIVKKVSK

SEQ ID NO: 66217 - protein, 502 aa, Brucella abortus
MAEPETCDLFVIGGGINGAGVARDAAGRGLKVVLAEKDDLAQGTSSASGKLVHGGLRYLEYYEFRLVREALIEREVLLNAAPHIIWPMRFVLPHSPQIRPAWLVRLGLFLYDHLGGRKKLPGTRTLDLKRDPEGTPILDQYTKGFEYSDCWVDDARLVALNAVGARRKGSTILTRTPVVSARRENGGWIVETRNSDTGETRTFRARCIVNCAGPWVTDVIHNVAASTSSRNVRLVKGSHIIVPKFWSGANAYLVQNHDKRVIFINPYEGDKALIGTTDIAYEGRAEDVAADEKEIDYLITAVNRYFKEKLRREDVLHSFSGVRPLFDDGKGNPSAVTRDYVFDLDETGGAPLLNVFGGKITTFRELAERGMHRLKHIFPQMGGDWTHDAPLPGGEIANADYETFANTLRDTYPWMPRTLVHHYGRLYGARTKDVVAGAQNLEGLGRHFGGDFHEAEVRYLVAREWAKTAEDILYRRTKHYLHLTEAERAAFVEWFDNANLVA

SEQ ID NO: 66218 - protein, 429 aa, Escherichia coli
  misc_feature (274)..(274): Xaa can be any naturally occurring amino acid
MTTDDLAFDQRHILHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGNTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGXALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 66219 - protein, 429 aa, Escherichia coli
  misc_feature (274)..(274): Xaa can be any naturally occurring amino acid
MTTDDLAFDQRHILHPYTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGFHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGXALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 66220 - protein, 256 aa, Streptococcus agalactiae 2603V/R
MKIGIIGVGKMASAIIQGLKQTQHDIIISGSCLERSKEIAERLDVTYAESHQSLINQADIIMLGIKPQLFEKVLLPLDITKPIISMAAGISLARLSQLTRSDLPLIRIMPNINAQILQSCTAICYNNHVSDELRQLAKEITDSFGSSFDIAETNFDTFTALAGSSPAYIYLFIEALAKAGVKYGFPKEQALSIVGQTVLASSQNLLQGQNSTSDLIDNICSPGGTTIAGLLDLEKNGLTHSVISAIDATIEKAKKL

SEQ ID NO: 66221 - protein, 373 aa, Archaeoglobus fulgidus DSM 4304
MREAARLSQISTSMIRRMFEIVERAKKEGREIISLTIGEPDFDTPQEVIERACRAMNAGFTHYTSNFGLEELRSAIAERYGVDSSNVMVTAGGSEALLNASLAFIEEGSKVVIPSPNFLSYFTYAKMCGGQIVQLRTHNNGFLPDVEKLNEIIDRNVSVIFLNYPNNPTGAVIDEKDARAVVEIAADNKAIVVSDEIYDQIYYDVKPTSLAGYENVVCVNGFSKSLSMTGWRIGFTIADEKLLDPMLKVHQVNGVCAPAFAQKAVAEVMAERLFDSIVSRMVKEFRQRRDYLYSELSKIYDVVKPEGAFYMFVNVNQDCMEYAENLINLGVAVTPGLPFGDGNETYVRISYANSLENLKKAAEIIREYESQRA

SEQ ID NO: 66222 - protein, 437 aa, Physcomitrella patens subsp. patens
MKKVFSIILGGGAGTRLNPLTLRRAKPAVPLGGAYRLIDVPMSNCINSGINKIYVLTQFNSTSLNRHLSRTYNLGNGSSFGDGYVEVLAAAQRPGFGGDKWFGGTADAVRQYLWLLEDAKNKDVEEVVILSGDHLYRMDYEDFVQKHKDSGADITVSCVPMDDSRASDYGLMKINDKGRIHYFNEKPKGDELQSMQVDTTVLGLSPDEAKKKPYIASMGIYVFKKSVLSKLLKWRYPLANDFGSEIIPQAAKEFYVHAYLFNDYWEDIGTIKSFFDANLALTSPDSKFSFYDAAKPTYTSARYLPPTKIERCRVKDSIVSHGCFLRDCSVENSVIGIRSRLESGCDVKRAMIMGADFYETDPEASALQEEGKVPLGIGANTKLRNCIVDKNARIGSNVVIANTDNVFEAARPDEGFYIRSGITVICKNAVIQNGTVI

SEQ ID NO: 66223 - protein, 464 aa, Staphylococcus aureus subsp. aureus MRSA252
MACTMKVSKFGGSSVSNATQIKKVLNIVNSDPERKIVIVSAPGKRHDNDIKTTDLLIRLYEKVINHLDYHDKKREIIQRYDDIVKELQMDESILRTIDVTLEHYINQLKNEPKRLLDALLSCGEDFNAQLIALYNNSQGIPTKYISPKEAGIFVTDVPQEAQILDSAYSEIKKLRDYDEKLIIPGFFGVSHEGYIVTFPRGGSDITGAIISSGVRATIYENFTDVSGIYKANPNIIKDPELIEEITYREMRELSYAGFSVFHDEALQPLYKDRIPVVIKNTNRPQDKGTFIVHDREINAKNVISGISCDKDFTVINIKKYLMNRQVGFTRKILGVLEDNNISFDHMPSGIDTISIVMRSKQIQNKETKVLNEIRQKCDVDELSIEHDLAILMIVGEGMNKVIGTANKITHALAESKINLKMINQGASEISMMFGIHVDDAEKAVLSTYEFCYHGVALKNLCDKN

SEQ ID NO: 66224 - protein, 268 aa, Bouteloua hirsuta
ASYAAAAMPALDVLPEKPHHGWESNGAAAVAPTPAPRRLDGKVAIVTGGARGIGEAIVRLFTRHGARVVIADVDAAAGDALAAALGPQVSCVRCDVSVEDDVRRAVEWAVARHGRLDVLCNNAGVLGRQTRAAKSILSFDAGEFERVLRVNALGAALGMKHAARAMAPRRAGSIVSVASVAGVLGGLGPHAYTASKHAIVGLTKNAACELGAHGIRVKCVSPFGVATPMLINAWRQGHADAVPSDEEVEKMEEVVRGLATLKGPTLRP

SEQ ID NO: 66225 - protein, 1056 aa, Vitis vinifera
MPSETGVDDDGPYSFAMEYHGPPVTYDIPRAVPINVEKIPVATVVAQVSLSDKLSLPVVQPLLAPDPRCKMLSKEIKLGSKSTVSPTSVIAFERGSEDDGGCVSKELDLGSEATVSPTSVIAYEERAAAGHECVLSGELTSSGALEFSDNRYGSSELSDAIKALATVGSSSSSREHSNELLGGAGSSGTIEFSDRLYKSRDLSGSSGAFEVSNGCKESLDFNDLNAPDWVSTESQVSLDYPSSRVSSLKAGDCSNEPGCDVRRTPVVSFRGVALDDDTNEEFSSAEPEIVRPKKEPETKGKKGSCYRCFKGSRFTEKEVCIVCDAKYCSNCVLRAMGSMPEGRKCVTCIGYPIDESKRGNLGKCSRMLKRLLNELEVRQIMKSEKMCETNQLPPEYVCVNEKPLSQEELVLLQNCPNPPKKLKPGNYWYDKVSGLWGKVNVITFRHFVLEGQKPSKIISPNLSVGGPIRANASNGNTQVFINGREITKVELRMLQLAGVQCAGNPHFWVNEDGSYQEEGQKNTKGYIWGQVLMQAGTKLVCAVLSLPVPSKFLSPSGEQVNNFVTRTVPDYLEQRTLQKLLLIGNNGSGTSTIFKQIFRIGCSAASTPHLAPASCWLLAYIHVSTHAKILYKATPFSEDERENIKLKIQSNVYGYLGILLEGRERFEDESLIEMRKRKSYHKSDSIGNTDDENDDKTIYSIGTRLKAFSDWLLKTMVAGNLEAIFPAATREYAPLVEELWNDAAIQATYKRRSELEMLPSVASYFLERLFGINVGAISYIVILPQNLREKEKESKQATRDAIKQEEAVDILRTDYEPSDVDILYAEGVTSSNGLACVDFSFPQSEPGDDIDTADLHDSLLRYQLIRVQARGLGENCKWLEMFEDVRIVIFCVSLNDYDQYSYDANGSLVNKMMLSQRLFESIVTHPTFEQMDFLLILNKFDLFEEKIERVPLTQCDWFEDFHPVVSRNRSNSNSNNINNSPSLGQLAFHYIAVRFKTLYSSLTGRKLYVSLVKGLELNSVDETLKYAREILKWDEERANFSLSDSVYSTEPSSFSH

SEQ ID NO: 66226 - protein, 247 aa, Oryza sativa
MAASASASAPPHSLLLAAVALAALASVAAARDENGVYDPCSDTRIQRGDGFSFGIAFATLGAFYSGGSVQLSPCDRRLSLASSGQLAVFRPKVDEISLLTINTTTGFNPATAGGYMVAFAGRKYAARSVPTFVSNSSYTVSSFTLVLEFNKGRLQNLHWKKDGCGACAKSSSLVCIGKQTCAFRTQSCKSQGPVDCSIGIQLAFSGTDKHESVLNSWYEVSNLRQYSLYGLYSNLKDTLSGQFNKFF

SEQ ID NO: 66227 - protein, 268 aa, Bouteloua hirsuta
ASYAAAAMPALDVLPEKPHHGWESNGAAAVAPTPAPRRLDGKVAIVTGGARGIGEAIVRLFTRHGARVVIADVDAAAGDALAAALGPQVSCVRCDVSVEDDVRRAVEWAVARHGRLDVLCNNAGVLGRQTRAAKSILSFDAGEFDRVLRVNALGTALGMKHAARAMAPRRAGSIVSVASVAGVLGGLGPHAYTASKHAIVGLTKNAACELGAHGIRVNCVSPFGVATPMLINAWRQGHADAVPSDEEVEKMEEVVRGLATLKGPTLRP

SEQ ID NO: 66228 - protein, 268 aa, Bouteloua hirsuta
ASYAAAAMPALDLLSEKSHHGWDGTGAAAVAPTPAPRRLDGKVAIVTGGARGIGEAIVRLFVKHGARVVIADIDDAAGDALAAALGPQVSCVRCDVSVEEDVKRAVEWAVARHGRLDVLCNNAGVLGRQTRAAKSILSFDAGEFDRVLRVNALGTALGMKHAALAMAPRHAGSIVSVASVAGVLGGLGPHAYTASKHAIVGLTKNAACELGAHGIRVNCVSPFGVATPMLINAWRQGHADAVPSDEEVEKMEEVVRGFATLKGPTLRP

SEQ ID NO: 66229 - protein, 167 aa, Nocardia farcinica IFM 10152
MSSTHTLSVLVEDKPGVLARVASLFSRRGFNIESLAVGGTEIPDISRMTIVVTVEDLPLEQVTKQLNKLVNVIKIVEQDADASVARELILVKVRADASVRTQVIEAVQLFRAKVIDVSPDALTVEATGTRSKLDALLRMLEPYGIREIVQSGVVAVGRGPKSITATR

SEQ ID NO: 66230 - protein, 432 aa, Alteromonadales bacterium TW-7
MSNIVKVIGREIMDSRGNPTVEADVHLADGSWGRAAAPSGASTGTREALELRDGDKARYLGKGVLNAVGYINKEIADALAGQDALNQSAVDKVMLDLDGTENKEKLGANAILAVSLATAKAAAQSKKVELYEHIADLNGTPGVYSMPLPMMNIINGGEHADNSVDIQEFMIQPVGASNFREGLRMGAEVFHSLAKVLKADGHSTAVGDEGGFAPNLESNEAALAAIKVAVANAGYELGKDITLAMDCAASEFYDKEANIYDLKGEGKKFTSEEFNFFLQELTQQYPIVSIEDGLDESDWDGFAHQTKLMGDKIQLVGDDLFVTNTKILKRGIDNGIANSILIKFNQIGSLTETLAAIKMAKDAGFTVVISHRSGETEDATIADLAVGTAAGQIKTGSLSRSDRVAKYNQLLRIEEQLGAKAPYNGLKEVKGQ

SEQ ID NO: 66231 - protein, 464 aa, Pseudomonas fluorescens
MAVYNYDVVVLGSGPAGEGAAMNAAKAGRKVAMVDSRRQVGGNCTHLGTIPSKALRHSVRQIMQFNTNPMFRAIGEPRWFSFPDVLKSAEKVISKQVASRTGYYARNRVDVFIGTGSFADEQTIEVVCANGVVEKLVAKHIIIATGSRPYRPADIDFNHPRIYDSDTILSLGHTPRKLIVYGAGVIGCEYASIFSGLGVLVELVDNRGQLLSFLDSEISQALSYHFSNNNITVRHNEDYDRVEGVDNGVILHLKSGKKIKADALLWCNGRTGNTDQLGLENIGVKVNSRGQIEVDEAYRTCVPNIYGAGDVIGWPSLASAAHDQGRSAAGSIVDNGSWRFVNDVPTGIYTIPEISSIGKNEQELTQAKVPYEVGKAFFKSMARAQIAGEPQGMLKILFHRETLEVLGVHCFGYQASEIVHIGQAIMNQPGELNTLKYFVNTTFNYPTMAEAYRVAAYDGLNRLF

SEQ ID NO: 66232 - protein, 460 aa, Clostridium perfringens ATCC 13124
MEIFKKQSLKRILSEANENKERTLSALDLTLMSVGSVIGTGVMVLTGIVAAKQSGPATSIAFIGGGIAAAIIVLCYAEFSSSIPSAGGSYSFTYVSLGEIIAYISGLCIVIGYTLSTATVASGWGSYLLSLLDILGIKLPKTFTAIPSEGGIVNLPAMISILFIVFVISLGTKESKKVNDIMVFIKIAVIALFIGVGVFHVNTSNWHPFAPFGVKGIVTGTASLFFAYCGFDATASAAEEVKNPQKSLPLGLISSLVICTIIYIAVSLVLTGVTSYTNLNVGDALSYALKLVGQRGVAFVVSLGTVIGILAVIFAGNFTTSHILLAMSRDGLLPKFFSKVDKKDVPYTALWTVGIIGALLAGFFNLGQLANFANIAFLLTYTLVCISLIAFRKKYPHVKRGFKTPLVPFIPLLGAFSCLFLMSNLSEEIWKIFIVVLVLLIISYLVYGRKHSLINKNNDN

SEQ ID NO: 66233 - protein, 321 aa, Bacillus cereus ATCC 10987
MRIVNKKIIFFGDFGIDDAVALIYANKTCKLDIIGIVAEYGNVSREIVTENVYFLERYYATEVKIIEGAARPMTAEEPLFFPEIHGEHGLGPIIPPEMRICKRENFCELIKLIEPCPEDIIIVATGRLTTLATLFLLYPNVMDKICSYYIMGGAFLFPGNVTPVSEANFYGDPIAANIVMKYAKNATIYPLNVTQQALITPEMVDIINKEGTGQAKLIKPMIDFYYENFYKKEYPGIAGSPIHDLLPFISFINDDIFEYKKSAVWISTTNDVTRGQSVADFRKIAEPTRFDDRPIQRIAVGFNYPAFKEEFMRTILKPDCP

SEQ ID NO: 66234 - protein, 311 aa, Oryza sativa Japonica Group
MDAVAYMPVVRSGGWADIGSRHTMEDVFICSDNLMKEFGVESFEDGPSAFYGVFDGHGGKHAADFVCSNLARFIVEDEDFPREIEKALSSAFLQTDAAFADACSVNSSLASGTTALAALVVGRSLLVANAGDCRAVLCCRGKAIEMSRDHKPSCNREKVRIEASGGYVYDGYLNGQLNVARAIGDWHMEGMKACDGLGPLSAEPEVMIRNLTEEDEFLIIGCDGIWDVFRSQNAVDFARRKLQEHNDPVTCCKELVDEAIKRKSGDNLSVVVICFNSRPPPVLTTPRPRVQRSISAEGLRELQSFLDSLAD

SEQ ID NO: 66235 - protein, 594 aa, Novosphingobium aromaticivorans DSM 12444
MAGNLEPTTALSDALVILGAAGIIIPAFARFRITPIIGFILVGLVVGPFGLGSLVPQYPWLYHVTISDPAAITPFAEFGIILLLFEIGLELSFNRLWDMRRLVFGLGAMELGVSAFLLSAVLLGTGLNISGAFGLGLALALSSTALVLPIAGTHGPVGRAALSMLLFEDIALVPIIFILGAMGPVAAHSDGPSLGETLLYGGIVVAVLLVGGRLLLPRLFAQAAQTKSPELFLAATMLVVIAAALSTSLVGLSPIMGALLAGLLIAETEYHTEVESITKPFKGLALGVFLITIGMGIDLRVVWEQIGPLALAVTGVVVLKALVTMFALRAMGKERATALEAGILMASPSETTLIVLATAAEASLIDRETAQFWQIVTAIGLTITPLLAKVGETWGRRVAKGGADAGQAVAVEEPEGERVVVMGFGRVGRLVADMLSVHGASWLGIDTDPAIVKRARNDGLPVLFGNVDSETAIERLGLDNARAMILTMDEPVLVVRMVKKLRSGHPDLPIIVRARDTAHAAELYKAGATHAVPETLESSLQLSEAVLVDLGFPMGLVIASIHEKRDEFREQIMEEGGLTEKPRLKSASLRERSA

SEQ ID NO: 66236 - protein, 605 aa, Cryptococcus neoformans var. neoformans B-3501A
MSAEELVASPKLSKEEKKARKEAKKLKKAEKAAKEATAQEGVATEEVKEEVGKKDKKDKKEKKDKKRKEVDQEEAESPSTSTAATEEPPKKKKKSKDADSSETPVSTATPTESETPALSKKQQKKLAKASAAAAATSSAAAIPAPTVPTTFTAEHNTFLTSNNITLTPSLFPPLLSIRDLPINSKLQPFLNKFEKPTPIQACSWPALLSKKDVVGIAETGSGKTLAFGVPGINLLSQLPPVTGSKKGRGQVPGQIQMLVLAPTRELAQQSHEHLSAFGEQVGLKSVCIFGGVGKDGQARELSQKDTRVVVGTPGRTLDLADSGELDLSSVSYLVLDEADRMLDAGFENDIRRIIAHTPGHKEGRQTVMFSATWPESVRRLASTFLNNPLRITVGSDELSANKRIEQIVEVLDNPRDKDFRLTHHLKAHLKVHPNSKTSPTRILVFALYKKEAQRLEYTIRRAGYAVGALHGDMTQEARFKALEAFKTGQQNVLVATDVAARGLDIPDVGLVINVTFPLTTEDFVHRCGRTGRAGKTGKAVTFFTGENHEKSLAGEFMRVLRDVGAEIPKEMDRFPTTIKKKEHGSYGAFYKETSNAPAPTKITFD

SEQ ID NO: 66237 - protein, 258 aa, Ralstonia solanacearum
IANFKDIEVVAINDLLEPDYLAYMLKYDSVHGRFDGEVSVDGNTLVVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELEKSASYDEICAEMKAQSQGALKGVLGYTEDK

SEQ ID NO: 66238 - protein, 506 aa, Pseudomonas syringae pv. phaseolicola 1448A
MRYAHPGTEGAIVNFKERYGNYIGGEFVAPVKGQYFTNTSPVTGKAIAEFPRSTAEDIEKALDAAHAAAAAWGSTSVQARSLVLLKIADRIEANLEVLAITETWDNGKAIRETLNADIPLAADHFRYFAGVLRAQEGSAAEIDGNTVAYHIHEPLGVVGQIIPWNFPLLMAAWKLAPALAAGNCIVLKPAEQTPLGISVLIELIGDLLPPGVLNIVQGYGREAGEALASSKRIAKIAFTGSTPVGSHIMKLAADNIIPSTVELGGKSPNIFFEDIMSAEPEFIDKAAEGLVLAFFNQGEVCTCPSRALVQESIYPQFMEAVMRKVEKIKRGDPLDTDTMVGAQASEQQFDKILSYLDIAKGEGAELLTGGKVEKLEGSLSTGYYIQPTLLKGNNKMRVFQEEIFGPVVSVTTFKDEAEAVAIANDTEFGLGAGLWTRDINRAYRVGRAIKAGRVWTNCYHLYPAHAAFGGYKKSGVGRETHKIALEHYQQTKNLLVSYDTNPLGFF

SEQ ID NO: 66239 - protein, 364 aa, Pseudomonas syringae pv. phaseolicola 1448A
MSAVNRAAVETILRQYTDPYLNQDPVSAGCVRSIDIQGAQVSVQLELGYAADLFRNGWAQVLKTAIENLDGVSSATVAIKSVISAHKAQSQIPGLANVKNIVAVASGKGGVGKSTTAANLALALSREGARVGILDADIYGPSQGVMFGIAEGTRPKIKDQKWFVPVQAHGIDVMSMAFLTDDNTPMVWRGPMVSGALLQLVTQTAWNDLDYLVIDMPPGTGDIQLTLAQKVPVAGAVIVTTPQDLALLDAKKGVEMFRKVNIPVLGVVENMAVHICSNCGHAEHLFGEGGGEKLASQYNVELLASLPLSMLIREQADGGKPTAIAEPESQIAMVYQELARHVGARIVLQEAASPAMPTISVSDD

SEQ ID NO: 66240 - protein, 258 aa, Ralstonia solanacearum
VANFKDIEVVAINDLLEPDYLAYMLKYDSVHGRFDGEVSVDGDTLIVNGKKIRLTAVKDPAELKWGEIGADVVVESTGIFLTKEGAQKHIDAGAKKVIMSAPSKDDTPMFVYGVNHGTYKGEAIVSNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELDKPATYDEICAEMKAQSEGALKGVLGYTEDK

SEQ ID NO: 66241 - protein, 429 aa, Escherichia coli
  misc_feature (274)..(274): Xaa can be any naturally occurring amino acid
MTTDDLAFDQRHILHPFTSMTSPLPVYPVVSAEGCELILSDGRRLVDGMSSWWAAIHGYNHPQLNAAMKSQIDAMSHVMFGGITHAPAIELCRKLVAMTPQPLECVFLADSGSVAVEVAMKMALQYWQAKGEARQRFLTFRNGYHGDTFGAMSVCDPDNSMHSLWKGYLPENLFAPAPQSRMDGEWDERDMVGFARLMAAHRHEIAAVIIEPIVQGAGGMRMYHPEWLKRIRKICDREGILLIADEIATGFGRTGKLFACEHAEIAPDILCLGXALTGGTMTLSATLTTREVAETISNGEAGCFMHGPTFMGNPLACAAANASLAILESGDWQQQVADIEVQLREQLAPARDAEMVADVRVLGAIGVVETTHPVNMAALQKFFVEQGVWIRPFGKLIYLMPPYIILPQQLQRLTAAVNRAVQDETFFCQ

SEQ ID NO: 66242 - protein, 395 aa, Rickettsia sibirica 246
MRVKIIVPSLGESITEATIAKWYKKEGDSVKTDELLLEIETEKVTLEVNAPCNGTIGKISKTDGANVAVGEEIGEINEGASANTAGTNNESAKAQAVTQPTSEKPAVANNTLAPSVQKLVTENKLDPNNIKGTGRDGRITKGDVLATINTTTTSAPAISKSNEERVQRVRMSRLRKTIAQRLKDSQNTAAILTTFNEIDMSKVIALRNQYKEEFEKKHAVKLGFMSFFVKATIEALKLIPSVNAEIDGDDLVYKNYYDIGVAVGTEQGLVVPVVRDADKMGFAEVEKTIGILAKQAREGKLSMADLSGGTFSISNGGVYGSLLSTPIINPPQSGILGLHKTEERAVVIDGKIEIRPMMYIALSYDHRIIDGKEGVSFLVKIKQLIENPEKLLLNL

SEQ ID NO: 66243 - protein, 353 aa, Staphylococcus aureus subsp. aureus MRSA252
MRRWQGLVEEFKAHLPVNENTPKLTLNEGNTPLIHCENMSEILGIDLYVKYEGANPTGSFKDRGMVMAVTKAKEQGKKIVICASTGNTSASAAAYAARAGLKAIVVIPEGKIALGKLSQAVMYGAEIVSIEGNFDEALEIVKEIAKSGEIELVNSVNPLRIEGQKTGSFEIVQQLDGEAPDILAIPVGNAGNITAYWKGFKEYHEAKGSQLPKMFGFQAEGASPIVQNKVIKNPETIATAIRIGNPASWDKATNALKESNGLIDSVTDDEILEAYQLMTTKEGVFSEPASNASIAGLIKLHRQGKLPQGKKVVAILTGNGLKDPDTAISLLDNPIKPLPNDKDSIIDYIKGAL

SEQ ID NO: 66244 - protein, 154 aa, Neurospora crassa
MSNQEQTFIAVKPDGVQRGLVGNIISRFENRGFKLVAMKLTQPGQVHLELEKHYEDLNTKPFFAGLIKYMNSGPICAMVWEGKDAVKTGRTILGATNPLASAPGTIRGDFALDMGRNVCHGSDSVENAKKEIALWFKPEELNQWNHHSAAWIFE

SEQ ID NO: 66245 - protein, 473 aa, Bacillus cereus E33L
MMDQNKGLKRELKSRHIFMIALGGVIGTGLFLGSGYTIHEAGPGGAIVAYLVGGFVMYLTMLCLGELAVAMPDAGSYQTYATKHISPAAGYVVGWMSWLNWSATIGIELIAVSILMKRWFPDVPSWIWCVVFAVLLFAINALSSRSFAEVEFWFASIKVITIIAFIILGGAAMFGFLDMKGNEPAPMFSSFTDYGGLFPNGLSAILITMIAVNFSFQGTELVGIAAGESENPEKTIPKAINNTVWRILVFFVLSIFILAGLFPWQQAGVIESPFVVVFDKIGIPYAADIINFVIITAVLSVANSGLYATSRMLWSMSNQGMISPIFGKLSKNGVPIYALIVSTIVGCLSLLSGIYAEDTVYLWLLSIAGFGAILVWASIALSNLLARRSYIKRGGDVKDLKFKTPLYPFVPLLALVLNVTVIVGMAFIPEQRMALYCGIPFMIVCLLFYRATRNKAHKVEHIEKTDTTEVESL

SEQ ID NO: 66246 - protein, 484 aa, Staphylococcus aureus subsp. aureus MRSA252
MEDNKMNRSLNSRHISMIAIGGAIGTGLFVATGNIISQAGPGGAILAYLVIGVMLYFLMASIGELATFYPVSGSFSSYSTRFIDSSLGFTMGWLYWALWSLVTSVDVIVASNVLYFWDTFKFFHPITWSLIFITILLLLNIFSVKSFGETEFWLSLIKVLTIIVFVIFGFLMIFGILGGHAYGFENYTKGQAPFVGGISGFLGVLLVAGFSVGGTEVVAVTAGESDDPKKSMPKAIKQVFWRILLFYVLSIAVIGAIIPYTDPSLLRASSSISQSPFTIVFDRVGIAFAASVINAVILTSLLSAANSGVYTTGRMLYSLSSDKKAPKFLSKLNKTTKLPLRALLTTYAVVVIVIIYANFNSNAVFNLLEIIGSMIIVVWGSSIWSQIRLRQAIKKQGQDPNKVLPYKAPFYPLGPIIVIATLLFLLFGGSVEYILKDQWLNAFKNFLPLIILALIYFIHKIIHKTKFVKLETINLKPHDYDNQK

SEQ ID NO: 66247 - protein, 459 aa, Moorella thermoacetica ATCC 39073
MSYQIAIIGGGPGGYVAAIRAAQLGAKVVVIEQDALGGTCLNRGCIPTKALLAGAAMVRGIKGAAAFGIDVEDYRVDYARLAARKDAVVKQLTGGIAYLFKKNKVDLIKGRGFLKGPGQIEVATADGTIENLQAENIILATGSEPALIKALGYNGRTVVTSTEALAWTEVPAELLIIGGGVIGCEFATLFATLGSKVTIVEMMPAILPMIDSEISRRFSMLLKKTGVEIKTKAQITEVKEAGGRVQATLADGQTINADKVLISIGRQFNTRGLGLEDAGITLGPKGEIVVDEYLRTSVPGIYAIGDVTNKIQLAHVASAQGLAAVTTIMGRPTKVNYDAVPSCIYTLPEIAGVGLTKEAAEGRGMKVRVGKFPFQASGKALCSGETDGMVKIIAEAESDRVVGVFIMGPHATELIAEGALAVNKGITAGELAATIHAHPTLSEAVMEAAEAVHGLSIHS

SEQ ID NO: 66248 - protein, 128 aa, Zea mays
  misc_feature (72)..(72): Xaa can be any naturally occurring amino acid
  misc_feature (104)..(104): Xaa can be any naturally occurring amino acid
MVLSHGVGGSDESVHSTFASRYVRTSLPRYRMPEQSIHVDAASGGFIAPFLYPELEWDFRLPLVKSINVSGXKYGLVYAGIGWCIWRTKEDLPGELIFHINYLXADQPTFTLNFSKGASLGSLFFLGL

SEQ ID NO: 66249 - protein, 420 aa, Vitis vinifera
MNLGSSDCSSFLRKEKRNPFMKTKSFGRINMAIAVNTSRFEGVTMAPPDPILGVSEAFRADNSEMKLNLGVGAYRTEELQPYVLNVVKKYLPIEGLAAFNKVTAELLFGAGNPVIEQQRVATVQGLSGTGSLRLAAALIERYFPGAKVLISSPTWGNHKNIFNDARVPWSEYRYYDPKTVGLDFDGMISDIKSQFSETLIPSGHLLFRPSFIPAKSLWPSLNPTISLSGHLSFRSSVPVLRAKGENAFQSVKSSSQNIHRRQLFRRQFFLHRKERLEEISNFSQSTGAKKPSKRRPRAFFRPAREPLSSDALPPPGSPDADQPPFLPVSSIRALHWSQSVLLFICGKGKDEYLTGEAAMPETTEPGFKKWKIENSMIMSWLINSMNNDIGENFLLFGTTKDIWDATKETYSSSKNTSELF

SEQ ID NO: 66250 - protein, 151 aa, Synechococcus sp. RS9917
MAERTFIAIKPDGVQRGLVGEILGRFERKGFKLVGLKQLTPSRELAEQHYGVHKERPFFAGLVDFITSGPVVAMVWEGDGVIASARKLIGATKPLEAEPGTIRGDLAINIGRNVIHGSDAPETALFEIGLWFQPSELSDWSPSDQGWRTEG

SEQ ID NO: 66251 - protein, 711 aa, Neptuniibacter caesariensis
MKLFLTCPKGLELLLEEELQQLGISETKQTVAGVQCQGELEDAYRICLWSRLANRVLMPLWEGEAETADDLYQSVQQVDWLSHMRSEGTLLIDFSGQTRGINNTHFGALKVKDAIVDQIRDKTGARPSIDKVAPDLRINVRMHRGKITVALDLSGDSLHRRAYRLKAGEAPMKENLAAAVLIRSGWPQRSEDNAVLLDPMCGSGTLLIEAALMAADIAPGLQRKRYGFSRWTGHHKEIWDGLIAEAKARKAKGLLALSAQLVGRDQDKQVLRSARQNAERAGVAEFIDFATCRLEDLERSALPEGNGLLVTNPPYGERLGETQQLMFLYRHLGDKLKAQFAGWTAAIFTSNPDLCKVMGLRADKQYKLFNGALESRLFVYPVSERREKAEEPGEVKLSDGAQMFANRLLKNKKQLAKWVKREEIECYRVYDADIPEYSVAVDLYGDEVHVQEYQAPKKIDPVKTFARLQDVMNALPVALQIPAEKVILKQRKKQQGSSQYEKHSETHRFKEMNEHGCRLLVNLHDYLDTGLFLDHRPIRYRIQQEAAGKDVLNLFCYTGTASVHAAKGGAKSTTSVDMSATYLNWAKRNMDLNGLDNEQNLQVQSDCLKWLRVQRGEAYDLIFMDPPTFSNSKRMEGVLDVQRDHVDLIDGAMRLLRKEGVLYFSNNYRRFKIDHDALADYQIEEITRATLDPDFKRNDKIHCCFRITHKA

SEQ ID NO: 66252 - protein, 235 aa, Populus trichocarpa
MEQQFDINERMRGILIDWLIEVHYKFELMEETLYLTVNLIDRFLAVQPVARKKLQLVGVTAMLLACKYEEVSVPVVEDLILISDKAYSRKEVLDMEKLMVNTLQFNLSVPTPYVFMRRFLKASQCDTKLELLSFFIVELCLVEYDMLKFPPSLLAAAAIYTAQCTLSGTKQWSKTNEYYTSYSEEQLRECSRLMVNFHRNSGTGKLTGVHRKYSTSKFGYAVKNEPANFLLEAQF

SEQ ID NO: 66253 - protein, 352 aa, Bipolaris oryzae
MPPAGSGSSRKISFNVSEQYDIQDVVGEGAYGVVCSALHKPSGQKVAIKKITPFDHSMFCLRTLREMKLLRYFNHENIISILDIQKPRNYETFTEVYLIQELMETDMHRVIRTQELSDDHCQYFIYQTLRALKAMHSANVLHRDLKPSNLLLNANCDLKVCDFGLARSAASTEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKIPWKAMFPKTNDLALDLLERLLAFNPVKRISVEDALKHPYLEPYHDPDDEPGADPIPEEFFDFDKNKDNLTKEQLKLLIYQEIMR

SEQ ID NO: 66254 - protein, 452 aa, Arabidopsis thaliana
MGKENAVSRPFTRSLASALRASEVTSTTQNQQRVNTKRPALEDTRATGPNKRKKRAVLGEITNVNSNTAILEAKNSKQIKKGRGHGLASTSQLATSVTSEVTDLQSRTDAKVEVASNTAGNLSVSKGTDNTADNCIEIWNSRLPPRPLGRSASTAEKSAVIGSSTVPDIPKFVDIDSDDKDPLLCCLYAPEIHYNLRVSELKRRPLPDFMERIQKDVTQSMRGILVDWLVEVSEEYTLASDTLYLTVYLIDWFLHGNYVQRQQLQLLGITCMLIASKYEEISAPRIEEFCFITDNTYTRDQVLEMENQVLKHFSFQIYTPTPKTFLRRFLRAAQASRLSPSLEVEFLASYLTELTLIDYHFLKFLPSVVAASAVFLAKWTMDQSNHPWNPTLEHYTTYKASDLKASVHALQDLQLNTKGCPLSAIRMKYRQEKTYYGFAVQICGGSHVSKAT

SEQ ID NO: 66255 - protein, 399 aa, Bacillus cereus ATCC 10987
MTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETGIQMAGATSYYMPLKKNNGFLPNLELIPEEIADKAKMMILNFPGNPVPAMAHADFFKEVIVFAKKHNIIVVHDFAYAEFYFDGNKPISFLSVPGAKEVGVEINSLSKSYSLAGSRIGYMIGNEEIVRALTQFKSNTDYGVFLPIQKAACAALKNGAAFCEKNRGIYQERRDTLIDGFKTFGWNVDKPAGSMFVWAEIPNGWTSIDFAYALMDRANVVVTPGHAFGPHGEGFVRIALVQDKEVLQQVIENIRNSGIFSLEKINELVKN

SEQ ID NO: 66256 - protein, 464 aa, Novosphingobium aromaticivorans DSM 12444
MKFADLGLSDELLKSVLDAGYDEPTPIQAQAIPAVLMMKDIIGIAQTGTGKTAGFVLPMIDILAHGRRRALMPRSLILEPTRELAAQVAENFEKYGKNHDLKMALLIGGVQMGDQVKALQEGVDVLIATPGRLMDLFERGKILLTGCEMLVIDEADRMLDMGFIPDIENICSKLPTTRQTLLFSATMPPPIKKLADKFLSNPKSIEVARPAATNTNIAQFKVRSTTRQKREVLRHLLRTDNVSTAIIFANRKTTVRELAKSLQRHGFAAGEIHGDMDQSARNAELQKFKDGEISILCASDVAARGLDVKGVSHVFNFDTPWHPDDYVHRVGRTGRGGATGRAFTLVSDEDSESIENVEKLQGTKIPEFKVELPGKEERKPRESGAERDEEPKRGSRRERPAREERKPRAERESRPEREARPEREVRAERAPRREPTPYRDQSEPPSKPGEWNGPIPEFLAVSAL

SEQ ID NO: 66257 - protein, 483 aa, Schisandra chinensis
GPGVSTLEEKNLGRITQIIGPVLDVAFPPGKMPNIYNSLVVKGRDTVGQQINVTCEVQQLLGNNRVRAVAMSATDGLMRGMKVIDTGAPLSVPVGGSTLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNISRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTSQRYKELQDIIAILGLDELSEEDRLTVARARKIERFLSQPFFVAEVFTGSPGKYVGLAETIRGFQLILSGELDGLPEQAFYLVGNIDEATAKAMNLE

SEQ ID NO: 66258 - protein, 128 aa, Brassica napus
MSSTPGAAAPSSSKSKATGSSQAPEKRKPLFQKELQHMMYGFGDEQNPLPETVALVEDIVVEYVTDLTHKAQEIGTKRGRLLVDDFLYLIRKDLPKLNRCRELLAMQEELKQARKAFDVDEEKITSLD

SEQ ID NO: 66259 - protein, 481 aa, Papaver somniferum
SLVAVVITTFLYLIFRDSSPKGLPPGPKPWPIVGNLLQLGEKPHSQFAQLAETYGDLFSLKLGSETVVVASTPLAASEILKTHDRVLSGRYVFQSFRVKEHVENSIVWSECNETWKKLRKVCRTELFTQKMIESQAEVRESKAMEMVEYLKKNVGNEVKIAEVVFGTLVNIFGNLIFSQNIFKLGDESSGSVEMKEHLWRMLELGNSTNPADYFPFLGKFDLFGQSKDVADCLQGIYSVWGAMLKERKIAKQHNNSKKNDFVEILLDSGLDDQQINALLMEIFGAGTETSASTIEWALSELTKNPQVTANMRLELLSVVGKRPVKESDIPNMPYLQAFVKETLRLHPATPLLLPRRALETCKVLNYTIPKECQIMVNAWGIGRDPKRWTDPLKFSPERFLNSSIDFKGNDFELIPFGAGRRICPGVPLATQFISLIVSSLVQNFDWGFPKGMDPSQLIMEEKFGLTLQKEPPLYIVPKTRD

SEQ ID NO: 66260 - protein, 430 aa, Bordetella parapertussis 12822
MRACQPEYEMSLIVQKYGGTSMGSVERIKNVARRVAKWHAAGHKVVVVPSAMAGETNRLLSLAREISPQPDGRELDMIAATGEQASSGMLAIALQAEGVPARSYAGWQVPVRTDSSYTKARIKSIDDKRVLADLDAGRVVIVTGFQGVDDDGHITTLGRGGSDTSAVAVAAAIKADECLIFTDVDGVYTTDPRVVPEARRMAVVSFEEMLEMASLGSKVLQIRSVEFAGKYHVPTRVLSSLTDPLIPLEEEMRSGTLITFEEDEKMEAAVVSGIAFSRDEAKITLLAVPDKPGIAYSILGPVAAANIDVDMIVQNQSVAGTTDFSFTVNRNEYQRTLDLLKREVIPAVSARELVTDEKVAKVSIVGIGMRSHVGVASLMFQTLSQEGINIQMISTSEIKTSVIIDDKYMELAVRSLHKAFGLDQVPGDQV

SEQ ID NO: 66261 - protein, 672 aa, Coprinopsis cinerea okayama7#130
MTFDQQQILRNFREELVAEGILHEGDTIGSDQTTLLRFLRARRYNIQLAKTQFRECQEWRQTVQGIGIDELYRRVDPFNYPERDVIFQSWPMWYHKTDKQGRPIHIQVVGEMGMRKLHKLCPPQKHWEAVLVICESLPRELLPAASRAAGKSIEKAFVIVDLKGFGFEQFWQMKSILRGALQISQNYYPDTMGKLVVINAPASFSKIWPVLRRWLSDDTAEKVEILGDNFAEILLEYVDAENLPITRSASTSPSSADSTVEPSQTSPASPTPTNASGKFVVAHHMLAHASGIDGFALNTGREVWEPERIADAYQAALELGHDFKLFLSLDMASLPCNSHEDAAYLRRLVSQHASHPNQLMYNDKAFVSTFAGESCQFGHDNVVEGWKHQFTLHPELKERIYFVPSFFMDPARFGEFKDVMDGTFNWNSGWPIQVTTSFAREQLDKLAEAAPSESSRVGRLPLLANPLQRAFVFLADQHLYAKRWESLVESRDKFDIVQILTWNDFGESHYIGPIKGAQPNSEAWTDGMPHTAWLDLTSYYARAFKTGEYPKIEKDKIFMWSRPHSTEAESPDPVPKPDNFELMEDAIWAVVMTTKPSTVVLSTSPTSRTFFQVPAGVSKLSVPITPGGTMRGTIERDGAVIVDLHPSSEEFTFQGSPQSYNFNVFVASATAS

SEQ ID NO: 66262 - protein, 424 aa, Chlamydomonas reinhardtii
MQCLDKSRMMQASSRCASGSRSVPARVSSRASAVSVRCTIQEARPASTPAAASTPALNGVASPVAGAVPPIALPRGAVPNRPILEVPDWENQYRRHTASARHGSAGTPGSLSRLRLFSGTSNPTLATEVAHYLGLELGKIKCKRFADGEIYVQVQESIRGCDVFLIQPTCPPVNDHLMELLITIDACRRASARSITAVIPYYGYARADRKVQGRESIAAKLTANLITEAGADRVLAIDLHSGQCVGYFDIPVDHVYGETVILDYLASKRIATGDLVVVSPDVGGVARARAFAKKLNDAPLAIVDKRRSAHNVSEVMNLIGDVKGKVAVLVDDMIDTAGTITNAAKVLQKEGAREVYACATHAVFSPPAVERLSSGVFQEVIVTNTIPVPPENVFPQLTILSVANLLGETIWRVYNAASVQALRD

SEQ ID NO: 66263 - protein, 355 aa, Schizophyllum commune
MGGCASKPVDLEAKARSDDIDKMIEEDGKRLKKECKILLLGSGESGKSTIVKQMKIIHQDGFSQDELIAYRPIIHRNVLDSAKAILVHMKKLSVECEDFKNRPLQDKILDYQLDETTNLTISPDIAEAIDAFWKDPAVTRIIDEQTSHFYLMDSATYFFTEVLRIGEPNYIPTETDVLRARAKTTSITETRFTMGPLSIHMFDVGGQRSERKKWIHCFESVTSIIFCTALSEYDQSLLEEKNQNRMAESLVLFESIINSRWFLRTSIIIFLNKIDVFKLKVHKVPLERYFPEYTGGKDPNKAAKFILWKFMQANRAGLSVYPHLTQATDTSNIRLVFAAVKETILQNALKDSGIL

SEQ ID NO: 66264 - protein, 504 aa, Oryza sativa
  misc_feature (164)..(164): Xaa can be any naturally occurring amino acid
  misc_feature (207)..(207): Xaa can be any naturally occurring amino acid
MALAILARRRAAEALLRRPLGAAGVSALRASYAAVAGEESDVVVVGGGPGGYVAAIKAAQLGLKTTCIEKRGTLGGTCLNVGCIPSKALLHSSHMYHEAKSSFAHHGVKFSNLEVDLPAMMAQKDKAVAGLTKGIEGLFKKNKVTYVKGFGKLASPSEVSVASXDGGSTVVKGKNIIIATGSDVKSLPGVTIDEKKIVSSTGALWLXQQIPKKLVVIGAGYIGLEMGSVWNRLGSEVTVVEFAPDIVPSMDGEVRKQFQRMLEKQKMKFMLKTKVVGVDTSGDGVKLTLEPAAGGEQSVIEADIVLVSAGRVPYTAGIGLESVGVETDKAGRILVDKRFMTNVNGVYAIGDAIPGPMLAHKAEEDGVACVEFIAGKEGHVDYDTVPGVVYTHPEVASVGKTEEQVKALGIPYRVGKFPLLANSRAKAIDDAEGLVKVVAEKETDKILGVHIMAPGAGEIIHEAVLALQYGASSEDIARTCHAHPTVSEALKEACLQTFTKAIHI

SEQ ID NO: 66265 - protein, 448 aa, Bacillus pumilus SAFR-032
MEQQELKRDLSNRHVQLIAIGGTIGTGLFLGSGKAIQLAGPSIIFAYFIVGMAIFFVMRALGELLLSKTGYQSLTDIAEDYLGPWASFVTGWTYWFCWIMTAMADVIAVGVYVQYWFDIPQWIPAIICLLILLGFNLLTVKLFGEMEFWFALIKVITILLLIGVGIVLLIIGFQTDAGPVTVTNLWSHGGLFPHGVTGFLLSFQMVIFAYVGVELVGVSAAETANPQKNIPSAINKIPLRILFFYVGAIFVLLCINPWTELSASESPFVKTFGLIGIPVAAGLINFVVLTSAASACNSGMFSTSRILYNLSHQKQGPSSFGRLNKHAVPSNALFVSTIVVSVGALLSKLIPEQAFGIVTTISAICFIWVWSIILICHLKYKKTKPELHAASTFKAPFTPFVNICVLVLFAAILVIMLFADATRPALLLTPVWFGFLLLIYARKKRRAS

SEQ ID NO: 66266 - protein, 473 aa, Lactobacillus plantarum WCFS1
MTKLQSVNYQQLTWPLIIGLIIWLSAPFRPAGLSLLAWHMLALFVGTIIGCITQPLPIAGVAIIGLTLGVLLGVTSMTDAMAGFGDNTVWMIAMAYFLSRGFVKTGLGRRVALVFVKLFGKKTLGLAYALIGVDLVTSPATPSNTARAGGIVFPIIESLAKAYGSDPQNGTQRKVGSFLIMSAFHGNIATSGLFMTAMAPNLVAVALAQAMQIHITWMDWLLAALLPGLICLISVPAIIYWLYPPEIKDTPNAHAWAANELEQMGAMTLAEKLMGGIFMLALFLWISASLTGLDATLVAFIAVTLLLLTGVLSVDDLLHENGAWNTLVWFSILIFMAGKLNSLGFIPWLSQTMGQALQGISWLWVLAALMLVYFYSHYLFAGATAHVSAMYGAFLGVAISAGAPPMLAALLLGFDGAIFSSTTHYANGPASIMFGSGYITQSEWWRLNLCLGGFYLLVWGVGGTLWMKLLGYW

SEQ ID NO: 66267 - protein, 412 aa, Triticum aestivum
  misc_feature (37)..(37): Xaa can be any naturally occurring amino acid
TAAASVGLYIDCGSIYETPASSGASHLLERMAFRSTXNRSHLRLVREVEAIGGNVSASASREQMSYTYDALKSYAPEMVEVLVDSVRNPAFLEWEVKEQLQKIKSEISEVSSNPQGLLLEALHSAGYSGALAKPLMATESAIRRLDISTLEEFIHENYTAPRMVLAASGLEHDELVSIAEPLLSDLPGVKRHEEPKSVYVGGDYRCQADSPNTHIALAFEVPGGWRQEKTAMIVTVLQMLMGGGGSFSVGGPGKGMHSRLYLRVLNKYDQIESFSAFNSIYNDSGLFGIHAATSPDFASTAVDLAAGELLEVATPGKVTQEQLDRAKEATKAAVLMNLESRIVASEDIGRQVLTYGQRKPVEYFVRAVEATTLDDISTVAQKIISSPLTLASWGDVIHVPSYESVSRKFLSK

SEQ ID NO: 66268 - protein, 119 aa, Brassica napus
PRVRKTLATSDNTRSISVLPSAAVKSRAAGFERRTKRRLSQTKASVCVSGEEEDDEEEELKEKFEALQRIIPGGTALGVDALFEETAGYIMSLQCQIKTIKVLTSFIQRLDKQDMKFGG

SEQ ID NO: 66269 - protein, 354 aa, Bacillus cereus E33L
MESMFNKIFLIVALIGVPLSVLGKTLHWPQTIMFAVYCITIIALAGFMGRATESLAIVSGPRIGGLLNATFGNAVELIISIFALQAGLIEVVLASLTGSVLGNLLLVGGLSFFVGGLKYKRQSFNVYDARHNSALLIFAVVVAFVIPEIFSMKMDASKTYQLSIGVSIIMIIMYLAALLFKLVTHRGVYQHKSDEVAHEEEPEWSKGKALLILAIATIAVAYVSEALVHTFETVAKSFGWSELFIGVIIVAIVGNAAEHASAIIMAYKNKVNIAVEIAVGSTLQIAMFVAPVLVLLSMFFAQRMPLVFTIPELVSMITAVFLTIAISNDGDTNWFEGGTLLAAYVIMGIGFYLL

SEQ ID NO: 66270 - protein, 170 aa, Bacillus sp. SG-1
MDLKQYVTIVEDWPKEGIKFKDITTLMDNGDAYKYATDKIVEYAKEKEIDLVVGPEARGFIIGCPVAYALGVGFAPVRKPGKLPRETIKVEYGLEYGKDALTIHKDAIKPGQRVLITDDLLATGGTIEATIKLVEELGGIVAGTAFLIELTYLDGREKLEGHDIMTLMQF

SEQ ID NO: 66271 - protein, 68 aa, Glycine max
  misc_feature (49)..(49): Xaa can be any naturally occurring amino acid
MARPTTLECSGCPRLRALTLDALGLIKVVEARDKQRGAPLVVERWGDPXSSRCVMAVSMIDRKSHPLL

SEQ ID NO: 66272 - protein, 292 aa, Triticum aestivum
HRCFTNPVLSTFFRSVKVLPVNRGEGIYQKGMDMALSKLNNGGWVHIFPEGSRSRDGGKTIAPAKRGVGRLIMDADSLPVVVPFVHTGMQDIMPVGKRIPRTGQRVIVVVGDPINFDDLMAENSNDSQHISRGDLYDKVTERIGQRLQQLKVEVDRLAAEQKAELQNRHTDNTVNDGYKVWQQVDWESFGIGNMLSSAEHSSAARAAKADPARKPEPRLEEEQSVFSPISRVPHWFSRHMDASELMGFAARGLVRNGRSMQEGYRQFQEPSAFNAWWEAQTSSAMMPRWSTA

SEQ ID NO: 66273 - protein, 408 aa, Klebsiella pneumoniae subsp. pneumoniae MGH 78578
MSSVDILVPDLPESVADATVATWHKKPGDAVVRDEVLVEIETDKVVLEVPASADGILDAVLEDEGATVLSRQILGRLREGNSAGKESSEKADAKASTPAQRQQASLEEQNNDALSPAIRRLLAEHNLDPAAIKGTGVGGRLTREDVEKHLAKAPAPAEAKAPAAAPAAAPAPQLGHRSEKRVPMTRLRKRVAERLLEAKNSTAMLTTFNEVNMKPIMDLRKQYGEAFEKRHGIRLGFMSFYVKAVVEALKRYPEVNASIDGDDVVYHNYFDVSMAVSTPRGLVTPVLRDVDLLGMADIEKNIKELAVKGRDGKLTVDDLTGGNFTITNGGVFGSLMSTPIINPPQSAILGMHAIKDRPMAVNGKVEILPMMYLALSYDHRLIDGRESVGFLVAIKELLEDPTRLLLDV

SEQ ID NO: 66274 - protein, 388 aa, Klebsiella pneumoniae subsp. pneumoniae MGH 78578
MNLHEYQAKQLFARYGLPAPVGYACTTPREAEEAASKIGAGPWVVKCQVHAGGRGKAGGVKVVKSKEEIRAFAEHWLGKRLVTYQTDANGQPVNQILVEAATDIDKELYLGAVVDRSSRRVVFMASTEGGVEIEKVAEETPHLIHKIAIDPLAGPMPYQGRELAFKLGLEGKQVQQFTKIFMGLATIFLERDLALIEINPLVITKQGDLICLDGKLGADGNALFRQPDLREMRDQSQEDPREAQAAQWELNYVALDGNIGCMVNGAGLAMGTMDIVKLHGGEPANFLDVGGGATKERVTEAFKIILSDDNVKAVLVNIFGGIVRCDLIADGIIGAVAEVGVNVPVVVRLEGNNAELGAKKLADSGLNIIAAKSLTDAAQQVVAAVEGK

SEQ ID NO: 66275 - protein, 179 aa, Bdellovibrio bacteriovorus HD100
MGKIKVGVVTARWNQEITSKLEEGAISYLEACEDVEIFAALVPGAVEIPLACQAFLEAGCDGVVALGVVIRGDTSHYDYVCNSVTDGVTRLMLDYKKPIGFGVLTTENEEQALARAGGDHGNKGEEAAQVTMEMIGLTQEIPAAMKTALMLAKKAPAKAAKKPAKAAAKTQKKKKKVRK

SEQ ID NO: 66276 - protein, 376 aa, Bdellovibrio bacteriovorus HD100
MEFNTIPEIIDDVRNGKMVILVDDEDRENEGDLILAAEFATPQNINFMVKEARGLVCLCLTAQQVERLQLPLMVRDDLNFAPNKTAFMVSIEASEGISTGISAADRALTCRVAANPHAKPSDIHMPGHIFPIRAQQGGVLKRAGHTEASVDLARLAGLNPAAVICEVMNDDGTMARVGDLREFAKKHDIKIGTIVDLIAYRLANETLVEELHSVPLPASFGENMQARVFRSTVDGLEHLVIQKGEIKKDHPTLVRVHVDNFTRDFMAVVQRGASSVLESIKAISQEESGAFVLLRGNNRTSGLTQELNVLVGLEDIRPTTPLMDERDYGIGAQILREIGANKIRLLTNKPEKKVGLKAFDIEIVEIVAMENLKGPK

SEQ ID NO: 66277 - protein, 435 aa, Oryza sativa
  misc_feature (52)..(52): Xaa can be any naturally occurring amino acid
MASPSLAAAAASPLTSLDLATSPATASRPAAAAASALRKRPVLLLDQRHHPXKKAGHTSSSTRPRWQTALSVAAKNAVLLAVLLYVGDLAWRAARPAPPRPVDQAAMAGYDARVADVEASLARAFRMLQVQLEAVDRKIDGEVGAVRGELAALLEEKRLELEGQLKRLDARADDLSDALGALKRMEFLRKDEFDKFWNEVKESLGSGPGTEVDLDQVRALAREITMGEIEKHAADGIGRVDYAVASAGGKVVRHSDAYDAGKRGGFFSSLLSGDTAASPKKILQPSFGEPGQCFPLQGSSGFVEIKLRKGIVPDAITLEHVSKDVAYDMSTAPKDCRVSGWYQEAHNEAYSGHAASAKMYVLTEFTYDLDKKNVQTFDITAPDVGIINMVRLDFTSNHGSSALTCIYRIRVHGHEPVKQPKISCNSTWNSCPLSN

SEQ ID NO: 66278 - protein, 356 aa, Prunus domestica subsp. insititia
QMGLAENQVSFDLLEKYLEEHSEASNWGSKGGPCFRENALFQDYHGLVSFRKAMASFMGQIRGERAKFDPDRIVLTAGATAANELLTFIIADPGDALLVPTPYYPGFDRDLRWRTGVNIVPIHCDSSNNFQITPQALEAAYKDAEAKNMRVRGVLITNPSNPLGATIQRVVLEEILDFVISKNIHLVSDEIYSGSTFSSSAFVSIAEILEARQYKNSERVHIVYSLSKDLGLPGFRIGTVYSYNDKVVTTARRMSSFTLISSQTQHLLASMLSDKEFTENYIKTNRERLRKRYVMIIEGLKKAGIECLKGNAGLFCWMNLSPLLEKPTRGGELALWDSMLHEVKLNISPGSSFHCN

SEQ ID NO: 66279 - protein, 220 aa, Prunus domestica subsp. insititia
GRPAGGREFTSDWHGSEVAVKILMEQDFHAERFKEFLREVTIMKRLRHPNIVLFMGAVTKPPNLSIVTEYLSRGSLYRLLHKPGAMEALDERRRLNMAYDVAKGMNYLHRRNPPIVHRDSKSPNLLVDKKYTVKVCDFGLSRLKANTFLSSKSAAGTPEWMAPEVLRDEPSNEKSDVYSFGVILWELATLQQPWGNLNPAQVVAAVGFKNKRLEIPRDLN

SEQ ID NO: 66280 - protein, 309 aa, Streptococcus agalactiae 2603V/R
MRCSTKEMRLVYRDFLLQANQENKQITVLEADLSSSMSTNALASEFGKRYINLGIMEAEMVGLAAGLAIKGYKPYLHTFGPFASRRVFDQVFLSLGYSQLSATIIGSDAGISAEMNGGTHMPFEELGLLRLIPKATIFEVSDDIQFEAILKQTLSIDGLKYIRTIRKAPTAVYEGREDFSKGFIQLRQGKDITLVASGIMVSRAIEAADYLKELGIEASVIDLFKIKPLPEELKPLLIDQSIVTIENHNRIGGIGSALCEWLSMEKDTTVSRMGIDERFGQVGQMEYLLEEYGLAVKDIVQHCKSIYKS

SEQ ID NO: 66281 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLSLGEINKAFDLLHEGTCLRCVLDTSK

SEQ ID NO: 66282 - protein, 472 aa, Lactobacillus plantarum WCFS1
MTLNKVKYRDFIAPLLVGLIIWLSSPIKPASVSMNAWHILAIFVATIIGCITRPLPIAGVAIIGLTLTVLLGIVPMDTAVAGFGSSTVWMIAMAYFMSRGFINTGLGRRVALVFVRLFGKRTLGLAYALIGVDLVTAPATPSNTARAGGIVYPIIQSLAETFGSDPKDGTQSKIGSFLVFAEFHGDLITSTMFMTAMAPNLVAVTLAKSLHITLSWMQWFLAGIVPGLICLLVVPYLIYKMYPPEIKDTPNAKQWADDELAKMGKMSLPEKIMGGVFLLALVLWMLSSFIGLEASLVAFMAVSLLLVAGVLSVDDVLHETGAWNTLVWFSILIFMANELNKLGFIPWLSGAIGGALKGFSWGIVLAALVLFYFYSHYLFASGTAHVSAMYGALLGVAVSAGAPATFAALILGFTGSIFASTTHYANGPASVLFGSGYVTQGKWWQLNFILGLFYLVVWGGIGALWMKVIGIW

SEQ ID NO: 66283 - protein, 194 aa, Streptococcus agalactiae 2603V/R
MGWWKESIAIVKEQDPAARSSLEVILTYPGIKALAAHRLSHFLWNHNFKLLARMHSQFWRFWTQIEIHPGATISEGVFIDHGSGLVIGETAIVEKGAMLYHGVTLGGTGKDKGKRHPTIRKGALISAHSQIIGPIEVGENAKVGAAAVVLADVPADVTVVGVPAKVVRVHGQKDDLQIRSIEHDREESYYSSKL

SEQ ID NO: 66284 - protein, 386 aa, Lactobacillus plantarum WCFS1
MVEQDEILKLHAAHTGVLDIHSDLAVTDKADLGKAYTPGVAVISKLIAAHPELKAKYTMSGKLVALITDGSAVLGLGNIGPAGGLPVVEGKALLYKNLAGINAIPLALNQVSVPAMVATIKNMSLSFAGIHLEDITAPKCFELEAALKDELDIPVYHDDQEGTAIVVLAGLINAAHVVGKSLRQMRIVVNGVGASGLATARLLAAVGVKQLTLVDVYGVVTADDQRYNQYQRNLAKQLGTPAQLKGQPLAKVMADQDVFIGLSDANVLSAGAVHLMNHDPIVFALANPVPEINPAVAEKAGATVIATGSSQYPNQVNNILAFPGLFKGLLTNGVKQVDNALQIQVAQALAKTVSNPTATTIVPSVFDSQVVPNVTAAVAAYAQAQH

SEQ ID NO: 66285 - protein, 655 aa, Bacillus sp. SG-1
MKRAYYIEVNEMILLQVNQIVKSFGAEVILSNIKLELQNRDRIALVGRNGAGKSTLLKIISGQLSYDSGEIIKPKEVSIGYLAQHTGLESGLSIWDEMLSVFDDLRKLEEDLRKLEQQMADPAVYEHEEKYNRVLKEYDTIQVEFKESGGYQFEADIRSVLHGLNFAGFDYNTPISTLSGGQKTRLALGKLLLTKPDILILDEPTNHLDIDTLSWLEQYLQGYEGAILIVSHDRYFLDKVVNQVYEVSRSNSKKYHGNYSQFLEMKAEMYEREMKQFERQQEEVAKLQDFIQKNIARASTTKLAQSRRKKLEKMQMMDRPQGDEKSATFSFTIDRQSGNDVLKVNDLAIGYGNDVVSSSINMTMSKGDSVALVGPNGVGKSTLLKTLIKRLQPIKGSFTFGSNVSVGYYDQEQAELSSNKTVLNELWDEYPMKDEKEIRTILGNFLFSGEDVLKPVTALSGGEKARLALSKLMLQKANLLILDEPTNHLDLDSKEVLESALIDYPGTILFVSHDRYFINRIATKVIELSSDDATEFLGDYDYYLQKKSEILELALLENSNKVQSQGPVKTEKQNYQLDKEAKKLERQRKRRVEELEALMEELEETIGKLETELCDPEIFQDHEKVIKLNQAMEESKNALEEYMEEWTEIEELLQS

SEQ ID NO: 66286 - protein, 347 aa, Schizosaccharomyces pombe
MDTAIEDRPGQTLTDDHQVKVAIKATGICGSDVHYWKEGGIGDFILKKPMILGHESAGVVVEVGKGVSSLKPGDPVAVEPGCVCRLCDYCRSGRYNLCPHMEFAATPPYDGTLRTYYITTEDFCTKLPKQISVEEGALFEPMSVAVHAMTRGNLKCGSRVLVMGCGTVGLLMMAVAKAYGAIDIVAVDASPSRVEFAQKYVGAKPFTPIAAKENESLPDYAQRYKQAIIEKYGEFDFAVDATGVGICIHTAVLALKRGGTFVQAGNGKPVIDFPINHIINYEINVLGSFRYAHGCYKQSLFLVSNGLVDVKPLITHRFAFKDALKAYETVASGEEGVLKVIIGGPDA

SEQ ID NO: 66287 - protein, 313 aa, Desulfovibrio desulfuricans G20
MHGDLKIITGTANPELASAICNHLGCHLTPTLCETFSDGEIRIEIGDNVRGDDVFIVQPTCAPVNDNLIQLSLMLDALKRASVGRVTAVVPYYGYARQDRKVSPRAPISARLMADLLEAAGMHRLVTVDLHAGQIQGFFNCPVDNLYAAPVILDYLRQTVTNDIVIVSPDAGGVERARAYAKRLGASLAIIDKRRDKPNQAEAMNVIGEVKGKTAIVVDDMIDTAGTMVAAGNVLLTKGAKEVMACTTHPVLSGPAIERLCESSFSQVVVTDTIPLGSKLQACSKLKVLSVAGLLAKAIHNIHTESSVSVLFV

SEQ ID NO: 66288 - protein, 614 aa, Triticum aestivum
  misc_feature (512)..(512): Xaa can be any naturally occurring amino acid
GRVGSWKGTCMAGTDFNSSACNRKLIGARFFNRGYEAAMGPMDTSRESRSPRDDDGHGTHTSSTAAGAAVADADLFGFASGTARGMAPKARVAVYKVCWLGGCFSSDILAGMDAAVADGCGVLSLSLGGGSADYARDSVAIGAFAAMEQNVLVSCSAGNAGPGSATLSNVAPWITTVGAGTLDRDFPAYVQLGNGKNYTGVSLYAGKAPPSTPTTLIYAGNASNSTSGNLCMPGTLSPEKVQGKIVVCDRGISARVQKGFGVRDAGGAGMVLANTAANGQELVADAHLLPAAGVGEKEGTAIKSYIASESKPTATIVVAGTQVDVRPSPLVAAFSSRGPNMITPEILKPDIIGPGVNILAAWTGKAGPTGLAADTRRVNFNIISGTSMSCPHVSGLAALLRSAHPEWSPAAVRSALMTTAYSTYTGGAGSPILDAATGAAATPFDYGAGHVDPTRAVEPGLVYDLGTSDYVDFLCALKYTPNMIAALARSKSYGCAANKTYAVANLNYPSFXVAYSTANGEAGDSGATTVTHTRTLTNVGAAGTYKVDASVSMSGVTVDVKPAKLEFTAAGEKKSYTVTFTAAKSQPSGTAGFGRLVWSDGKHTVASPIAITWT

SEQ ID NO: 66289 - protein, 175 aa, Triticum aestivum
MAPTVMPSSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMLGCTDATQVINEVEEVKKEYPDAYVRIIGFDNMRQVQCVSFIAFKPPGSEESGKA

SEQ ID NO: 66290 - protein, 240 aa, Lentisphaera araneosa HTCC2155
MDKLTQIKKSDADEWRKNVEDMFQEIADTYEKINTFISMGMDKGWRLKLLKRLKQYYDPSHPVLDIGCGPGSLSALSKKHLPEARFLSSDICPRFLEIAANSGNAQEVLRLSASDLPFKNECTSAVTSAFVLRNLPDLERFYKECHRILRPGGVISMLDLTQPKFKPISFFHSLYMALALPLGAKIYGSRLEAYEYLDRSIKNCLAPEEMNALLKKCGFTVKHTDSLCMGTVTIYTAVKE

SEQ ID NO: 66291 - protein, 573 aa, Bacillus megaterium
MTKEIQGIAASSGIAIAKAFRLENPELTVEKKSVTEVEAEVARLEAALEKSKSELEIIREHARKELGDDKAEIFEAHLLVLSDPELINPIKDKITNENVNAEHALDEVAAMFINMFESMDNEYMKERAADIRDVTKRVLAHLLGVNVSNPSLISEEVVIIAEDLTPSDTAQLNRKFVKGFTTDIGGRTSHSAIMARSMEIPAVVGTKTVMEDIQNGVLVIVDGLDGEVIVDPSEETVKAYEKKAAEYAEQKAEWAKLVNEKTVSADDHHVELAANIGTPEDVKGVLENGGEGVGLYRTEFLYMGREDLPTEEEQFTSYKTVLERMEGKPVVVRTLDIGGDKELPYLNLPKEMNPFLGFRAIRLCLEMQDMFRTQLRALLRASVYGNLKIMFPMIATVDEFRQAKAILLEEKAKLQQEGVQVSEDIEVGMMVEIPSSAVIADLFAKEVDFFSIGTNDLIQYTLAADRMNERVSYLYQPYNPAILRLVNMVIKAAHKEGKWVGMCGEMAGDEIAIPILLGLGLDEFSMSATSILKARSQIRQLSKADIEPHLDTILSMSSTEEVIEFVKSTFHIG

SEQ ID NO: 66292 - protein, 307 aa, Neptuniibacter caesariensis
MFNPVSLPISRISDPVLSANGISLDMLRLDLTDEVISGNKWFKLKYNLMDAKSRGCKAVLSFGGAYSNHIHALAKAGLDLGIRTIGVIRGEPEYAKNPTLSDAIDWGMELHFVNRKDYRLRSDPGFLSHLREQYDCPYIVPEGGSNALALKGAMEILPSELIEFVCPDHVILPCGTGGTLSGIALSCRDTPVLGIPVLKNAGFLYDDISALMGLVTDNVPDNWSLDLEGHFGGYGKVSDQLLQFMQSFEVNNQIQLDPIYTAKMMLRIFQRIELGEYSRGSRLLAIHTGGLQGRRGAGCSAVPANCT

SEQ ID NO: 66293 - protein, 578 aa, Bacillus sp. S
MGNAIREKTIHGIAASSGIAIAKAYRLETPDLAAEKRAVADVEAEVARFEAAVAKAKEELEAIKQHALEKLGEDKAAIFAAHLLVLDDPELLNPIKEKIQTERVNAEYSLDETASFFISMFEAMDNEYMKERAADIRDVTKRVLAHLLGVTISNPSLISEEVVIIAEDLTPSDTAQLNRQYVKGFATDIGGRTSHSAIMARSLEIPAVVGTKTVTAEVKNGDIVIVDGLDGQVIINPSPELLAQYEQKRARYEAQKAEWAKLVHEATVTADGIHVELAANIGTPDDVKGALANGAEGIGLYRTEFLYMGRSELPTEDEQFVAYKTVLEQMNGKPVVVRTLDIGGDKELPYLQLPKEMNPFLGFRAIRLCLEMQDMFRTQLRALLRASVYGNLKIMFPMIATLDEFRQAKAILLEEKEALLRQGVAVADGIEVGMMVEIPAAAVMADQFAKEVDFFSIGTNDLIQYTMAADRMNERVAYLYQPYNPAILRLISHVIDAAHREGKWVGMCGEMAGDPIAIPILLALGLDEFSMSATSILPARAQLKQLAKEEAARIKETVLSLGTAEEVVSFVKRTFSLA

SEQ ID NO: 66294 - protein, 186 aa, Triticum aestivum
  misc_feature (55)..(55): Xaa can be any naturally occurring amino acid
RARSGAASRGSGDSDNHCDEVRRVARPAPVTSACQARHLLPPQPARAVLVTRSRXRPCGAASSLPPGEYLPPLFSVAPMMDWTDNHYRTLARLISRHAWLYTEMVVAETIVHQKDKLDRFLAFPAEQHPIVLQIGGSNLDNLAKATELASGYAYDEINLKWLPQSCLIMQYTVLYLQILVDFVLVV

SEQ ID NO: 66295 - protein, 351 aa, Arabidopsis thaliana
MGSSVEQNILVTGGAGFIGTHTVVQLLKDGFKVSIIDNFDNSVIEAVDRVRELVGPDLSKKLDFNLGDLRNKGDIEKLFSKQRFDAVIHFAGLKAVGESVEKGRRYFDNNLVGTINLYETMAKYNCKMMVFSSSATVYGQPEKIPCMEDFELKAMNPYGRTKLFLEEIARDIQKAEPEWRIILLRYFNPVGAHESGSIGEDPKGIPNNLMPYIQQVAVGRLPELNVYGHDYPTEDGSAVRDYIHVMDLADGHIAALRKLFADPKIGCTAYNLGTGQGTSVLEMVAAFEKASGKKIPIKLCPRRSGDATAVYASTEKAEKELGWKAKYGVDEMCRDQWKWAFNNPWGYQNKL

SEQ ID NO: 66296 - protein, 593 aa, Oryza sativa
MDRQEEEDDDAALREAGGGSSDPHDGGGGGECGGWLRRLSRELHWSFVLAVVAVYGACQGVGDAVGGVAAGYYWKDVQRVQPSAAQFYQGFVSAPWVVKPVWGLLTDVVPVAGYRRRPYFLLAGVIGASSMLTLALHRKLGIMPAILALTAQSAGAAVADVTVDALVAQNSITHQPLAADMQSLCGFSSSVGALLGFSISGLLVHSMGSQGALGLLSIPSALVFLAGVLLKERRVTDFDYKQVHRKFYKAIQSMGATLKCAEVWRPCVYMYVSLSLSLDIQAGMFYWYTDPIVGPGFSEDYPFRGVLFWGQVLSSLAGMLDLIMVTRLNTRVGIPDYVFAVIDNSVSQMVGRLKWLPLLVLCSKLCPPGIEGTFYALLMSIQNAGLLMSGWWGGLMLHLLNVTRTEFSNLWVAVLIRNLSRLLPLMLLFLVPQSDQNSMLLPAEMLQDNESTEARKGGQDTAEFSVLVADDSSCHALSVAVEDERIKVVDAGTGHLYHKSSPGHRVDIPDFPFVKATDSCHSIQQTVSTQVPQGKNTHINIENGLRNKEEHAMLVLGMIKNIMGIIEMLFPRLRMENSNNRTAVGMVLWLADT

SEQ ID NO: 66297 - protein, 397 aa, Salmonella typhimurium
MFQKVDAYAGDPILSLMERFKDDSRHDKVNLSIGLYYNEDGIIPQLKTVAEAEARLNAQPHGASLYLPMEGLNTYRHTIAPLLFGADHPVLQQQRVATIQTLGGSGALKVGADFLKRYFPDAGVWVSDPTWENHIAIFAGAGFEVSTYPWYDDATNGIRFNDLLATLNTLPARSIVLLHPCCHNPTGADLTPSQWDAVIEIVKARDLIPFLDIAYQGFGAGMDDDAYVIRAIASAGLPALVSNSFSKIFSLYGERVGGLSVVCEDAEIAARVLGQLKATVRRIYSSPPCFGAQVVATVLGDEALKAGWLAEVDAMRNRIISMRQTLVKELTAEMPDRNFDYLLQQRGMFSYTGLSEEQVDRLRDEFGVYLIASGRMCVAGLNASNVHRVAKAFAAVM

SEQ ID NO: 66298 - protein, 250 aa, Geobacillus kaustophilus HTA426
MRLKGKAAIVTGGASGIGRATAIRFAEEGAKVAVSDINEEGGEETVRLIREKGGEAIFVQTDVADSKQVSRLVQTAVDAFGGLHILFNNAGIGHSEVRSTDLSEEEWDRVINVNLKGVFLGIKYAVPVMKQCGGGAIVNTSSLLGIKGKKYESAYNASKAGVILLTKNAALEYGKFNIRVNAIAPGVIDTNIITPWKQDERKWPIISKANALGRIGTPEEVANAVLFLASDEASFITGATLSVDGGGLTF

SEQ ID NO: 66299 - protein, 217 aa, Triticum aestivum
MELFAHAKAVRLKSRHDKFLYADEDELHVTQDRNGSSPSARWTVEPVPHAPGAVRLRSRYGRYLAASTEPFLLGMTGRKVLQAAAAPGGRPDASVEWEPVRDGFQVRLKSRAGGVRGGGDKYLRANGGVPPWRNSVTHDVPHRTATQEWVLWDVEIVQVLTPGPATPAPEKAASAPPAALAPDSPPAPKLRPAPTPYEAHHRPTKSQTSPSLRRTTR

SEQ ID NO: 66300 - protein, 256 aa, Geobacillus kaustophilus HTA426
MRFANTVAVITGGGSGIGRATAVRLAQEGATVVLVGRTAVKLEETVQDITRLGVPGVADRFAADVTDHEQVRALAAYVQNRYGDLHVLVNNAGISTHTKWLELTEQEWDDVQRVNMKSVFLVSQTLAPLMIEGAKRERANRAIVNVASLSGHQAGAEIPHYSAAKAGVINLTKSLALELAPYGIRVNSVSPGFVETPLTERGLQNERFVKAIERNTALGRVGAPEEIANVIAFLASSEASYMTGSDVLVDGGWLIK

SEQ ID NO: 66301 - protein, 257 aa, Neisseria meningitidis FAM18
MYHQIGMWDQKWVIGNWKMNGRLQNNNSLMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 66302 - protein, 106 aa, Oryza sativa
  misc_feature (13)..(13): Xaa can be any naturally occurring amino acid
  misc_feature (27)..(27): Xaa can be any naturally occurring amino acid
  misc_feature (30)..(30): Xaa can be any naturally occurring amino acid
  misc_feature (45)..(45): Xaa can be any naturally occurring amino acid
  misc_feature (71)..(71): Xaa can be any naturally occurring amino acid
  misc_feature (89)..(89): Xaa can be any naturally occurring amino acid
TKQRLKRAEDWTXVVEAYERVRAIGTXKIXTPYQAHNVHDCTDEXLADHGSAQADESTRTIYGGHVTGANXEELASKSDADGHLEGGAXLTPERINIINCGTGYSH

SEQ ID NO: 66303 - protein, 340 aa, Bacillus cereus E33L
MTKIFILASTLSLSFFSGLNIGNAATENFSPITNAIVQNNDHFAEGNSKDNNKPPGNGGSQDDSGSGGNGSDGNGSGGSGSGGNGSGDNGSGGNGSGDNGSGGSGSDGNGSGGNGSGGNGSGDNGSGGNGSDGNGSGGNGSGGSGSDGNGSGDNGSGGNGSGGNGSDGSGSGGNGSGGNGSGGNGSGGNGSGGNGSGGNGSDGSGSGGNGSGSSGSGGNGSGGNGSGGNGSGGNGSGGNGSDGSGSGGNGSGSSGSGGNGSGGNGSDGNGSDGNGSGGSVKGDSSSQSENNLQGGNVKDNAKKQGDKLPNTATHYPASILIGLSTFLMGMLLLIRRKNAK

SEQ ID NO: 66304 - protein, 268 aa, Triticum aestivum
  misc_feature (26)..(26): Xaa can be any naturally occurring amino acid
  misc_feature (52)..(52): Xaa can be any naturally occurring amino acid
MAATAACRSMERRWSLAGSTALVTGXAAKGIGHAIVEELAGLGARVHTCSRXNAAELDECRRQWEDKNLRVTVSVCDVSVRAEREKLMNTVRQTLGGKLDILVNNAGQSMVKAATECTGEDYALVMATNIESCFHLAQLAHPLLLRSGGGASSIVHVSSIAGFVGFPGLAVYSMTKGAMNQLTRSLAAEWAGDGIRVNCVAPGGINTDIAKDMITRDPEIVKRQATQLPMQRLGETEEVASVVAFLCMPAASYITGQVICVDGGRTIA

SEQ ID NO: 66305 - protein, 243 aa, Burkholderia vietnamiensis G4
MSKTHFGFESVEETEKAKKVAGVFHSVASNYDLMNDLMSAGMHRAWKAFTIAQANVRPGFKVLDIAAGTGDLTRAFAKAAGPTGEVWHTDINESMLRVGRDRLLDKGVVTPSLLCDAEKLPFPNNYFDVVTVAFGLRNMTHKDAALAEMRRVAKPGGRVMVLEFSKVWEPLKKAYDLYSFKVLPWLGDRFAKDADSYRYLAESIRMHPDQDTLKTMMEQAGLDAVKYYNLSGGVVALHVGSKY

SEQ ID NO: 66306 - protein, 459 aa, Mycobacterium sp. MCS
MDTEPTTFDAIIIGAGQAGPPLAGRLTEAGQTVAVIERKLVGGTCVNYGCIPTKTLVASAHAAHLARRGAEYGVGTGDVTVDMAKVKARKDKIMLGDREGVESWLQGMDGCTFIRGHARFEDPHTVRVDDQVLKADRIYLNVGGRAVAPDLPGLSDIDYLTNVGILDLDTLPEHLVIVGGSYIALEFAQMYRRFGARVTVLEHGPRLTSREDEDVSAAIKDILEAEGIDIVLDAKDIRFTKRDNGFDVVPRDGAAPIAGSHLLIAVGRQPNTDDLGLDAAGVQTDERGYVVVDDQLRTTADHIWAMGDCNGKGAFTHTSYNDFEIVAANLLDDDPRRVSDRVTTYALYIDPPLGRAGMTAEQVRKSGRKALVGKRPMTRVGRAVEKGETQGFMKVVVDADTEEILGAAILGVGGDEVVHAILDIMTAKKPYTAISRTMHIHPTVSELVPTLLQDLKPLT

SEQ ID NO: 66307 - protein, 398 aa, Neptuniibacter caesariensis
MNRDLSLLQPYPFEKLTALKAEVTPPADLEHIALSIGEPKHPAPPFVAECLINNIDKLANYPTTKGLPELREAIANWCSRRFNLNEGTLSAEDNVLPVNGTREAIFAFTQAAVNRAPDALVISPNPFYQIYEGAAYLAGAEPYYLNCLADNNFIPDYDAVPEEVWQRCQLLFLCSPSNPTGAVTNLETLKKLIELSDKYDFIVASDECYSEIYLDEENAPVGLLQACAELGRDDYKNCVVMHSLSKRSNLPGLRSGFVAGDAALLKPFLSYRTYHGCSMPIQHQLASIAAWGDEDHVLDNRDQYRHKFDAVIRILEPVMDVQHPDASFYLWAKTPIADDKFAQGLFASQNVTVLPGRYLSRETEGKLPGAGFVRMALVATVEECVEAANRIREYVESL

SEQ ID NO: 66308 - protein, 318 aa, Triticum aestivum
  misc_feature (79)..(79): Xaa can be any naturally occurring amino acid
  misc_feature (174)..(174): Xaa can be any naturally occurring amino acid
  misc_feature (193)..(193): Xaa can be any naturally occurring amino acid
  misc_feature (202)..(202): Xaa can be any naturally occurring amino acid
  misc_feature (208)..(208): Xaa can be any naturally occurring amino acid
  misc_feature (250)..(250): Xaa can be any naturally occurring amino acid
  misc_feature (255)..(255): Xaa can be any naturally occurring amino acid
  misc_feature (262)..(262): Xaa can be any naturally occurring amino acid
  misc_feature (273)..(273): Xaa can be any naturally occurring amino acid
  misc_feature (282)..(282): Xaa can be any naturally occurring amino acid
MSSIAPSSSSIAVLRRQPVQFLGGSDVSKQAKGSVSYSFPTNSRNANMKSVGLKIAASLKKNSGFPADGCLENDDTLSXKSTSVRAQDLPPTNSVIPVDSVVAAEIISTDLSCVVDTLSNEEDDAELDLDSPTEGFSSISEAIEDIRQGKLVIVVDDESRENEGDLILAASLVXPEAMAFIVRHSTGIVCVSXEENDLERLXLPLMVXTKENEEKLCTAFTITVDAKEGTTTGVSCKDRGKTVMTLASPXSKPEXFNRPGHXFPSEVRDGGVXKRAGHLDHXVDPAGLLGFPPVDYLVKCGLGWSRAPTQVAVLLKNN

SEQ ID NO: 66309 - protein, 121 aa, Clostridium perfringens ATCC 13124
MTKEQIIEAIKEMSVLELNELVKACEEEFGVSAAAPVAVVGGAAAGAAAEEKSEFDVVLTNAGANKIKVIKAVRELTGLGLKEAKEIVDGAPKTLKEAVAKEEAEDMKAKLAEVGAEVELK

SEQ ID NO: 66310 - protein, 335 aa, Silicibacter pomeroyi DSS-3
MERFARIRLGHLPSPLEPLDRLSEALGGPRIWVKRDDCTGLSSGGNKTRKLEFLMASACEAGADTIITQGAIQSNHARQTAAAAARLGLHCHLLLEDRTGAADLAYTLNGNVLLDRLHGATISRRAGGSDMAAEMERLAATLRGKGKRPYVIPGGGSNRVGALGYVNCALELSEQALSMGLDIDALIHATGSCGTQAGLVAGLAGLSWNTHLLGIGVRAPQERQEAMVFDLACETMDYLGMGIPIVRSGVRANCDHVGPGYGLPTEAMCEAVRMLARLEGLLLDPVYTGKAMAGLIDLTRQGYFDGMANIVFLHTGGSAALFGYPEIFGLPGYQP

SEQ ID NO: 66311 - protein, 264 aa, Pisum sativum
PSDEVHIFGYARSKISTDELRNKLQSYLIPKKDASPKDLHDVSDFLQLVKYISGGYDSEEGFRLLDIEISEHEYLKNSKEGSSRRLFYLALPPSVYPSVCKMIKTYCMNKSDLGGWTRVVVEKPFGRDLESAEELSNQIGELFEEPQIYRIDHYLGKELVQNMLVLRFANRFFLPLWNRDNIDNVQIVFREDFGTEGRGGYFDQYGIIRDIIQNHLLQVLCLIAMEKPVSLKPEHIRDEKVKVLQSVLPIRDDEVVLGQYEGYK

SEQ ID NO: 66312 - protein, 146 aa, Silicibacter pomeroyi DSS-3
MTHTRYAFIKANWHADIVDRALEGFLELIPPEQVDVYDVPGAFEMPLLARDLAQTGRYAAVACAAFVVDGGIYRHDFVAQAVVDGLMRAGLDTGVPILSVSLTPHQYQETDHHNAIFRAHFVDKGREAARAALQITATRSKLAQAA

SEQ ID NO: 66313 - protein, 258 aa, Ralstonia solanacearum
VANFKDIEVVAINDLLEPDYLAYMLKYDSVHGRFDGEVSVDGDTLIVNGKKIRLTAVKDPAELKWGEVGADVVVESTGIFLTKEGAQKHIDAGAKKVIMSAPSKDDTPMFVYGVNHGTYKGEAIVSNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELDKPATYDEICAEMKAQSEGALKGVLGYTEDK

SEQ ID NO: 66314 - protein, 516 aa, Candida albicans SC5314
MAYVLTETAAGYALLKAADKKIHKSSSLVEDLNTAEKVAEQFKIHRFEKFQSAANALEEANAIIEGKVSENLQKLLEDAKSDKKATLIVSEAKLGNAINKLGLNFQVVSDAASLDLQRAIKQFLPELLPGLDDSALKQMSLGLAHSMGRHKLKFSADKVDTMIIQAIALLDDLDKELNTYAMRCKEWYGWHFPELAKMITDSAAYARIILTMGVRSNASETDLSEILPEEVEEQVKAAAEVSMGTEITEDDLNNIKALAEQIVDFAAYREQLSNYLSSRMKAIAPNLTAMVGELVGARLIAHAGSLTSLAKAPASTVQILGAEKALFRALKTKHDTPKYGIIYHASLVGQASGKNKGRIARTLAAKAAVSLRYDCFDEERDESDDFGLENRAKVEGRLSQLEGRDMRTTSKVVREQPKVEITEARAYNADADSTAAAAAAAPTADSDDEESETEEVEEKKSKKDKKKDKKEKKDKKKDKKRKRDDDKEDKESSKKSKKDKKEKKEKKEKKAKKEKK

SEQ ID NO: 66315 - protein, 1280 aa, Zea mays
MPGGPRVQRLHPVLEPARLRLASHLRRRPRPRNPSNSPRRPSSFSIKFTPPPNLESPSRCFSTDPDADADATAAPSPVPTPLPGPRSRDPGRRAMANIDMAKILADLDRGASGGDARVPKTKLVCTLGPASRTVPMLEKLLRAGMNVARFNFSHGTHEYHQETLDNLRQAMHNTGILCAVMLDTKGPEIRTGFLKDGKPIKLTKGQEITVTTDYDIKGDENTIAMSYKKLPVDVKPGNVILCADGTISLAVLSCDPDAGTVRCRCENTAMLGERKNCNLPGIVVDLPTLTEKDKEDILGWGVPNDIDMIALSFVRKGSDLVTVRQVLGQHAKRIKLMSKVENQEGVVNFDEILRETDAFMVARGDLGMEIPVEKIFLAQKMMIYKCNIAGKPVVTATQMLESMIKSPRPTRAEATDVANAVLDGTDCVMLSGESAAGAYPEVAVKIMARICIEAESSLDHEAVFKAMIRSAPLPMSPLESLASSAVRTANKAKAALIVVLTRGGTTAKLVAKYRPRVPILSVVVPVLTTDSFDWTISSEGPARHSLIYRGLIPLLAEGSAKATDSESTEVILEAALKSAVQKQLCKPGDAIVALHRIGVASVIKICIVNRGTEDQERGGAEAAAMGSDVPPPSAIPPLSAAAASVVRQIAGVPVDQLLRRVDAEEQARGPLEYARSVVEYCSHVALRVEARRPDHLGDREFHTLTYDMMLAWEAPDEETDAVFQKTAFSVLRGDDADDDDSGSIFYSSPTQMAIQVSGLFLLRTVGPEAFAKIAPACPAMAHPITVRNLFDAITNSTGGRLHFLIYHKAFCSAKRVLGGHRAPALQLSDDEVILDIHGAATTKPVLQHIGTSTWPGRLTLTNHALYFEAIGVDFSYGEAVVYDLARDLKQSVKRESTGPWGAHLFDKAVMYKSSLTSEPVFFEFPQFKGHTRRDYWFAAIKEVLHAHKFIRKYKLAGFQKAEALSVATLGILRYRTVKEGFHILPAHFKTILAFNLAEKLPKGDKILEALYGQLKQHCPRFRGGQDLGQSSSEELMLADPFPLSAYTMVTMGLLKLKEEDNAEERDFAVRDVQIGGTSSVQMALERSVGYSGRVEAARATLDQVRVEDIDTNVAVLKELLFPLIEIGKRLLALSGWEEPFKSYVFLLCFLYMAYRYCFLAISQLEAHVQAGNIFLLKLRSLMLAAFPQSTNRVAAALVAVAAIFTFVPLRTIVLLILLEEYTRQMPVRKKSSEKLVRRLREWWLRIPAAPVQLFYTMFRAHSLSGRDLGITPSSESKTLV

SEQ ID NO: 66316 - protein, 319 aa, Zea mays
  misc_feature (117)..(117): Xaa can be any naturally occurring amino acid
  misc_feature (202)..(202): Xaa can be any naturally occurring amino acid
GPLSRLSALQVESCAEHLASIFGTEKDRVNCPFYFKIGACRHGDRCSRLHNRPTISPTLVLANMYQRPDMITPGVDAQGQPIDPEKMQEHFEDFYEDIYEELGKFGEIENLNVCDNXLADHMIGNVYVQFREEEQAAAAYNALQGRFYSGRPIIVEYSPVTDFREATCRQFEENSCNRGGYCNFMHVKQIGRDLRRKLYGAXASRRYHARSRSPPPQRRGYREDYHHRDRDEYRGGGGGGGGRGRGSRHDRYDDGAGRGGRHDRYDDGAGRGGRYERYDDGGRRRHGSPPRRGRSPVRESSEERRAKIEQWNRERESKQ

SEQ ID NO: 66317 - protein, 292 aa, Gibberella zeae PH-1
MYSWIPLLATFAPQALASCAYGTHLHRRADAIQAPKFGYSAANGPANWYNLDPEANKLCATGTHQSPINLSNGTHKVLSGSDLQIEIPDFHDGAEFENLGSTVEVVTEGMGGKLTLDNTVYHLKQFHFHLPSEHLDNGTSMAMEMHMVHQSEDKKLAVIGVYIDLDDGLPNATYKAKAAAREATGKDCKTTQAQRSTVATTVLNSVDKIATLGQTTHTKPLKMSEIVSLLEAGEFQSEGVTWLVSTQKVSIPTKTYLKARSVIGYNARFPQNSPGEENVLSMLADEVDDDSV

SEQ ID NO: 66318 - protein, 124 aa, Oryza sativa
MANYLASIFGTEQDKVNCSFYYKIGACRHGDRCSRKHVKPSYSQTILLPNLYQNPAYDPKNKMNPQQMQMHFDAFYEDIWCELCQYGLVEELVVCDNNNDHLIGNVYVRFKYEEDAQKACDALK

SEQ ID NO: 66319 - protein, 454 aa, Geobacillus kaustophilus HTA426
MEHSRPSLQKGLLPRHVQLMALGGMIGTGIFKGSAEAIHIAGPSVVLTYLIGGVLLFWIMAALAEMAIAYPGSNVQHLIRRAFGFRLSWIVGWLYWINWTLVTVVELLAAGSFLNYWVPSAPLWLLALLCACLIMGLNLFPVKYYGEAEFWLAGLKVAALVVFIVLGACVWAGVIPSGISGSFPSAGDGGWFPHGFAGTLSALLIVMFSYGGAELIGVAVTEMKDAEQVLPRVIRTTIWRVVGFYLLPMAIICGIMPWNTVSETNSPFVQVLEAIGLPGAAHVMNAVLLIAVLSAANTGVYATSRLLYTMAEQGEASRRLQRTTKHGVPLYGMGMVAICIAAGVIGAYLAPGRIIGELMTIPGFTVLIVWMMIGAAQLKLRPHYKTKPFFRTKGFPYTTMAAVGALGAIWLGFLLQREHRIGSLLCVAVLVLLFIYSTVKEKQHQATKAPGRTA

SEQ ID NO: 66320 - protein, 188 aa, Staphylococcus aureus subsp. aureus MRSA252
MILVVDNYDSFTYNLVDIVAQHTDVIIQYPDDDNVLNQSVDAVIISPGPGHPLDDQHLMKIISSYQDKPILGICLGAQALTCYYGGEVIKGDKVMHGKVDTLKVISHHQHLLYQDVPEQFSIMRYHSLISNPDNFPEELKITGRTDDCIQSFEHKERPHYGIQYHPESFATDYGVKIITNFINYVKKG

SEQ ID NO: 66321 - protein, 181 aa, Cucumis melo var. cantalupensis
MSSSLIFKLFFFSLFFSNRLASRLDSDDDGKNIYIVYMGRKLEDPDSAHLHHRAMLEQVVGSTFAPESVLHTYKRSFNGFAVKLTEEEAEKIASMEGVVSVFLNEMNELHTTRSWDFLGFPLTVPRRSQVESNIVVGVLDTGIWPESPSFDDEGFSPPPPKWKGTCETSNNFRCNRKIIGA

SEQ ID NO: 66322 - protein, 256 aa, Daucus carota
MSQQQPRRPQQEQPIKYGDVFDVSGQLSSQPVAPNDASAMQAAENMVLGKTQKGGPASVMQSAAAANLQRGVVGRHEGTPIASEQGVTISEAEIAGTRIITEAVGGQVVGQYLEPGKFKMTSPAGALGSDSITIGEALETTALTAGDKPVDQSDAAAIQAAEVRASGYAHPGGVAAAAQSAADYNARTMNVASKTKLGDVLADASIRLAEDKAVTREDAEGVVGAEVRNNPEMMTYPGGVASSMAAAARLNQDPTF

SEQ ID NO: 66323 - protein, 408 aa, Thermoplasma volcanium GSS1
MADFFLMDSFDLAGRTIYLRVDINSPVNPVTGEIMGTDRFRAHVETIRKLRDSKVVIVAHQSRPGKDDFTSLRQHAQVMSRILNKKVMFVDQLFGSLVNKTVESMNEGDIVMLENARFYSEEVDLTTLESMENSNIVKGLSTLFDYYIIDAFAAIHRAQTTLVGFRRIKPNIAGALIEKEVTMIDRFRHLNESPKIAILGGAKIDDSIAVSENFLKSGFVDKILTGGVVANAFLWAKGIDIGKKNRDFIIKNNGDYEKLIAKCKGLLSEFGDRILVPSDFILSPSGERVSANGKIPDDQILADIGLDTVVEYSEIIDKAKAIFMNGPMGIYEIEAYSSGTREIFSSVAKSEAFSIAGGGHTLSALDKLGLTNRIDHASTGGGALISYLSGEAMPVLEALKESKRLFEV

SEQ ID NO: 66324 - protein, 456 aa, Klebsiella pneumoniae
MSLFHSVSDLIGHTPLLQLHKLDTGPCSLFLKLENQNPGGSIKDRVALSMINEAERQGKLAPGGTIIEATAGNTGLGLALIAAQKNYRLILVVPDKMSREKIFHLRALGATVLLTRSDVNKGHPAYYQDYARRLADETPGAFYIDQFNNDANPLAHATSTAPELYQQLEGDIDAIVVGVGSGGTLGGLQAWFAEHSPKTEFILADPAGSILADQVDTGRYGETGSWLVEGIGEDFIPPLARLEGVHTAYRVSDREAFQTARQLLQVEGVLAGSSTGTLLSAALRYCRTQSRPKRVVTFACDSGNKYLSKMFNDDWMRQQGLIARPEQGDLSDFIALRHDEGATVTAAPDDTLAAVFTRMRLYDISQLPVLEDGRVVGIVDEWDLIRHVQGDRQRFSLPVSEAMSRHVETLDKRAPESELQAILDRGLVAVIADNTRFLGLVTRSDVLTAWRNRVAQ

SEQ ID NO: 66325 - protein, 507 aa, Burkholderia vietnamiensis G4
MASHDYLKKILTARVYDVARETELEPARNLSTRLRNPIYLKREDNQPVFSFKLRGAYNKMAHIPADALTRGVITASAGNHAQGVAFSAARMGVKAVIVVPVTTPQVKVDAVRAHGGPSVEVIQAGESYSDAYAHALKVQQERGLTFVHPFDDPYVIAGQGTIAMEVLRQHQGPIHAIFVPIGGGGLASGVAAYVKAVRPEIKVIGVQAEDSCAMAQSLQKGERVELSEVGLFADGTAVKLVGEETFRLCSEFLDGVVTVDTDALCAAIKDVFQDTRSVLEPSGALAVAGAKRYVEREGIENQTLVAVTSGANMNFDRMRFVAERAEVGEAREAVFAVTIPEERGSFKRFCSLVGDRSVTEFNYRIADEKSAHIFVGVQIRRRGESAEIAANFDAHGFKTVDLTHDELSKEHIRYMVGGRSPLALDERLFRFEFPERPGALMKFLSSMAPDWNISLFHYRNQGADYSSILVGLQVPQADRAEFERFLAALGYPYVEESVNPAYRLFLS

SEQ ID NO: 66326 - protein, 134 aa, Triticum aestivum
  misc_feature (6)..(6): Xaa can be any naturally occurring amino acid
FHLSQXAHPFLLNATIAGGGSIVNISSHAGSLGFPGLALYSMAKGGINQLTRSLATEWAQNKIRVNCVAPSATKTDMLNSLGPEIIENELARTPMRRAGEPAEVATVVSFLCMPAASFVTGQVITVDGGRTISG

SEQ ID NO: 66327 - protein, 637 aa, Neisseria meningitidis FAM18
MNPSPLLDLIDSPQDLRRLDKKQLPRLAGELRAFLLESVGQTGGHFASNLGAVELTIALHYVYDTPEDKLVWDVGHQSYPHKILTGRKNQMHTMRQYGGLAGFPKRSESEYDAFGVGHSSTSIGAALGMAVADKQLGNNRRSVAIIGDGAMTAGQAFEALNCAGDMDVDLLVVLNDNEMSISPNVGALPKYLASNVVRDMHGLLSTVKAQTGKVLDKIPGAMEFAQKVEHKIKTLAEEAEHAKQSLSLFENFGFRYTGPVDGHNVENLVDVLKDLRSRKGPQLLHVITKKGNGYKLAENDPVKYHAVAKLPKEGAAQMPSEKEPKPVAKPTYTQVFGKWLCDRAAADERLIAITPAMREGSGLVEFEQRFPDRYFDVGIAEQHAVTFAGGLACEGMKPVVAIYSTFLQRAYDQLVHDIALQNLPVLFAVDRAGIVGADGPTHAGLYDLSFLRCIPNMIVAAPSDENECRLLLSTCYQADAPAAVRYPRGTGTGAPVSDGMETVEIGKGIIRREGGKTAFIAFGSMVAPALAVAGKLNATVADMRFVKPIDEELIVRLARSHDRIVTLEENAEQGGAGGAVLEVLAKHGICKPVLLLGVADTVTGHGDPKKLLDDLGLSAEAVERRVRAWLSDRDAAN

SEQ ID NO: 66328 - protein, 524 aa, Klebsiella pneumoniae
MSVIAQAGAKGRQLHKFGGSSLADAKCYLRVAGIMKEYSQAGDMMVVSAAGSTTNQLISWLKLSQSDRLAAHQVQQSLRRYHTELIGGLLEPAAADTLIAAFIHDLERLAGLLDGGVSEAVYAEVVGHGEVWSARLMAAVLNQLGMEAAWLDARAFLRAERAAQPQVDEGLSYPLLQQLMAQHPNKRLVVTGFISRNQAGETVLLGRNGSDYSATQIGALAGASRVTIWSDVAGVYSADPRKVKDACLLPLLRLDEASELARLAAPVLHARTLQPVSASDIDLQLRCSYTPEQGSTRIERVLASGTGARIVTSHDDVCLVEFQVPAGHDFKLAHKELDALLKRAQLRPLAVGVHADRKLLQFCYTSEVADSALKLLDEAGLPGELRLRQKLALVAMVGAGVTRNPLHCHRFWQQLKGQPVEFTWQSEEGISLVAVLRAGPTESLIQGLHQSLFRAEKRIGLMLFGKGNIGSRWLELFAREQTTLSARTGFEFILAGVVDSKRSLLNYDGLDAIRALAFFNDEAV

SEQ ID NO: 66329 - protein, 380 aa, Saccharomyces cerevisiae
MNCIPSPISERKIQINNEDCIGKENAFHTIPRESSINLTPHSTNEKKVLSEVNSNKIDSLQLPRGKLQRDSTHLEKTRKRQLSNDSTDPIEPKTVKKIKCHQWKNLDSIEMDDPFMVAEYTDSIFSHLYEKEIQMLPTHNYLMDTQSPYHLKSSMRALLIDWLVEVHEKFHCLPETLFLAINLLDRFLSQNVVKLNKLQLLCITCLFIACKFEEVKLPKITNLAYVTDGAATVEGIRKAELFVLSSLGYNISLPNPLNFIRRISKADNYCIETRNMAKFIMEYSICCNKFIHLKPSYLAAMSMYIARKIKNENSKWDETFIHYSGGIDIESDPAFKDFISELVEDIAVPDTNLDSLRLKYKKPKHGMVYFKVFDWCKQKR

SEQ ID NO: 66330 - protein, 492 aa, Mycobacterium sp. MCS
MAGHGGAPVGGDLPIGDDEFTSGKTAIRIASVAALGGLLFGYDSAVINGAVDSIQEDFGIGNASLGFAVASALLGAAAGAMTAGRIADKIGRIAVMKIAAVLFLISAFGTGFAHEVWAVVLFRIVGGIGVGVASVIAPAYIAETSPPSIRGRLGSLQQLAIVSGIFLSFVVNWLLQWAADGPNKPLWFGVDAWRWMFLAMAVPAVVYGALAFTIPESPRYLVASHKIPEARRVLSTLLGKKNLEITITRIRETLEREDKPSWRDLRKPTGGLFGIVWVGLGLSIFQQFVGINVIFYYSNVLWQAVGFSADESAVYTVITSVINVLTTLIAIALIDKIGRKPLLLIGSSGMAVTLITMAVIFANATLDADGNPSLPGASGVIALIAANLFVVAFGMSWGPVVWVLLGEMFPNRIRAAALGLAAAGQWAANWLITVTFPGLREHLGLAYGFYGMCAILSGLFVWRWVRETKGVSLEDMHGEILKHDLPTGAKEG

SEQ ID NO: 66331 - protein, 280 aa, Neptuniibacter caesariensis
MKGLDTWLMQQGLSIQKDQNVSGGCVAVSRRLTLSNGQQVFVKSMDKPATGLFRAEAAGLKALGECTDISVPEVIYTGEDCLILDYIETGERSGDFEQLLGQQLASLHQMSVPSFGFTLNTFCGSTEQPNLSTSDGYAFYAEHRFGYLARQCFEQQLIGKETLRGIESICNRLQELIPQQEPALLHGDLWAGNVMSDRRGLPILIDPAVYWGWPEADLAMTQLFGGFSHALYQAYQEVSPLERGWRVRFQIYNLWHLLNHLYLFGESYRADVMAVVAKYR

SEQ ID NO: 66332 - protein, 535 aa, Alteromonadales bacterium TW-7
MTILKSSVNPHDPTYVQNHKNMSALVDDLRDKVATISLGGGTALKERHEGRGKLFVRDRISTLIDEGSPFLEISQFAAFGVYEQAIPCAGVVAGIGRVKGIECMIIANDATVKGGTYFPLTVKKHLRAQDIAERCHLPCIYLVDSGGANLPEQDDVFPDKLHFGRIFYNQARMSGKGIPQIAVVMGLCTAGGAYVPAMADESIIVKEQGTIFLAGPPLVKAATGEEVTAEELGGADVHCKTSGVADHFAENDEHALSIARQCIERINYTRPTAPLLKDIKAPRYDISELYGIVGTDLKKPFDVREVIARTVDDSSFDEFKRYFGETLVTGFASIYGNPVGIVANNGILFSESAQKGAHFIQLCAQRNIPLVFLQNITGFMVGKKYEAEGIAKHGAKMVMAVSCADVPKFTVLIGGSYGAGNYGMCGRAFEPTMMWMWPNARISVMGGEQAAGVMAQVKQDGLARKGQSMTDEQISEFKKPIIEQYEEQGHPYYASARLWDDGIIDPADTRNVLGLALSAAKNAPAQDSQFGVFRM

SEQ ID NO: 66333 - protein, 715 aa, Pseudomonas fluorescens Pf-5
MIYEGKAITVKALESGIVELNFDLKGESVNKFNRLTLNELRQAVDTIKADASIKGVIVSSGKDVFIVGADITEFVDNFKLPDAELVAGNLEANKIFSDFEDLNVPTVAAINGIALGGGLEMCLAADYRVMAASAKIGLPEVKLGIYPGFGGTVRLPRLIGADNAIEWIAAGKENRAEDALKVGAVDAVVAPDKLKDAALALVKRAISGEFDYKAKRQPKLEKLKLNAIEQMMAFETAKGFVAGQAGPNYPAPVEAIKTIQKAANFGRDKALEVEAAGFVKLAKTSAAQSLIGLFLNDQELKKKAKAYDEIAKDVKQAAVLGAGIMGGGIAYQSASKGTPILMKDINEHGIEQGLAEAAKLLVGRVDKGRMTAAKMAEVLNGIRPTLSYGDFGNVDLVVEAVVENPKVKQIVLAEVEGQVKEDTILASNTSTISISLLAKALKRPENFVGMHFFNPVHMMPLVEVIRGEKSSELAVATTVAYAKKMGKNPIVVNDCPGFLVNRVLFPYFGGFAKLVSAGVDFVRIDKIMEKFGWPMGPAYLMDVVGIDTGHHGRDVMAEGFPDRMKDDRRSAVDVLYEAKRLGQKNGKGFYAYETDKKGKQKKVADPSVLEVLKPIVYEQREVTDEDIINWMMIPLCLETVRCLEDGIVETAAEADMGLVYGIGFPPFRGGALRYIDSIGVAEFVALADQYADLGALYHPTAKLREMAKNGQSFFG

SEQ ID NO: 66334 - protein, 96 aa, Ostreococcus tauri
MKFVGDRDYVVLLDERGEEVSSEQLADIVAKIGDEGHERGVFIIGGPFGHGSQVVKRANKSIRLSKMVLNHQVARLVLTEALYRAHTILRGEPYHH

SEQ ID NO: 66335 - protein, 197 aa, Novosphingobium aromaticivorans DSM 12444
MLTLPNLLTLSRIVTVPLLAALLWWPEWRLGYGMAFAVYCLMGVTDYFDGYLARAKGAVSKLGIFLDPIADKIMVAAVILVLTAQGVLRGPYVGDMHVIAGLVILLREIAVSGLREFLGGIQVSVPVSRLAKWKTTFQMVCLGALILGQALPEWLMTIGGFTVNVPHTVGLSTLWGAAVLTVITGWDYLRVGLKHMD

SEQ ID NO: 66336 - protein, 195 aa, Nocardia farcinica IFM 10152
MTSATAGLNLSDSVYERLLRERIIFLGTQVDDDIANKLCAQILLLSAEDPTRDISLYINSPGGSVTAGMAIYDTMQFAECDIRTVGMGLAASMGQFLLTAGTKGKRYALPHARIMMHQPSAGIGGSAADIAIMAEQFAHTKRELNELQALHTGKSVEQVTADADRDRWFTAQEALEYGFIDHVISHANQANGIGG

SEQ ID NO: 66337 - protein, 628 aa, Zea mays
  misc_feature (287)..(287): Xaa can be any naturally occurring amino acid
MDHSSDEDTEISDSEIDDYEGKIYARLMSGDLKLNKNGENYICPFCSSKKKNYSKSSLVQHASGVSAAPNREAKEKAVHRALFKYLKNGLAKSPEPGSHATPVEPQPLQNRDEKFVWPWMGVLVNVPTEWKDGRQIGESGNRLKEQLSHFCPLRVIPLWTFRGHTGNAIVEFGKDWNGFRNARTFESHFAAGGFGKKDWIGKKNQGSELYGWLARAEDYNSPGIIADHLRKNGDLKSVNDLAKEGARKNDRLVANLANQIEVKNRYLQELECKYSETTASLEKMMGXREQLLQSYNEEISKMQQLARRHSQKIIDENQKLRSDLEAKMNDLDVRSKQLDEIAAKSDYDRRSLEQEKQKNAIKSSHLKLATLEQQKADENVLKLVEEQKREKHAALKKILMLEQQLDAKQKLELEIQQLKGKLKVMEHMPGDEDSASKNKINELSEALQEKIDELDGMESLNQTLVIKESKSNIELQEARKELENGLLDLSGGQTHIGIKRMGELDLKAFSKACQKERTENAEVTAAFLCSKWEAEIKNPDWHPFRVVTIDGKEMAIIEDDAKLRALKEEHGEEIYAMVTKALLETNEYKSKGSYPVGELWNFKENRKVTLKEAVQFVLRQWRTNRRKR

SEQ ID NO: 66338 - protein, 765 aa, Phycomyces blakesleeanus
MATLLIDNYDSFTYNVYQYLCSQGADVVVYRNDKITVDEIVKLNPVNIVISPGPGHPSHDAGVSRDVISYFAGKLPILGICMGEQCIFEVFGGTVSYAGDILHGKTSTIKHDNRGLFKNVPQDNQVTRYHSLAGMPSTLPEVLEVTATTDDGVIMGVRHKKYTVEGVQFHPESILCEHGHTMISNFLSLRGGNWDENPAAGVLAQKVPAAATEKAAQEASPAISTPPTCSTILSRIYAQRVKDVQAAKEVPGQSQADLQKLLNLHIAPPLRDVVNRLKESSPALMAEVKRASPSKGNIDITVNAAEQALQYALAGASVISVLTEPKWFRGSLNDLRQVREACPLLPNRPCILRKTFLLDTYQILEARLYGADTVLLIVAMMSDEDLRELYQYSVSLGMEPLVEVNNAEEMARANAVGAKLIGVNNRGLHSFDVDMETTSRLAEMVPEGTILCALSGISTRADVETYVSQGVHGLLVGEALMRAWNLKEFVAELLGYKKKDPVPHTPVSRQVQVKICGISSVEAAVEAATAGADLVGLIFAEKSKRQVTVAKAREIVDALHKLPTRSSQLPVKSQKSIDWFDVQTEMVEQRVPWRPLVVGVFVNQSTEYMSQVAVEAALDLIQLHGTESAEIARFLPVPVIKAFHMDASSFHAGQIPYVTQPGNNQLLLLDAKVPSLPMDRQGGLGQKFDWTIAQDIVNVKRPGCSKEQTFPVILAGGLDPSNISEAIQQVRPWAVDVSSGVETDGKKDLKKIRAFVEKAKSINLQ

SEQ ID NO: 66339 - protein, 342 aa, Zea mays
  misc_feature (231)..(231): Xaa can be any naturally occurring amino acid
MAANVALVLLSSCSPSTSAAAASLLPRRRFLPSRRRRASSRATTIMSALGDDPIREWILTEGKATQIKGIRSIGGGCINSAQRYDTDAGPFFVKTNSRIGPEMFEGEALGLKAMYDTKSIRVPLPYKVGSLPTGGSFIIMEFIEFGRSRGDQSDLGRKLAEMHKAAKSDKGYGFPVDNTIGSTPQINTWTDDWIEFYSKHRLGYQLELASRRYGDSAILEKGQRLIKNIRXLFDGAVIEPCLLHGDLWSGNISSDSNGDPVILDPACYYGHNEAEFGMSWCAGFGGDFYNAYFQVMPKQPGFEKRRDLYLLYHYLNHYNLFGSGYRSSAMSIIEDYLYVLAI

SEQ ID NO: 66340 - protein, 514 aa, Bacillus cereus E33L
MSVLTVENLSHSYGEKPILYNACFRILKGEHVGVVGQNGIGKSTLLKILTGELIHDDGNIEWFPHVKVGFLQQHMDLQEGMTIERYLQSAFADLYAIECEMLKIAEEMNGAGEVEKLLVKYGELQTILESSNFYHIHTEVEEVAIGLGLFEIGLKKDVSKLSGGQRTKLLLGKLLLEKADVLLLDEPTNYLDTAHIEWLQSYLRLYEKAYVIISHDELFLNSITNVIFHLEGGKVKRYVGNYEKFVQSYQVQKKQLQSAYAKQQKEISQLETFIQKNKIRKAKQAKSREKVLEKMQRIEKIHPVPRSRFDFNVYDEPVSRILQAEKLRIGYSDPLCPELNLQVKKGEKIAIIGHNGIGKTTMLKTLLGQIKPLSGSTSVGERVNPAYFAQQEFASETTPLEKVWAERPDMTKKEVRQALAKCGLKEEHVLKPIRLLSGGEQTKVRLCELTVKKSNVLILDEPTNHLDIETKKALQEALQRYKGTVLLVSHEPSFYEAWITKVWNIEEWNAEQYE

SEQ ID NO: 66341 - protein, 335 aa, Geobacter metallireducens GS-15
MSEVRKGEGMTVLVTGGAGYIGSHVVRQLSEAGYTVVVYDNLSTGFADALVHGERLVVGELADSDRLDALFAEHGFKTVLHFAASIVAPESVTDPLKYYSNNTRNTLNLLTACVKHGVERFIFSSTAAVYGMPENGIAAEESPTVPINPYGTSKLMSEWMLRDVCAAHGMRSVALRYFNVAGADPQARMGQRTPEATHLIKVSSQAALGMREKVSIFGTDYATPDGTGIRDYIHIEDLASAHLAALAYLERGGETTRINVGYGKGASVREVIEMVRRVSGVHFPAEEAPRRPGDPAMLVAKADRARTVLGWTPHYDDLETIVADAWRWEAKLNKR

SEQ ID NO: 66342 - protein, 129 aa, Platanus x acerifolia
TKRGPEIVAVYVQHPKATATLLYSHGNAADLGQMFELFVELSLRLRVNLMGYDYSGYGQSTGKPTEYNTYADIEAVYECLKEQYGVKDENLILYGQSVGSGPTLDLASSLPNLRAVVLHSPILSGLRVL

SEQ ID NO: 66343 - protein, 336 aa, Geobacter metallireducens GS-15
MSTVLVTGAAGFIGFHLSQRLLARGDRVVGLDNLNDYYDVNLKLDRLRQLEGREGFRFIRASLADRPALEELFSGERFDAVVNLAAQAGVRYSLKNPHAYVESNLVGFMNILEGCRHHGVKHLVYASSSSVYGANTAMPFSVHHNVDHPVSLYAATKKANELMAHTYSSLYGLPTTGLRFFTVYGPWGRPDMALFLFTKAILEGRPIDVYNHGKMQRDFTYIDDIVEGVMRVMDRTAEPNPSWSGDHPDPGTSYAPYRIYNIGNNSPVELLTFIETIEKCIGKPAEKNFLPIQAGDVPATYADVDDLMNDVGFKPATPIGEGIRRFVEWYREYYHV

SEQ ID NO: 66344 - protein, 170 aa, Saccharophagus degradans 2-40
MSQQNKREDSNAEGLQEKLVQVNRVAKTVKGGRIFGFTALTVVGDGNGKVGFGRGKAREVPIAIQKAMEAARRNMIQVELDGDTIQYPTKGRHGASKVYMQPASAGTGVIAGGAMRAVLEIAGVQNVLAKCYGSTNPVNVVRATFEALRAMSSPERVAAKRGKSVEEIIG

SEQ ID NO: 66345 - protein, 210 aa, Brassica napus
FLHSALVQSRQIDPKRKSRVQEALNYYLIESSLALFISFMINLFLTTVFAKGFYGTEKANNIGLVNAGQYLQEKFGGGLLPILYIWGIGLLAAGQSSTITGTYAGQFIMGGFLNLRLKKWMRAAITRSCAIVPTMIVAIVFNTSEASLDVLNEWLNVLQSVQIPFALLPLLTLVSKEEVMGDFKIGPILQVSFTFFYHKSSEIFTWYDPT

SEQ ID NO: 66346 - protein, 220 aa, Geobacter metallireducens GS-15
MWPGGNNVKKLVVWGASGHAMVVADIVRLRGEYDIVGFLDDVTEGRNGEEFFGLPVFSGRDSLAMLCGQGVRHAIVAFGNCPARLKVAEYLRAQGLELVTAVHPSAVVARDVVIGEGTVVAAGAVINPGVHVGANVIINTSASVDHECTIEDGAHICPGVRLAGRVAVGEGAWIGIGSSIIDRVRIGAGSFIGAGSVVVGDIPDNALAYGVPAKIRKRIE

SEQ ID NO: 66347 - protein, 635 aa, Oryza sativa Japonica Group
MAAASISRSLLRRSRCGGGEHHLLLLARGFVTAECHRPVVLHKRGSDILHDPWFNRGTGFSMTERDRLGLRGLLPPNVVSSQQQIDRFTPTLKYQYKFHSEIQHIDAKGLALNYLNISPAICESSQYCVNADKYARDGPSDTYPLAKWRILNRLHDRNETMYYKAEVLIDNIEEHAPIVYTPTVGLVCQNYSGLFRRPRGMYFSAEDRGEMMSMVYNWPADQVDMIVVTDGSRILGLGDLGVHGIGIAIGKLDLYVAAAGINPQRVLPVMIDVGTNNEKLLKDPLYLGLQEHRLEGEEYVAIIDEFMEAVFARWPNVIVQFEDFQSKWAFRLLQRYRKTYRMFNDDVQINALSLALTSAGIGVVNAASRTMARMLGNNEVAFESARSQFWIVDAHGLITEERTNIDPDARPFARRKSELGHQGLSEGASLVEVVKKVKPDVILGLSAVGGLFSKEVLEALKDSSSSRPAIFAMSNPTKNAECTPEEAFSILGEKIIFASGSPFSDVDLGNGKIGHSNQGNNMYLFPGIGLGTLLSGARVISDGMLQAAAERLASYMKEEEVLEGIVYPPISRIRDITKEVAAAVVKEAVAEDLAEGYRDMDARELARLSEVEETVEYVQQNMWSPVYPTIVYKKD

SEQ ID NO: 66348 - protein, 298 aa, Saccharomyces cerevisiae
MSTSVPVKKALSALLRDPGNSHCADCKAQLHPRWASWSLGVFICIKCAGIHRSLGTHISKVKSVDLDTWKEEHLVKLIQFKNNLRANSYYEATLADELKQRKITDTSSLQNFIKNKYEYKKWIGDLSSIEGLNDSTEPVLHKPSANHSLPASNARLDQSSNSLQKTQTQPPSHLLSTSRSNTSLLNLQVSSLSKTTSNTSVTSSATSIGAANTKTGNRVGEFGQRNDLKKSILSLYSKPSAQTQSQNSFFTSTTPQPCNTPSPFVNTGITATNNNSMNSNSSSNISLDDNELFKNVWS

SEQ ID NO: 66349 - protein, 173 aa, Helicobacter pylori J99
MNLDQLEVSHDADSLCVVIEISKHSNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 66350 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFYGPTLAFKDFGGRFMAQMLTHIADDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSFGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 66351 - protein, 204 aa, Zea mays
  misc_feature (147)..(147): Xaa can be any naturally occurring amino acid
  misc_feature (164)..(164): Xaa can be any naturally occurring amino acid
  misc_feature (173)..(173): Xaa can be any naturally occurring amino acid
MAQQSLIYSFVARGTAILVEFTDFKGNFTSVAAQCLQKLPSSNNKFTYNCDGHTFNYLVEDGFTYCVVAVDSAGRQIPMAFLERVKEDFNKRYGGGKAATAQASSLNKEFASKLKEHMQYCMDHPDEISKLAKVQAQESEVKGAMMXDIEQVLDRGEMIELLVXKTENLRSQXLDFTTTGTQMRRECGFRHEDKLIGLAIIAAM

SEQ ID NO: 66352 - protein, 275 aa, Brucella suis 1330
MTVPTVKLNDGNHIPQLGYGVWQISNDEAVSAVSEALKAGYRHIDTATIYGNEKGVGKAINGSGIARADIFLTTKLWNSDQGYESTLKAFDTSLKKLGTDYVDLYLIHWPMPSKDLFMETWRAFIKLKEEGRVKSIGVSNFRTADLERLIKESGVTPVLNQIELHPQFQQDELRLFHGKHDIATEAWSPLGQGKLLEDPTLKSIAEKHAKSVAQIILRWHIETGNIVIPKSITPARIKENFDIFDFTLNGTDHDAITKLDMADGRIGPNPSVFSA

SEQ ID NO: 66353 - protein, 496 aa, Alteromonadales bacterium TW-7
MHQVPLLIDGEFIQSASKELIDVINPANQEVLAQVPCTTDAEMDAAIASASETFKTWKDVPITERARIMMKYAALLKEHHDELATIICHELGKTFEDAKGDVWRGIEVVEQAANAPSLMMGETMENVARKIDTYSYMQPLGVCAGVTPFNFPAMIPLWMFPLAIVCGNTFILKPSEQDPLTPMRLAELFIEAGAPKGVLQIVHGTKPQVDRLLEDKAVRAISFVGSCGVGAYIYSKGTQNLKRVQACVGAKNHMVIMPDASKSHVVNNLVGASVGAAGQRCMGISVAVFVGQASEWVDEIKAGFEKVRPGLWDDKDAAYGPQTSKAAKERILSLIKSGKEQGATCLIDGSHFTVEGYEQGNWVGPTLFTDVTKEMDLYKEEIFGPVLACMFVDTLEEAIALINESPYGNGTSLFTSSGAVARKFQHEIEVGQVGINVPIPVPLPFFSFTGWKGSFYGDTHTYGKQGIRFYTETKTITSRWFEDDIASGPNMSINLK

SEQ ID NO: 66354 - protein, 351 aa, Ipomoea hederacea
ERLASSGIERIPKEYIRPEEERRSIGDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKTPSDYIDATKEYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFAQHIKHKLFRQSDQEAADTPKPDN

SEQ ID NO: 66355 - protein, 357 aa, Vigna angularis
MASISSNKNAIFSFLLLSIILSVSVIKVCEAQARPPTVRGLSYTFYSKTCPTLKSIVRTELKKVFQSDIAQAAGLLRLHFHDCFVQGCDGSVLLDGSASGPSEKDAPPNLTLRAEAFRIIERIRGLLEKSCGRVVSCSDITALAARDAVFLSGGPDYEIPLGRRDGLTFASRQVTLDNLPPPSSNTTTILNSLATKNLDPTDVVSLSGGHTIGISHCSSFNNRLYPTQDPVMDKTFGKNLRLTCPTNTTDNTTVLDIRSPNTFDNKYYVDLMNRQGLFTSDQDLYTDKRTRGIVTSFAVNQSLFFEKFVFAMLKMGQLSVLTGNQGEIRANCSVRNANSKAFLSSVVENVAQEFIEM

SEQ ID NO: 66356 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALCDQLNPGEYGLFLGTAHPAKFKESVEA

SEQ ID NO: 66357 - protein, 351 aa, Ipomoea purpurea
ERLAGSGIERIPKEYIRPEEERRSIGDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKTPSDYIDATKEYAKQLRALATKVYAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNKEKVRVSWAVFCEPPKDKILLQPLPETVSWTEPPRFPPRTFAQHIKHKLFRQSDQEAADTPKPDN

SEQ ID NO: 66358 - protein, 136 aa, Glycine max
MATISAAITTPSITRACLVQKRSLGFSSPVLGLPAMGKVGRVSCSMEEKPSSVKESSSSMLGMGASLMAAASAAAMSGPAMALVDERLSTEGTGLPFGLSNNLLGWILFGVFGLIWALYFVYTSSLEEDEESGLSL

SEQ ID NO: 66359 - protein, 484 aa, Mannheimia succiniciproducens MBEL55E
MSTKGDIGVIGLAVMGQNLILNMNDNGFKVVAFNRTTTKVDEFLQGAAKGTNIIGAYSLEDLAAKLEKPRKVMLMVRAGDVVDQFIDALLPHLEQGDIIIDGGNSNYPDTNRRTKALAEKGIRFIGTGVSGGEEGARHGPSIMPGGNPEAWPYVKPILQAISAKTDKGEPCCDWVGAEGAGHFVKMVHNGIEYGDMQLICEAYQFLKEGLGLSYEEMHEIFQQWKQTELDSYLVDITTDILAYKDTDGQPLVEKILDTAGQKGTGKWTGINALDFGIPLTLITESVFARCVSSFKEQRVAAAKLFNKTVSPVEGDKKVWIEAVRKALLASKIISYAQGFMLIREASEQFGWNINYGATALLWREGCIIRSAFLGNIRDAYETNPDLVFLGSDPYFKGILQNALADWRKVVAKSIEAGIPMPCMASAITFLDGYTSERVPANLLQAQRDYFGAHTYERTDKPRGEFFHTNWTGRGGNTASTTYDV

SEQ ID NO: 66360 - protein, 186 aa, Oryza sativa Japonica Group
MAAAAAGGGGFEARVARIASTIRVIPDFPKPGIMFQDITTMLLKPDAFRDTIELFVERYKDKGITVIAGVEARGFIFGPPIALALGAKFVPLRKPKKLPGEVISEEYSLEYGTDKIEMHVGAVEPNGRAVVVDDLIATGGTLSAAVKLIERAGAEVVECACVIELPELKGRDKLGNKPVFVLVKAD

SEQ ID NO: 66361 - protein, 78 aa, Novosphingobium aromaticivorans DSM 12444
MSDTADRVKKIVVEHLGVEADKVTEEASFIDDLGADSLDIVELVMAFEEEFGVEIPDDAAEKISTVSDAIKYIDENKG

SEQ ID NO: 66362 - protein, 631 aa, Bacillus anthracis str. Ames
MKMLTVENLSKSYGEKPLFDGLSFSIAEGQRAGIIGVNGTGKSTLLKIIAGAEIPDTGDMTHSRGYTISYLSQQPEFDEQLTVLEQVFHGDTPLIRLLRDYEKALLHIEKDPSNEKVQEQLFAVQQRMDAMSVWEANANAKSLLTKLGITDFTATVGNLSGGQKKRIAMAQCFIETPDLLILDEPTNHLDHETVEWLEEYLARYTGAVLLVTHDRYFLDRVTNRIFELDNGKLYSYEGNYSTFLEAKALREEQELAQESKRQNLYRRELAWIRRGAKARSTKQKARIQRFEELKGQEGPAAKQSVDIALSGSRLGKKVLELKDVTKKFGDKTVLNNFNHIVKPGDRIGIIGANGSGKSSLLNMLAGKISPDSGEIEVGQTVKIAYYTQENEEMNLNQRMIEYIKEIAEVIHTTDGKVIGASQMLERFLFPPHSHGTPLGKLSGGERRRLYLLRILMGEPNVLLLDEPTNDLDPQTLTVLEDYLEDFSGVVLTVSHDRYFLDKVVDELFIFTGEGEVREFLGSYTDYLEMEKTRELIEKAEVQKEKKVVEEAPKQQRKRKLSYNEQREWETIEDTIAELEEKLESIGEELANVGSDFTKAQELSEAQQKTEEELEKTMERWSELSDIVEGLK

SEQ ID NO: 66363 - protein, 435 aa, Novosphingobium aromaticivorans DSM 12444
MAQCARDRTMSDPQWYSTGRDHVWLPYTQMKTARPPLPVASAEGVKLRLADGRELVDGISSWWATVHGYRHPHIEEAIRRQLETLPHVMLGGLAHEQAYTLARRLAGMLPGDLDHVFFSDSGSVAVEVAMKMAAQFWLNQGHRRVKFLCFRGGYHGDTFATMSVCDPDEGMHSLFRGALLEQVVVDLPRDAEGEAALGALIEQHRGELAGIVVEPLVQGAGGMVFHDPFTLQALRRLADEHELLLIFDEIFVGLGRLGDAMFACQIAGVQPDIVTLSKALTGGNLPLAATIASGRIYDAFLSDDPMHALMHGPTYMGNALGCAAANASLDLFESEPRLEQAQAIGRGLEQALEVLRGLPGVRDVRVRGAIGVIQLDRTAPADRLSAACIDRGVWLRPFRDILYTTPPLVTGEEDLARITSAMVEAVTEWSRETHV

SEQ ID NO: 66364 - protein, 467 aa, Salmonella enterica subsp. enterica serovar Paratyphi B str.
MVDQVKVAADEQAPAEQSLRRNLTNRHIQLIAIGGAIGTGLFMGSGKTISLAGPSIIFVYMIIGFMLFFVMRAMGELLLSNLEYKSFSDFASDLLGPWAGYFTGWTYWFCWVVTGMADVVAITAYAQFWFPGLSDWVASLAVVILLLSLNLATVKMFGEMEFWFAMVKIVAIVALIVVGLVMIAMHFKSPTGVEASFAHLWNDGGWFPKGISGFFAGFQIAVFAFVGIELVGTTAAETKDPEKSLPRAINSIPIRIIMFYVFALIVIMSVTPWSSVVPDKSPFVELFVLVGLPAAASVINFVVLTSAASSANSGVFSTSRMLFGLAQEGVAPKAFAKLSKRAVPAKGLTFSCICLLGGVVMLMVNPSVIGAFTMITTVSAILFMFVWTIILCSYLVYRKKRPHLHEKSIYKMPLGKLMCWVCMAFFAFVLVLLTLEDDTRQALIVTPLWFIALGLGWLFLRKNKLAK

SEQ ID NO: 66365 - protein, 133 aa, Sulfolobus tokodaii
  misc_feature (1)..(1): Xaa can be any naturally occurring amino acid
  misc_feature (10)..(10): Xaa can be any naturally occurring amino acid
  misc_feature (30)..(30): Xaa can be any naturally occurring amino acid
  misc_feature (73)..(73): Xaa can be any naturally occurring amino acid
  misc_feature (93)..(93): Xaa can be any naturally occurring amino acid
  misc_feature (126)..(126): Xaa can be any naturally occurring amino acid
  misc_feature (130)..(130): Xaa can be any naturally occurring amino acid
XEEEIVKEYXKTQVISVTKDAKLNDIAKVXTEKNIGSVIVVDGNKPVGIITERDIVKAIGKGKSLETKAEEFXTASLITIREDSPITGALALXRQFNIRHLPVVDDKGNLKGIISIRDITRAIDDXFETXGEY

SEQ ID NO: 66366 - protein, 307 aa, Cryptococcus neoformans var. neoformans JEC21
MTQPQQPLSLLESFLCGGLAGCGAVTITNIPETMKTRLQLQGELQRNDPSAPRVYRNVLDVFRKTWQHEGIRGLQRGLVPAYGYQTLLNGSRLGLYEPCRRLFNRAIGKDPNEGVFITAITAGAVTGCIGASLGSPLFLIKARMQAYSPHIPVGAQHYYKNSYDALRTILKSDGFFGLWRGVSTAILRTAMGSSVQLPSYNLSKYYLVSSAGMASDSFWTFLAASSVSGVCVCIAMQPPDTALTRMYNQNTIKDPITGKVRGALYTNPFDCLWKTFKAEGIAGWYKGTTAHFLRITPHTIFTLVFNE

SEQ ID NO: 66367 - protein, 167 aa, Rhodococcus sp. RHA1
MSTSHTLSVLVEDKPGVLARVAALFSRRGFNIESLAVGGTELPEISRMTIVVTVDEFPLEQVTKQLNKLINVIKIVEQDGEASVARELVLIKVRADASVRTQVIETVNLFRAKVIDVSPESVTIEATGTRSKLDALLRMLDPYGIREIVQSGVVAVGRGPKSITATR

SEQ ID NO: 66368 - protein, 625 aa, Novosphingobium aromaticivorans DSM 12444
MLTINGITVRLGGRDIISRASVAVPPRARVGLVGRNGAGKSTLVKAIIGEIEPDEGAVEMPRRTRLGYLAQEAPAGDSTPFETVLSADRERTELLAEAETCTDPDRLGDVHERLLAIDAYSAPARAARILIGLGFDEDMQARPLDSFSGGWRMRVALASLLFSAPDVLLLDEPSNHLDLEATLWLENFLKAYPGTLLLISHERDLLNNVTDHIVHLHAGKLTLYPGGYDSFERQRNERLAQQAAARAAQEAQADRLKDYIARNSARASTAKQAQSRAKMLAKMQPIAAVVEDPSLSFDFPDPEELRPPLITLDLASVGYAPGKPVLQRLNLRIDPDDRIALLGRNGNGKTTLARLLAAQLAPMDGAMTATSKMQVGYFTQYQVEEIAGGATPLELMTRAMEGKTPAAIRAQLGRFGFSGNRATAEVGTLSGGERARLALALVTRDAPHLLVLDEPTNHLDIDAREALVQALNAYKGAVILISHDRHMAELVADRLVLVDGGTARPYDGSIEDYIDFILGRNQPKADGAGEAREKGAAQDRKARALAREELRALRKKQTEAETRVGKLQSEIAQIDRAMFEPSSAPPALAKLTMGDLAHRRGKLAKELEEAEMLWLEAGEALEAAG

SEQ ID NO: 66369 - protein, 449 aa, Glycine max
MGSHQQEPWLLENGKPRVLTKETRHGRSAHRMSSTSLRKKSSRTLVSKVPCATLRNFLSNLQEVILGTKLSILIPAIPAAIVAECFGFGRPWIFILSLLGLTPLAERVSFITEQVAFYTGPTVGGLLNATCGNVTELIIAIFALSSNKIAVVKYSLLGSILSNLLLVLGTSLLCGGIANVGVEQKYDRRQADVNSLMLLLGLLCYLLPMLFKYSGASAALTVDPSLHLSRASSIVMLIAYVVYIVFQLWTHRELFEEEDDGKDGEDGSEEQAVIGLWSGIAWLVGMTVFIAVLSEYVVDTIEDASDSWGLSVSFLSIILLPIVGNAAEHAGAIIFAFKNKLDISLGVALGSATQIAMFVVPLCVIVAWIMGINMDMNFNLLETGSLALAIIVTGFTLQDGTSHYMKGLVLLLCYIVIGACFFVQRTPFNNQADVTNITLKPATNAVLSA

SEQ ID NO: 66370 - protein, 560 aa, Pneumocystis carinii
MEHSFYERKGNEQLTSWGLLILMVLLIMALWVSYYLQDKRVRSMHETVISILLGMIVGVLIKEIKNTDIQKIVTFNYGYFFNLLLPPIILNSGYELHQELFFKNAGAIFTFAFVGTFVSAVITGLLIYLWALTGLEQIGISWIEALKFGATISATDPVTILSIFRTYNVDPTLYTIIFGESLLNDSVSIVMFETLQRFYNKEMSIIDVFIGIGRFFIIFIISLTIGIIAGISIALLLKYSHLRRFPYIESCIITLIAYSSYLFSNGCHMSGIVSLLFCAITLKHYAFYNMSIQTQFSTKFLFKILSQLSENFIFVYLGISLFTQENLVYKPLLILVTMLFVCIARYISIFSISKLINMIIESYNIVFYEKLPTSYQFMLFWSGLRGAVGVALIQALEGKEANTFKATILVVVVLTVIIFGGTTPQMLEITGIRMGITNYQDDYHMESFYNENPSLEETIYDRFQYRKSGQLDSFNVLYPFWIGSSETQGNEEDNTNRESFDSNLFFPTVTEPAKLEDISYTSYEMTNEDISTDKDKLSTSNNHIKWFKNFDSKVLMPFRC

SEQ ID NO: 66371 - protein, 204 aa, Zea mays
  misc_feature (40)..(40): Xaa can be any naturally occurring amino acid
  misc_feature (67)..(67): Xaa can be any naturally occurring amino acid
  misc_feature (96)..(96): Xaa can be any naturally occurring amino acid
  misc_feature (104)..(104): Xaa can be any naturally occurring amino acid
  misc_feature (112)..(112): Xaa can be any naturally occurring amino acid
  misc_feature (117)..(117): Xaa can be any naturally occurring amino acid
  misc_feature (132)..(132): Xaa can be any naturally occurring amino acid
  misc_feature (161)..(161): Xaa can be any naturally occurring amino acid
  misc_feature (166)..(166): Xaa can be any naturally occurring amino acid
  misc_feature (180)..(180): Xaa can be any naturally occurring amino acid
  misc_feature (185)..(185): Xaa can be any naturally occurring amino acid
WHTKRTVCTLLLSDLKRNKEDMHTYLNDPVDNAHNISDHXRIRASVPTMKILLKKMATDILASRLSXTKDGTPEYGLNPLVTHLSEILGDEGGMFXDRIGEETXTNIAALPXGSMLXLDNVIFYEEDEKNEXENAKNLASDADLNANDAFGTAHTARASTXGVTKXLKPADAGYRMQNEXDHLVXCVVHPKKPFAALAGASKGS

SEQ ID NO: 66372 - protein, 401 aa, Staphylococcus aureus subsp. aureus MRSA252
MVTRSVLKFGGSSVSDFTKIKRIAEMLKERVNQDEQLIVVVSAMGNTTDQLMTNVSTLTKTPKQQELALLLTTGEQQTVSYLSMVLNDIGVNAKAMTGYQAGIKTIGHHLKSKIAQINPQTFEQAFQENDILVVAGFQGINDHQELTTLGRGGSDTTAVALAVSNQIPCEIYTDVDGVYATDPRLLPKAKRLDIVSYEEMMEMSALGAGVLETRSVELAKNYNIPLYLGKTLSNVKGTWIMSNEEILERKAVTGVALDKHMMHVTISYPLPDNQLLTQLFTELEEGAVNVDMISQIVNLDGLQLSFTIKDSDFHQISMILKTLKNQYEALAYKINEHYVKISLIGSGMRDMSGVASKAFLTLIENNIPFYQTTTSEISISYVIDDFNGQQAVEKLYDAFNI

SEQ ID NO: 66373 - protein, 494 aa, Streptomyces glaucescens
MAARTDNSIVVNAPFELVWDVTNDIEAWPELFSEYAEAEILRQDGDGFDFRLKTRPDANGRVWEWVSHRVPDKGSRTVRAHRVETGPFAYMNLHWTYRAVAGGTEMRWVQEFDMKPGAPFDNAHMTAHLNTTTRANMERIKKIIEDRHREGQRTPASVLPTELHAQQLLLLAASGRLARIVHVLTELRIADLLADGPRHVAELAKETDTHELSLYRVLRSAASVGVFAEGPVRTFSATPLSDGLRTGNPDGVLPLVKYNNMELTRRPYDEIMHSVRTGEPAFRRVFGSSFFEHLEANPEAGEFFERFMAHWSRRLVLDGLADQGMERFSRIADLGGGDGWFLAQILRRHPHATGLLMDLPRVAASAGPVLEEAKVADRVTVLPGDFFTDPVPTGYDAYLFKGVLHNWSDERAVTVLRRVREAIGDDDARLLIFDQVMAPENEWDHAKLLDIDMLVLFGGRERVLAEWRQLLLEADFDIVNTPSHTWTTLECRPV

SEQ ID NO: 66374 - protein, 283 aa, Klebsiella pneumoniae
MPFPDTLHLESDLATALAASRDILVVVPSHVFGQVLRQIKPLMRSDARLVWATKGLEAETGRLLQDVAREALGDDIPLAVISGPTFAKELAAGLPTAISLAATDPQFAEDLQRLLHCGKSFRVYINPDFIGVQLGGAVKNVIAIGAGMSDGIGFGANARTALITRGLVEMSRLGAALGADPETFMGMAGLGDLVLTCTDNQSRNRRFGMMLGQGMDVQSAQDKIGQVVEGYRNTKEVRVLAQRLGVEMPITEEIYQVLYCGKIAREAALTLLGRARKDERSSN

SEQ ID NO: 66375 - protein, 622 aa, Marinobacter sp. ELB17
MSYQVLARKWRPRTFEDMVGQEHVLQALIHALESQRLHHAYLFTGTRGVGKTTIGRLLARCLNCETGITAKPCGVCGSCREIQEGRFVDLIEIDAASRTGVDDMRELTDNVQYSPTRGRFKVYLIDEVHMLTNQSFNAFLKTLEEPPEHVKFLLATTDPQKLPVTVLSRCLQFNLKRMTPEHIAGHLNHVLTAEKIPFEEPALWLLARAADGSMRDALSLTDQAIAFGNQQLAASDVSSMLGTINQRDIESLVGTLVARDGPALLTEIGRIADFAPDYGVILADLLSLFHRVTMEQVVPGSADNALGDARQIQALAKKLSAEDAQLFYQVALMGRKDLAITPDARMGFEMTLLRMLAFRPGAARREPPTAIAVESAPAGNRDEPDPVAASSNQPESPVPEKPEPLAPAASAPPPTERTPVESIPPWEPQPGTDVDYPDDGAFYGADEAFEAAVQPKSQPDDQPMQPVPSASELSAQPEVAEEALADGEFVWQRDFRSLNIAGMPGNLASHGSMLHEGNTVLLTIDEGHARLLNARHEEKILAALRNRFGDATELRIERGRPDDTPAAYEERQRKIRQQAAEQAIRTDPLVQSIVDRFAARVVEDSIRPIEVPRKSPAGSNRR

SEQ ID NO: 66376 - protein, 425 aa, Saccharophagus degradans 2-40
MLDPNSRYVSRLTRDTVALVLAGGRGSRLHELTDWRAKPALHFGGKFRIIDFPLSNCVNSGIRRIGILTQYKAHSLIRHVIRGWSSFKKEFGEYVEILPASQRYSPNWYQGTADAIYQNLDILQAEAPKYILVLSGDHVYQMDYGAIIAHHVETGADLTVSCIEVPIEEAAGSFGVMTVDDDNRIIRFDEKPQRPTELANKPGYTLASMGNYVFNTEFLFDQLRKDAADPDSEHDFGKNIIPNIIAEKLVSAYRFRDHDTNETAYWRDVGTLDSFWEANMELVSPNPSLNLYNHDWPIWTYQTQLPPAKFVFDDDSRRGYAVDSMVSGGCIVSGGKVKSSLLFSDVHIHSYAEIEESVLLPEVEVHRSAKIKKAIIDSACVIPEGMIIGHDHEHDKARGFRVTKKGVTLVTREMLGQQPAGTSAK

SEQ ID NO: 66377 - protein, 377 aa, Neisseria meningitidis FAM18
MSTPALLVLADGSVFHGTSIGYEGSTSGEVVFNTSMTGYQEILTDPSYCKQIVTLTYPHIGNTGTNAEDEESRSVYAAGLIIRDLPLLHSNFRASESLHDYLVRNKTVAIADIDTRRLTTLLREKGAQGGAILTGADATVEKAQELIAAFGSMVGKDLAKEVSCTETYEWTEGEWELGKGFVTPDEQPYHVVAYDFGVKTNILRMLASRGCRLTVVPAQTSAQDVLALNPDGVFLSNGPGDPEPCTYAIEAVQKLMESGKPIFGICLGHQLISLAIGAKTLKMRFSHHGANHPVQDLDSGKVVITSQNHGFAVDADTLPANARITHKSLFDNTLQGIELTDKPVFCFQGHPEASPGPQDVGYLFDKFIGNMKAAKRA

SEQ ID NO: 66378 - protein, 266 aa, Ralstonia eutropha JMP134
MSSAFRPDALAGKTVFVAGGSSGINLGIAQSFARSGAKLALISRDPERVAAAAATITEAGGTAIGMAADVRDYAAVEAALKQARDTFGQIDIVISGAAGNFLAPVVGMSANGFKTVVDIDLIGTFNVFRASFDYLNKPGASLIAITAPQGVNAMMFQAHACAAKAGINMLVKCLAMEWGPAGVRVNGISPGPIADTEGMARLAPTPEMEARYKGRLPLRDYGSKQDIADAALYLSCDNARYVTGTILDCDGGSKLGDASADALKTK

SEQ ID NO: 66379 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 66380 - protein, 350 aa, Ipomoea trifida
ERLAGSGIERIPKRYIRPEKERPSIGDIFAEEKMAGGPQVPTVDLKGINSEDLEVREKCREELRKAAVDWGVMHLVNHGIPEELTARVKAAGEGFFGQPIEEKEKYANDQAAGNVQGYGSKLANNASGQLEWEDYFFHCVFPEDKADLSIWPKTPSDYIAATREYAKQLRALTTTVYAVLSQGLGLEEERLEKKWRDGRASSTNEDNYYPKCPQPELALGVEAHTDVSALTFILHNMVPGLQLFYEGKWVTAKCVPNSIIMHVGDTVEILSNGKYKSILHRGVVNREKVRVSWAVFCEPPKEKIILQPLPETVCRADPPRFPPRTFAQHIKHKLFRLTDQEGADTPKPDE

SEQ ID NO: 66381 - protein, 494 aa, Mannheimia succiniciproducens MBEL55E
MKAENNCIVIFGASGDLTHRKLIPALYNLYKIGRLSENFSVLGVARTELSNEKFREKMRSALIEHEKADGDELNNFCSHLYYQAVNTSDAADYVKLIPRLDELHDKYKTCGNTLYYLSTPPSLYGVIPECLAAHGLNTEEFGWKRIIVEKPFGYDMKTAKELDVQIHRFFDEHQIYRIDHYLGKETVQNLLVLRFSNGLFEPLWNRNYIDYIEITGAEELGVEQRGGYYDGSGAMRDMFQNHLLQVLAMVAMEPPAIINADSMRDEVAKVLYCLHPLEPNDLQHNLVLGQYAATQLNGERVKGYLEEKGVPPDSNTETYMALRCKIDNWRWAGVPFYVRTGKRLAARVTEVVIHFKKTPHPVFSQEAPENKLILRIQPDEGISMRFGLKKPGAGFEAKEVSMDFRYSDLNGASLLTAYERLLLDAMKGDATLFARTDAVHACWKFVQPILDYKANGGRVYEYEAGSWGPVEADKLIAQHGRVWRKPSGQMKKKV

SEQ ID NO: 66382 - protein, 267 aa, Mannheimia succiniciproducens MBEL55E
MQITQQLLDDVLKIASLAGEHLKTFYAKSVNVEIKTDNTPVTEADLFLSQFLIEKLTVLTPDIPVLSEENCNIPLAERQKWQSYWLIDPVDGTQQFINHTGQFSIMICLVQDNQPQLGIIHAPIIGKTYYARRGLGAFLIENGCCRKLPPLQPHNHQHIKITIGSSNPEKIRQSVQPPYKADLLLYGSSSLKSGLVAEGVADCYVRLGNTGEWDTAAAEVLLNEVGGKIFNLQYRPLTYNQRETLVNPHFVMANAQLDWKKIFRFDL

SEQ ID NO: 66383 - protein, 235 aa, Brassica napus
MASSSSSDAWMREYNEALKLSEDINGMMSERNSSGVTGPDAQRRASAIRRKITILGTRLDSLQSLLVKVPGKQHVSEKEMNRRKDMVGNLRSKANQVASALNMSNFANRNSLLGPETKPDDAMNRVSGMDNQGIVGFQRQVMREQDEGLEKLEETVMSTKHIALAVNEELTLQTRLIEDLDYHVDVTDSRLRRVQKSLAVMNKNMKGGCSCMSMLLSVLGIVGLALVIWLLVKYL

SEQ ID NO: 66384 - protein, 563 aa, Mycobacterium avium subsp. paratuberculosis K-10
MPVTDAATEPAYTVGDYLLDRLAELGVSEIFGVPGDYNLEFLDHIVAHPRLRWVGNANELNAGYAADGYGRLRGMSALVTTFGVGELSAANAVAGSYAEQVPVVHIVGGPSKDAQGTRRALHHSLGDGDFEHFFRVSREITCAQANLMPATARREIDRVLSEVREQKRPGYILLSTDVARFPTEPPEAALPRYTGGTSPRALAMFTEAAAALIGEHRITVLADLLVHRLQAIKELEALLAADVVPHATLMWGKSLLDESSPNFLGIYAGSASAPAVRTAIEEAPVLVTAGVVFTDMVSGFFSQRIDPARTIDVGQYQSSVAGEVFAPLEMGEALQALTAILTRRGVSSPPVASPPAEPLPPPPPREQPLTQKMVWDRVCTALTPGNVVLADQGTSFYGMADHRLPQGVTFIGQPLWGSIGYTLPAALGAAVAHPDRRTVLLIGDGAAQLTVQELGTFAREGLSPVIVVVNNDGYTVERAIHGETAPYNDIVGWKWTEVPNALGVTEHLAFRVQTYGELDDALTAAARHQDRMVLVEVVLPRLEIPRLLVELVRPTSPDGSPRR

SEQ ID NO: 66385 - protein, 464 aa, Pseudomonas fluorescens Pf-5
MAVYNYDVVVLGSGPAGEGAAMNAAKAGRKVAMVDSRRQVGGNCTHLGTIPSKALRHSVRQIMQFNTNPMFRAIGEPRWFSFPDVLKSAEKVISKQVASRTGYYARNRVDVFFGTGSFADEQTVEVVCANGVVEKLVAKHIIIATGSRPYRPADIDFSHPRIYDSDTILSLGHTPRKLIVYGAGVIGCEYASIFSGLGVLVELVDNRGQLLSFLDSEISQALSYHFSNNNITVRHNEEYDRVEGVDNGVILHLKSGKKIKADALLWCNGRTGNTDKLGMENIGVKVNSRGQIEVDENYRTCVPNIYGAGDVIGWPSLASAAHDQGRSAAGSIVDNGSWRFVNDVPTGIYTIPEISSIGKNEQELTQAKVPYEVGKAFFKGMARAQIAGEPQGMLKILFHRETLEVLGVHCFGYQASEIVHIGQAIMSQPGELNTLKYFVNTTFNYPTMAEAYRVAAYDGLNRLF

SEQ ID NO: 66386 - protein, 437 aa, Pneumocystis carinii
MFMTGQCSKKESKYEPLVMSTRIGRRYNRNKGPDASYKFPMVYPTTRCRLKLLKMERIKDYLLLEQEFVSNQELLKLDSEKRDQKGEEEDDDKLQSLIGSPMGVGTLEEMIDDDHAIVSSATGPEYYVSIMSFVNKDLLEPGCSVLLHHKAVSIVGVLSDDIDPMVSVMKLDKAPTESYADIGGLESQIQEIKETVELPLTHPELYEEIGIRPPKGVILYGEPGTGKTLLAKAVANQTSATFLRIVGSELIQKYLGDGPKFVRELFQTAQDNSPSIVFIDEIDAIGTKRYDSTSSGEREIQRTMLELLNQLDGFDDRGDVKVIMATNRINDLDPALIRPGRMDRKILFETPDQNTKRKIFQIHTSKMNLGDDVLIEEFITAKDEMSGADVKVIAICTEAGLLALRERRMRVVADDFRKAKEHVLKTKQKNIQGELYI

SEQ ID NO: 66387 - protein, 336 aa, Rhodococcus sp. RHA1
MKLAVIPGDGIGVEVTAEALKVLRKLVPDLQTTEYDLGARRYNATGELLPDADLAAIREHDAILLGAIGDPSVTPGVLERGLLLNMRFALDHHVNLRPSQLYPGSKSPLAAQPDIDFVVVREGTEGPYTGNGGAIRVGTPHEIATEVSINTWFGAERVVRYAFALAQTRRKHVTLIHKTNVLSNAGAIWTRAVETVSAEYPDVETAYCHIDAATIYMVTDPSRFDVIVTDNLFGDIITDLAGAVTGGIGLAASGNIDASGTNPSMFEPVHGSAPDIAGQGIADPTAAILSAALLLRHLGRDGDAARIEAAVEADLASRGDSKVVTSEVGDRIAAAL

SEQ ID NO: 66388 - protein, 370 aa, Pneumocystis carinii
MDSKHSVFNVMGQEFVLQKGYEVIKGLGKGSYGVVCSAKNIEVEDNNKVAIKKITNIFSKKMLAKRALREIMLLQHFRNHKNITTLYDMDIVDPSKFNELYLYEELMQANLNSIIRSDQPLTDAHFQSFIYQILCGLKYIHSANVLHRDLKPSNLLINADCKLKICDFGLSRGISVNQGQGTEYMTEYVTTRWYRAPEVMLSFQSYSKAIDLWSVGCILAELLGRKPFFKGSNYVDQLNQIFCILGTPNENIISKIKSASAQSYIRSLPTLPKMPYSKIFPYANPDALDLLNCLLTFDPYDRISCEEALEHPYLIIWHDPNKEPVCSEQFDFGFEAIDSIEEIRQMIINEVSRFKGLTGNQKLYHSISNT

SEQ ID NO: 66389 - protein, 365 aa, Cryptococcus neoformans var. neoformans JEC21
MADFVKLSIFGTVFEVTTRYVDLQPVGMGAFGLVCSAKDQLSGTSVAIKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVAVDIWSTGCIFAEMLEGKPLFPGKDHVNQFSIITELLGTPPDDVIQTIASENTLRFVQSLPKREKVPFSTKFPNADPVSLDLLEKMLVFDPRTRISAAEGLAHEYLAPYHDPTDEPVAAEVFDWSFNDADLPVDTWKVMMYSEILDFHNLGDISQNEAEGPVTGEVPAAPAS

SEQ ID NO: 66390 - protein, 809 aa, Ostreococcus tauri
MDSPHRDKSNDIRRARALEPHVSAHARASRAMGDDEAIERARAASTSAIESTDARERDGESDGRGSAALGKRRADGSTGRALEPFRHRVRQDPEFVESTLRALRDGTTKLLRLETSGLSFEALYGSAYALVLRKQGDALYDAIFGAVTDHLCQHVAISVANVAAEGDVEFLKALETGFLTHRKGTQMLVDVFNYLDRVHLPRSGKANLEPVGKLSMTLWRECVVRNPRIKRRMRSCVLDLIRRERDGERIDRDTLRQVTDMLLGLGESVYVEEFESNVLEETRSYYKALAQKRIDIDDCPTYLKLAETRIDQERDRSEAYMAPTTTTLLVAEVRQQLLKEMSQSLLHNTTSGMVHMLRTSQLDSLSCLYKLFSAMDDLEGIRDLMFEHIKDVGKGIVNDSENEKNPAQFVEELLKYKGKYDDILRVAFANSRVIESQCNQAYQYVANLNPRSPEYMSLYLDQVLRKSPKEMSQNELENIFNRSMGLFRLFHEKDVFEGYYRLHLSRRLLNKRSASDDNELAFIARLKDECGYTFTSKMESMFSDMLTSGDLNREFHETKFASGTPLDASFSVLTTGVWPMRMQKSHPFLPSECEAACAAFEAFYLGRHAGRKIYWQSAMGQAEIKFTVASGEYDLITSTRHMCVLMLFNRHNVLTTAQISQLTLMHDDELKACLQALSCVKGKNVLKRTPDGKEVLPTDTFEVNEDFSSKSSRVKISTISSRRENDHERASKSRQLSDDRKYQVEATIVRVMKTKKRLSHNDIVVEVTAQVKNRFMPTPADIKKYIEGLVEKDYIRRDPNDRRLYEYVA

SEQ ID NO: 66391 - protein, 405 aa, Vibrio cholerae O1 biovar eltor str. N16961
MAGVLGMILAGGEGSRLKPLTETRTKPAVPFGGSYRLIDFALNNFVNADLMRIYVLTQFKSQSLYIHMKKGWNLSGITDRFIDIIPAQMRDGKRWYEGTADAIYQNLRFVEIVAPDQVCIFGSDHIYKMDIRQMLDFHRRMEAELTVSALRMPISQASQFGVIEVDENGKMVGFEEKPSNPKSIPGEPEWALVSMGNYIFEAETLSKELREDAENNQSSHDFGKDIIPKMFPRGKVYVYDFTTNKIKGEKESTYWRDVGTIESYWSAHMDLLDKDPEFSLYNRSWPLHTYYPPLPPATFVDVKDKKVKITDSLISGGSYIQGSTIYKSVLGFRSNIAAGSFISESVILGDVKIGAGCTIKRAIIDKDVEIAAGTIIGEDLEMDRKRFHVSDEGIVVIAKGSKVGF

SEQ ID NO: 66392 - protein, 277 aa, Pneumocystis carinii
MHKKDIKRSDSIYPKKKRDQGGQWMRRKEEKKRRKQGKKSILLNRTSGITWEKDFEGKKTDTIESKREKKEKNFVEENKGIYEEIREKELKRIKRSGLYAKDFFLYQKKNRQKNTYFFAKEWPGLFPIFQSWLKDSLIIIHLPSGPSFYFTISSITPTSCIYRHGRATSHIPELIINNFTTYLGLTVENMFRSLFPTQADFEGRQVVTIHNQRDFIFIRRHRYIFKNDIKVSLQELGPRFTLKLRRLQRGIHDRHADNVVYEYKPGEESNRTRFWLS

SEQ ID NO: 66393 - protein, 393 aa, Mycobacterium avium subsp. paratuberculosis K-10
MTVSRLRPYATTVFAEMSALAARAGAVNLGQGFPDEDGPAEMLKAAQEAIADGVNQYPPGIGIAPLRHAIAAQRHRRYGIEYDPDTEVLVTVGATEAIASAVIGLVEPGSEVLLIEPFYDSYSPVIAMASAQRVAVPLVPHGRGFALDADALRRAVTPRTRALIVNSPHNPTGTVLGATELAAIAEVAVESDLLVITDEVYEHLVFDDHRHLPLAGFDGMAERTITISSAAKMFNCTGWKIGWACGPAHLIAGVRAAKQYLSYVGGAPFQPAVALALETQDAWVADLRDRLRARRDRLAAGLIDIGFEVHDSAGTYFLCADPRPLGYDDSVAFCAALPEKVGVAAIPLSPFCDPAGAHGPADVWNHLVRFTFCKRDDTLDEAIRRLAALRGAG

SEQ ID NO: 66394 - protein, 715 aa, Mycobacterium avium subsp. paratuberculosis K-10
MAENTIKWDKDADGIVTLTLDDPTGSANVMNEHYKESMHNAVERLVAEKDSITGVVITSAKKTFFAGGDLKSMINLGPENAGEAFDTVEAVKRDLRALETLGKPVVAAINGAALGGGLEIALACHHRIAADIKGLVVGLPEVTLGLLPGGGGVTRTVRMFGIQNAFMNILSQGTRFKPDKAKEIGLVDELVGSVEELVPAAKAWIKANPDAHEQPWDKKGYKMPGGTPSSPALAGILPSFPALLKKQLKGAPMPAPRAILDAAVEGAQVDFDTASRIESRYFTQLVTGQVAKNMIQAFFFDLQHINGGGSRPEGIEPVKINKIGVLGAGMMGAGIAYVSAKAGFDVVLKDVSLEAAQKGKGYSEKLEAKALQRGKTTEEKSKSLLDRITPTADAADFKGVDFVIEAVFENQELKHKVFQEIEDIVEPNALLGSNTSTLPITGLATGVKRQEDFIGIHFFSPVDKMPLVEIIKGEKTSDEALARVFDYTLASGKTPIVVNDSRGFFTSRVIGTFVNEALAMLGEGVAPASIEHAGSQAGYPAPPLQLSDELNLELMHKIAVATRKGIEDAGGTYEPHPAEAVVEKMIEIGRPSRLKGAGFYEYVDGKRTRLWPGLQETFNSGSTSIPLQDMIDRMLFAEALETQKCLDEGVLTSTADANIGSIMGIGFPPYTGGSAQFIVGYEGAHGIGKEAFVARAKELAARYGDRFLPPASLTS

SEQ ID NO: 66395 - protein, 300 aa, Magnaporthe grisea 70-15
MANVTGVASATDMPIQAVFAEVSQHFQQLTMMERLWATWYTWMQNDVLATGLLTFIIHEVVYFGRSIPWIIMDSMPIFQKYKIQQTKVPTIKEQLHCAGLVLLSHFTVELPEIWVFHPVAIYCGMAFDVPFPPAWKIALHIAVFFVLEDAWHYWTHRLMHYPPLYRSIHKLHHTYTAPFGLTAEYASPIEVLVLGLGTAGTPLLWVYLTGDLHLFTMQAWIVLRLLQAVDAHSGYEFPWSLHHILPFWAGAQHHDIHHEQFVGNYASSFRWWDYFMDTEAGAEANAKRRERKMAALKKTL

SEQ ID NO: 66396 - protein, 566 aa, Pneumocystis carinii
MIGLYAHVNASKDHFDDVINASPPLEEPQEPPLRGTLYLLFLTLVLGGLQLTCKSRKIFILYYIREGTPYLLSLGLTKHYTSFVWIAAPLTGIIIQPLIGFFSDRSRSKFGRRRPFLVVGTLCVVISLIGLAYFKDIAFFFFSGHEKVAKNMTIIVSIIIVYLLDFSINIVQASSRALIIDMVPMVQQDLANAWASRMIGIFNVVGYLNGYLNLPKIAPALGNTEFKALSVIGSIVLIVCMAVTFFVAKEKRYFMESLFNFFKTIFSTIITLPSEILWICIIQFFAWIELISMVFKVSDSFLCKIFFGTTYVAEIYAEKYCNKYLKYPDHLYTKEKEYLLIEEATRYGSFAFCAFFYYFFIRNIFLSFIFFMDFWSFYFYFMHAFNHTSKINHFFFPLFVSGKKLFKYIFRLKFYNILQNINIQFLWTFGHFIFTLCMLSTILVKSITQATIIIALCGLSWAITLWAPFSLIAIQLSSNNQLHRSGTILGVHNIFITVPQVLSIIMVGIIFKLTGYKKFEDIIKCNDNMDYSFIWIFQISGISALIAMYLSFKIYTNDPSYERNKI

SEQ ID NO: 66397 - protein, 545 aa, Bacteroides thetaiotaomicron VPI-5482
MISIDGLAVEFSGTTLFSDISFVINEKDRIALMGKNGAGKSTLLKILAGVRQPTRGKVSAPKDCVVAYLPQHLMTEDGRTVFAETAQAFAHLHEMEARIDALNKELETRTDYESDSYMALIEEVSALSEKFYSIDATNYEEDVEKSLLGLGFTREDFQRQTSDFSGGWRMRIELAKLLLQKPDVLLLDEPTNHLDIESIQWLEDFLINNGKAVIVISHDRKFVDNITTRTIEVTMGRIYDYKVNYSQYLQLRKERREQQQKAYDEQQKFIAETEAFIERFKGTYSKTLQVQSRVKMLEKLELLEVDEEDTSALRLKFPPSPRSGSYPVTMEGVGKTYGDHVVFRNANLTIERGDKVAFVGKNGEGKSTLVKCIMNEIDHDGTLTLGHNVQIGYFAQNQASLMDENLTVFQTIDDVAKGEIRNKIRDLLGAFMFGGPEESMKKVKVLSGGERTRLAMIKLLLEPVNLLILDEPTNHLDMKTKDILKQALMDFDGTLIVVSHDRDFLDGLVTKVYEFGNKKVTEHLCGIYEFLEKKKMDSLQELEKK

SEQ ID NO: 66398 - protein, 300 aa, Edwardsiella ictaluri
MTSLKAVIPVAGLGMKMLPATKAIPKEMLPIVDKPLIQKVVHECLSAGVKEIILVTHSSKNTIENHFDTSFELEALLEARVKRQLLDEVRSICPPGVTINSVRQHRQLGLGHAILCARPLVGEHPFIVALPDIWLDASTFDPETQNLAAMVRRFEESGRSQVLVQPMPLEALPEYSVINCADAVLEPGQSACMTSIVEKPEDAEKYHSDLSAVGRYVLSAAIWPILAATGFGAWERIQLSDAIATLLQHRPVEAYRQVGLSYDCGDKLGYAEAFVAGGLNHSQQGAAFTAWLQDVQTRIE

SEQ ID NO: 66399 - protein, 348 aa, Pisum sativum
SYADELVKTAKTIASPGRGILAMDESNATCGKRLDSIGLENTEANRQAWRTLLVTVPTLGEYISGAILFEETLYQSTVDGRKIVDVLVEQNIIPGIKVDKGLVPLAGSNNESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVQFEGILLKPSMVTPGAESKDKASPTKVAEYTLNLLHRRIPPAVPGIMFLSGGQSEVEATLNLNAMNKSPNPWHVSFSYARALQNTALKTWGGLPENVKAAQEALLFRAKSNSLAQLGKYIGDGESEEAKKDCCQGYSY

SEQ ID NO: 66400 - protein, 338 aa, Edwardsiella ictaluri
MAILVTGGAGYIGSHTVLALLSRGDEVVVLDNFVNASVQALARVEQICDRQPHLYRGDVRDRALLQQIFAQHVISDVIHFAGLKAVGESVEKPLEYYDNNVSGTLVLLEEMRRAGVQGFIFSSSATVYGDPESVPLTESSRTGGTTNPYGTSKLMVEQILQDVSRARPEMRITALRYFNPVGAHPSGLIGEDPNGIPNNLIPYVAQVAVGKLACLSIFGHDYPTQDGTGVRDYIHVMDLATGHLAALDRRDEGASYKVYNLGTGVGYSVLDIVAAFERCSGVTIPYRFAPRRAGDIAECWSNPALAAQELGWCAQYGLEAMMTDTWRWQQNNPNGYQD

SEQ ID NO: 66401 - protein, 475 aa, Zea mays
MQFALALDTNSGPHQIRSCEGDGIDRLEKLSIGGRKQEKALRNRCFGGRVAATTQCILTSDACPETLVPVGGCYRLIDIPMSNCFNSGINKIFVMSQFNSTSLNRHIHRTYLEGGINFADGSVQVLAATQMPEEPAGWFQGTADSIRKFIWVLEDYYSHKPIDNIVILSGDQLYRMNYMELVHKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 66402 - protein, 132 aa, Schizosaccharomyces pombe 972h-
MSMENRRGRPPTRRQHLFTKDLKSLMYAFGDDVNPAPDSINVLEEIVVDYINEMCLEAARIAGNRNKVKVDDFKFALRDDPKKLGRVEELLRSSNFSVAGHPFQGVLSRIRIFLRINTKMHSFITLNKFILT

SEQ ID NO: 66403 - protein, 436 aa, Bacillus cereus E33L
MNTMQPSAPPHLESTKTIFSNSITKLVVFICWLAILADGYDLGIYGAVLPKLLEDNSWALSPAHAGTIASYALFGMFIGAILVGTITDLIGRKWTLICCLALFSITMGLAALAPSPELFGLWRFIGGIGLGGVIPTASALTVEYSPKKRQSFIYALMFTGYPLGIVLGAILSMFMLEDFGWRIMFGIGMIPLLLIPFIIRYLPESIQFLLSRNRQEEVDKILNRFQIEFHAKEKTHQAPSNIRKKNGFLTLFSKEYIKATLLFWITYIMGMFLIYGLNTWLPQMMRQAGYPLGSSLSFLLMLNITAAIGALFAGAIADRIGAKIVISISYLMAAICIGLLTIKPSVSIIYLLIGLAGIGSVGITQILNAYVIQYFPSHIRATSLGWGLGLGRVGAIAGPILVGIIMTMQYDLAWNFYLFSFAGLLSAISVFFIPTK

SEQ ID NO: 66404 - protein, 209 aa, Zea mays
GRVHEGAHYSDIQSAMSKTAISALARELKGRHLQMIAIGGSIGTGLFVASGRALADGGPASILLAFTIVGAMLFCTCQALGELAVIFPIAGSFSSWATRFIDPSWGFAMGWKYAMQWLIVLPLEIIAASLTLSYWDESLTRAIFVSVFLVVIIVINMFGVKGYGEAEFIFSIIKVIAVIGFILLGIVLNCGGTPDSGYIGGRSRVSLEG

SEQ ID NO: 66405 - protein, 363 aa, Neisseria meningitidis FAM18
MSLKCGIVGLPNVGKSTLFNALTQSGIEAANYPFCTIEPNVGIVEVPDPRMAELAKIVNPQKMQPAIVEFVDIAGLVAGASKGEGLGNQFLANIRETDAIVNVVRCFDDDNIVHVAGRVDPIADIETIGTELALADLASVEKAIVREEKRARSGDKDAQKLVDLCKKLLPHLDEGKPVRSFGLDAEERAMLKPLFLLTAKPAMYVGNVAEDGFENNPHLERLKELAAKENAPVVAVCAAMESEIAELEDDEKAEFLAEMGLEEPGLNRLIRAGYDLLGLQTYFTAGVKEVRAWTIHKGDTAPQAAGVIHTDFERGFIRAQVISYDDFVSLGGEAKAKEAGKMRVEGKEYVVQDGDVMHFLFNV

SEQ ID NO: 66406 - protein, 88 aa, Desulfovibrio vulgaris subsp. vulgaris str. Hildenborough
MAKSIYVGNLPWSATEEQVQDLFSPFGPVLSVKLVSDRDTGRARGFGFVEMDDAEAVAAIEALDNASFGGRTLRVNEARPRAPRPPRY

SEQ ID NO: 66407 - protein, 274 aa, Saccharophagus degradans 2-40
MIKKCLFPVAGYGTRFLPATKSMPKEMLPVVNKPLVQYGVEEALDAGLHEIGFVTGRGKRAIADHFDVSYELEHQIAGTDKEKYLESIRAVISKGSFSYTRQSEMRGLGDAILSGRRLIGDEAFGVVLSDDLCVAADEGVLAQMVRLYKQFRCSIVAVQEVPEDQISKFGVIAGDPIKDGIYQVTNMVEKPEPKDAPSNLAIIGRYILTPDIFEIIENTPPGKNNEVQLTDALMTQAQNGCVLAYKFKGTRFDCGSVAGFVEATNFVYENIYNK

SEQ ID NO: 66408 - protein, 490 aa, Marinobacter sp. ELB17
MDLPANLKPAHNDIHPVYKVIFMLFPIVLAGGSGSRLWPLSRQLHPKQFLPLLGKNSMLQATIARLKGLETAPPTIICNNEHRFLAAEQLRAAGINDAKVLLEPVGRNTAPAIALAALALVRENPNAVLLVLAADHVIDDEAAFRAAVENAARYAAQGKLVTFGIKPDMAHTGYGYIRAGKTLGPAACELDEFVEKPSKETAQSYLTEGNYTWNSGMFLFRADRYLEELKQWRPDILEACTQAMANPVPDLTFIRINEEAFRACPSESVDYAVMEKTGAGVVIEMDAGWSDIGSWSALWEKLDKDANGNACNGDVMLHNASNSLVRADHRLVALVGVENLIVVETKDAIMVAHKDHVEDVKALVASIESDGRHEHINHREVYRPWGVFDSIDNGHRYQVKRITVNPGAKLSVQKHHHRAEHWIVVSGTAMVTNGEKQYLVTENQSTYIPIGEIHSLENPGVIPLELIEVQSGSYLGEDDIVRLQDQYGRA

SEQ ID NO: 66409 - protein, 487 aa, Ralstonia eutropha JMP134
MRRQRKAKIVATLGPASTDIAVIRQLFEAGADVFRLNFSHGTHEDHRARYDAVRQIEAETGRPIAVLADLQGPKLRIGVFAAGKVAVRAGDSFVLDSDPTPGDGTRVHLPHPELFHAAQPGQSLLIDDGKVRLAIESVASGSITTRVVNNGTLSDRKGVNVPDAVIPIPALTEKDRKDLDFALSLGADWIGLSFVQRPSDIVEAREIVGTRAGILSKIEKPAALQQLEEIVRVSDSVMVARGDLGVELPPERVPGVQKRILRVCRQLGKPVVIATQMLESMIDSPVPTRAEASDVASAIYEGADAVMLSAESANGRYPVPAVSMMNRIVTEVERDPLYRNLLDAQHETPLNTRQDAICAALREVTQIIGAVATVTYTSSGATALRAARERPCAPIVSITPNLEIARRLAIAWGIHSTVSPDVKSVDEMVEAATRAALVEGYAAPGDQITIAAGMPFGQGGTTNLLRVAEVGGNAVAGVESVRESATV

SEQ ID NO: 66410 - protein, 261 aa, Saccharomyces cerevisiae
MTKFIGCIDLHNGEVKQIVGGTLTSKKEDVPKTNFVSQHPSSYYAKLYKDRDVQGCHVIKLGPNNDDAAREALQESPQFLQVGGGINDTNCLEWLKWASKVIVTSWLFTKEGHFQLKRLERLTELCGKDRIVVDLSCRKTQDGRWIVAMNKWQTLTDLELNADTFRELRKYTNEFLIHAADVEGLCGGIDELLVSKLFEWTKDYDDLKIVYAGGAKSVDDLKLVDELSHGKVDLTFGSSLDIFGGNLVKFEDCCRWNEKQG

SEQ ID NO: 66411 - protein, 465 aa, Magnaporthe grisea 70-15
MGTVKNIAYYAFHPVELRAIIQWKIWHEPVHTRNPSKERPTETECFKYLDLTSRSFAAVIKELNPELLMPVCIFYLALRGLDTIEDDMTIPNDKKIPLLRNFADFMDQDGWTFNENGPNERDRELLVHFDQVITELKLVKKPYYEIIRDITVKMGNGMADYVLKTENTTNCINTVEEYEMYCHYVAGLVGEGLTRLFVVAELANPKLLERMDLAESMGQFLQKTNIIRDVHEDYIDKRSWWPRSVWSKYAKEYDDLFKPENRQQAVYCCSELVLNALKNVEDCLYYMAGMREQSVFNFVAIPQTMAIATLELVFQNPKIFERNVKITKGDACRIMLRSTQNLRLVTDLFKEYTRKIHQKNDPRDPNYAAISAQCGKIEQFIETIFPSQDPKVLEMAQKDVKMSEKPGMDTSEAVVLILAVIAMFVFSGGLMVGLAWLMGAQFNNFFSSIDAGMKPSPLPSGHQEL

SEQ ID NO: 66412 - protein, 273 aa, Helicobacter pylori J99
MIKKCLFPAAGYGTRFLPITKTIPKEMLPIVDKPLIQYAVEEAMEAGCEVMAIVTGRNKRSLEDYFDTSYEIEHQIQGTNKENALKSIRNIIEKCCFSYVRQKQMKGLGHAILTGEALIGNEPFAVILADDLCISHEYPSVLKQMTSLYQKYQCSIVAIEEVVLEEVSKYGVIRGEWLEERVYEIKDMVEKPSQEDAPSNLAVIGRYILTPDIFDILRETKPGKNNEIQITDALLTQAKRKRIIAYQFKGKRYDCGSVEGYIEASNAYYKKRL

SEQ ID NO: 66413 - protein, 635 aa, Brucella suis 1330
MPKSGVFKATSSTIFKYQEHSMVANGGSLYLQSLMILGGAIIAAPLFKRLGLGTVLGYLAAGITIGPVARLIADGEEFLHFSELGVVFLLFIIGLELNPSRLWSLRHSIFGLGTAQVLLCGAALAALGVYLAGLDTEAAIIIGFGLALSSTAFAMQVLEDRAETNQKHGQRAFAILLFQDLAIVPILAIIPALSPNEPSQASAGFHLATAIASIAALVIAGRYLINPMFRIIANTGAREVMIAAALFVVLGSASLLQYAGLSMAMGAFIAGVLLAESSYRHELEADIEPFRGIFLGLFFVAVGLSLNLSVILEYWAVILAAVPIFMATKIVIIYLLCRIFRSSHNDAVRIAFLLPQGGEFAFVLFSAASAAAIISSALGSELVAAVTVSMALTPLSVAIGSRLLIKDKADDIIEENFDGAGSDVLMIGFSRYGQIAAQILLAGGIDVTVIDSSSNRVRAAGKFGFRIYFGDGTRKDVLEAAGIRKAKIVAICTHKKSTTNHIVNLIQSEYPDVRLFVRSYDREHTLQLRAQGVEYELRETFESGLLFGQRTLEGLGLSEANAYAIREDVRQRDEDRLHVQASEGIMAGRHLLFNKPVTPEPLVKPTREGQRIDKSDDGQRAPSPQETAAAPVAAE

SEQ ID NO: 66414 - protein, 347 aa, Spinacia oleracea
MLAVSYAIPSCCINRFYIREFSSSLQPALHHPWYKKRFGCCSTNQENCSLGSPTHLPRMPGGDLSVAPSVGHLTANNEAWLWDQIKGEARRDADSEPALASYLYSTILSHSSLERSLSFHLGNKLCSSTLLSTLLYDLFLNILSSDSSLLDAVVADLRAARVRDPACVSFSHCLLNYKGFLACQSHRVAHKLWNQDRRPLALALHSRISDVFAVDIHPAARIGKGILFDHATGVVIGETAIIGDNCSILHHVTLGGTGKAGGDRHPKVGDGVLIGAGATILGNVRIGDGAKIGAGSVVLIDVPPRTTAVGNPARLIGGKEKPSQNSDVPGESMDHTSFISEWSDYII

SEQ ID NO: 66415 - protein, 368 aa, Mycobacterium sp. MCS
MKTRAAVLWGLEQKWEVEEVDLDPPGPGEVLVRLAATGLCHSDEHLVTGDLPIPLPVVGGHEGAGTVVECGEGVEELSEGDSVILTFLPSCGRCSYCARGMGNLCELGAALMMGPQIDGTYRFHARGEDVGQMCLLGTFSEYTVVPQASVVKIDGGIPLDRAALIGCGVTTGYGSAVRTGEVRAGDTVVVVGAGGIGMNAIQGARIAGALAIVAVDPVKFKREQASGFGATHTAASMDEAWSLVSDMTLGKLADVCILTTDVAEASYTAEALALVGKRGRVVVTAIGHPDDSSISGSLLEMTLYEKQIRGALYGSSNAPHDIPRLVELYSAGLLKLDELVTREYSLDQINEGYQDMRSGKNIRGLVRF

SEQ ID NO: 66416 - protein, 322 aa, Shewanella oneidensis MR-1
MSKIFEDNSYTIGNTPLVRLNRVSQGKVLAKVESRNPSFSVKCRIGANMIWDAEKKGLLTKDHELIEPTSGNTGIALAYVAAARGYKLTLTMPNTMSLERRKLLKALGANLVLTEGAKGMKGAIDKAEEIRQSAPEKYILLQQFNNPANPEIHEKTTGPEIWNDTDGAVDVFVAGVGTGGTITGVSRYLKKVAGKAITSVAVEPADSPVITQTLAGLPVQPGPHKIQGIGAGFIPGNLDIELIDRVETVTNDEAIEMARRLMQEEGILVGISSGAAVVAANRIAALPEFADKTIVVVLPSAAERYLSSVLFQGQFGDEENIQ

SEQ ID NO: 66417 - protein, 332 aa, Rhodococcus sp. RHA1
MSKAAVLGAGSWGTAFAKVLADAGTDVTMWARRAEVAESIVSRHENADYLPGIALPPSLTATDDARAALDGADIVVLAVPSQSLRDNLQVWSPMIPEDATLLSLAKGIETGTLMRMSQVIIQVTGADPGRVAVLSGPNLAREIAIGQPAATVVACTDSTRALELQKASATGYFRPYTNSDVIGCEIGGACKNVIALACGMASGIGLGENTIASIITRGLAEIIRLGVALGAKPATLAGLAGVGDLVATCTSPLSRNRSFGERLGQGGSIESAQAATHGQVAEGVKSCSSVRALAASYDVEMPLTDAVHRVCHEGVVVQDAIGQLLGRRTKPE

SEQ ID NO: 66418 - protein, 173 aa, Arabidopsis thaliana
  misc_feature (22)..(22): Xaa can be any naturally occurring amino acid
  misc_feature (39)..(39): Xaa can be any naturally occurring amino acid
PRRGYIPGSANKVGSFPRLESXGAFPVTPQDPQGITSIXSNGGRVSCMKVWPPIGKKKFETLSYLPDLSDVELAKEVDYLLRNKWIPCVEFELEHGFVYREHGNTPGYYDGRYWTMWKLPLFGCTDSAQVLKEVEECKKEYPGAFIRIIGFDNTRQVQCISFIAYKPPSFTEA

SEQ ID NO: 66419 - protein, 141 aa, Microcystis aeruginosa NIES-89
NQELRDEITEPIAQIKEFVKKIHSGAIKPPNRAKFSHILCVGIGGSALGPQFVAEALSPLNPPLEIAFIDNTDPKGIDRTLAHLPLATTLVIVTSKSGGTPEARNGMLEVRNAYEKLDLDFPQHAVAVTMPGSQLDKYAQD

SEQ ID NO: 66420 - protein, 336 aa, Pseudomonas fluorescens Pf-5
MSTKPTENLATSVDSVSRRFSVAPMMDWTDRHCRFFLRLLSKHTLLYTEMVTTGALLNGDHERFLRYHPSEHPLALQLGGSTPADLAACARMAQEHGYDEVNLNVGCPSDRVQNNMIGACLMGHPALVADCVKAMRDAVSIPVTVKHRIGINGRDSYAELCDFVGQVMEAGCSSFTVHARIAILEGLSPKENRDIPPLRYDVAAQLKADFPQLEIILNGGIKTLEACHEHLQTFDGVMLGREAYHNPYLLAEVDQQLFGSTEPVISRAEALARLRPYIAEHLAAGGAMHHITRHVLGLGTGFPGARKFRQLLSVDIHKTQDPLALLDQAGQLLEGR

SEQ ID NO: 66421 - protein, 488 aa, Vibrio cholerae O1 biovar eltor str. N16961
MRSLAMLPTDFPFFHQSAFINGQWILGEPQARQTVTNPFDGSLIGSVPLLSAAQVQEAIAGAQAAQILWCQQPAENKAKILRRWYELIEQHHESLAKLLTIEQGKPLAEARGEIHYAASFVEWYAEEAKRAYGELIPSHKPDARIMVSRQPVGVVAAITPWNFPAAMITRKCAPAFAAGCAVVLKPAPDTPFTALALADLAQQAGIPDGLLQVVTGDAIEIGRVLTESKTVRKLSFTGSTGVGKLLMAQSANNVKKLSLELGGNAPFIVFEDADINAAIDGVMVAKFRNAGQTCVCANRIYVHDAVYDQFAAKLVDRVSRLNVGYGLDAGVNIGPLINDAAVAKVTSHIVDAQSKGAKVMFGALPEAGSRLFQPHVLTEVTDEMRVADEETFGPLAALFRFSSEQEVIERANATDSGLAAYCYTQSLRRAWHMSEALEAGIVGINEGLISTTLAPFGGIKESGLGREGAKHGLEEYLEVKYTLMGGLA

SEQ ID NO: 66422 - protein, 343 aa, Burkholderia mallei ATCC 23344
MKCTLKPIGEQTIVITGATSGIGLVTARKAAKKGAKLVLVARNDTALEALCEEIRQHVGLAVAVAADVSRYEDVQRAAAKAVETFGGFDTWINNAGVTIFGSALSVPLDDQRRLFDTNYWGVVHGSLVASEHFRRKSDFRGGAIINMGSEASDAPVPLQSAYAASKHAIKGFTDSLRIELEADNVPVSVTLVKPAAVDTMFVMHAKNYMNVEAKLPPPIYDPDIVADAILFAAEHARRTLFVGGAAKLASSGAYHAPRLFDRLATSLFSRGQRTMRPARPRDDNALYEPTRPLHEREGMDGVVLRSCAYNTVMQRPRVAGALALTAAALVVAALARARRDVAS

SEQ ID NO: 66423 - protein, 547 aa, Saccharophagus degradans 2-40
MQAKTLADLYSDWDKVQAHAQAWQKRTLKDAFDADRNRAARYSVGAAGLELDFSKNHIDDETLQLLMGVADQANLKAAIKKLLRGDHVNNTEDRPALHSALRFQGKPQTAEHQEVKATLDKMAKLIKSVHSGEWKGYKGEKITDVVNIGIGGSDLGPRMITKALTPFHTGDVKVHFVANIDGAEIHDLTRGLNPSTTLFLVASKSFSTLETLENSLTARKWMLDNGCAQDQLAKHFVAISSKVEKAVEFGIAAENVYPIWDWVGGRYSLWSAIGMPIAFAIGMDNFNKLRAGAAAMDDHFAEAPLERNIPALMGLLMFWYSSCLGTDTQAILPYAYHLQLLPAYLQQLEMESNGKSVTKSGERVDYQTGSIVWGTEGTNGQHSFHQLLHQGTTMVPIDFIATLQAHHPLDHQHKFLFANCVAQSQALMTGRDQATSEAEMRAQGMSDEQIAELAPHKVHPGNRPSNTILMDKLTPETLGALIAAYEHKVYTLGVLWNINSFDQWGVELGKLLGTHVATAIDTTDIPSDWDSSTQTLVKKFTEANKNL

SEQ ID NO: 66424 - protein, 271 aa, Triticum aestivum
  misc_feature (110)..(110): Xaa can be any naturally occurring amino acid
  misc_feature (172)..(172): Xaa can be any naturally occurring amino acid
  misc_feature (183)..(183): Xaa can be any naturally occurring amino acid
  misc_feature (198)..(198): Xaa can be any naturally occurring amino acid
  misc_feature (210)..(210): Xaa can be any naturally occurring amino acid
NKFVQKSRLVPVRNSRDIVDPRVRKIVDILVEQGIVPGIKVDKGLVPLTGSNDESWCQGLDGLASREAAYYQQGARFAKWRTVVSIPNGPSELAVKEAAWGLARYAAISXDNGLVPIVEPEILLDGEHGIERTFEVAQKVWAETFYQMAQNNVMFEGILLKPSMVTPGAECXDRATPEQVADXHPQLLSRRVAPAVPXIMFLSGGQSEVXATLNLNAMKQGAQTRGTSSFSYGRGAAKHVALKTWGRPARKTSRAAQEAPACCLPKANLPR

SEQ ID NO: 66425 - protein, 180 aa, Zea mays
ACKYEEVSVPVVEDLVLISDRAYTKGQILEMEKLILNTLQFNMSVPTPYVFMKRFLKAADADKQLELVSFFMLELCLVEYQMLNYRPSHLAAAAVYTAQCAINRCQQWTKVCESHSRYTGDQLLECSRMMVDFHQKAGTGKLTGVHRKYSTYKFGCAAKILPAQFMLESGGTAPPPSGAI

SEQ ID NO: 66426 - protein, 225 aa, Oryza sativa Japonica Group
MAAPTAAALSTLSTASVTSGKRFITSSFSLSFSSRPLATGVRAAGARAARRSAASASTVVATIAVGDKLPDATLSYFDPADGELKTVTVAELTAGRKAVLFAVPGAFTPTCSQKHLPGVHREGRGASSQGGGRHCCVSVNDAFVMRAWKESLGLGDADVLLLSDGNLELTRALGVEMDLSDKPMGLGVRSRRYALLADDGVVKVLNLEEGGAFTTSSAEEMLKAL

SEQ ID NO: 66427 - protein, 351 aa, Arabidopsis thaliana
MAKPNIDELNQILTSYQNTINDTLQLFEQVPSPTQDKLYWNDVLQISDHLSKQATIVGMLWITGEPPKAEAMKETMEAYFNALQGFLLHCHGSMVGAGTTLSSTIHASVKQIVDSSFRLLQGSVSLYEGSYEKGRKPTIPQLAGAVWEACSNLKNVPETNIKAIGRAMAHVAVSMKDVLREMKELKPASSSPDHNVSTNSDDDDLGDELSPEEFEVAKMVADIVSETLVVIKELIRAITCMIKLENPKDNSEFVDSFEKLLKLCQGIGVQIDELGACVYPPQEFGLMKQTVENMRESIGEIESDVKSSKNSSSEALSGSCRRLQSLIEHMVTELDTRIEAEVVYKMQNVTL

SEQ ID NO: 66428 - protein, 269 aa, uncultured archaeon GZfos26D6
MRSKFAGRIKNIEISGIRKAFEALSGDFFNLGLGEPDFDTPEHVKIAAMQALKSGFTSYTSNKGIDELREAISAKLYRDNNLAFSPDEMIVTSGASEALHIAIHSVVERGDEVLIPNPGFVSFAALTELAEGKPIGVPLSDDFSISAEAVKEKITDKTKALIINSPANPTGAVESEENIKALVDIAHDHHVTIISDEVYEQLIYDDLKHISPARFSDDVITVNAVSKTYAMTGFRLGYVAARSEYTEQMLKVHQYVQACASSISQKAAL

SEQ ID NO: 66429 - protein, 421 aa, Coccidioides immitis RS
MADLQGRKVFKVFNQDFIVDERYNVTKEVGQGAYGIVCAASNVQTGEGVAIKKVTNVFSKKILAKRALREIKLLQHFRGHRNITCLYDMDIPRPDHFNEVYLYEELMECDLAAIIRSGQPLTDAHFQSFIYQILCGLKYIHSANVLHRDLKPGNLLVNADCELKICDFGLARGFSIDPDENAGYMTEYVATRWYRAPEIMLSFPSYTKAIDVWSVGCILAELLGGRPFFKGRDYVDQLNQILHYLGTPNEETLRRIGSPRAQDYVRNLPYMQKVPFQRLFPNANPEALDLLDRMLAFDPSSRISVEEALEHPYLQIWHDASDEPTCKTTFDFHFEVVEDVHDMRKMILDEVMRFRAHVRQPHIQMGNAGQQAAAQQTSVPIPEENIASWKQDEPRPQEAIHGGMQPNDLEASLQGGMDAMR

SEQ ID NO: 66430 - protein, 485 aa, Mycobacterium sp. MCS
MTNHLLAPAHHVKERLSSVIMVPAPHAVDDRWRRWSRDWPVRELAPAPAGSGLKAVRGDAGLPFVGHTLDYIRFGSDFSRERYDRLGSVSWMGAFGTKMVVIAGPDATREAFTSEAKAFSQDGWSFLIDAFFHRGLMLMSFDEHLMHRRIMQEAFTRPRLTGYVEQVTPCVRSAVPAWPVGPSVRIYPLLKELTLDIATDVFMGGRGKDESDAVNKAFVATVRAASSLVRAPLPGTRFRAGVQGRRVLEDYFFRHLPAARAGETEDLFAALCQATTEDGERFSDEDVVNHMIFLMMAAHDTSTITTTAVTYFLAKYPQWQEAAAAEAAAIGDGLPDIEALEKMTVIDLVIKEALRLLAPVPLVMRKTVRDVAIDGYHIPSNTLCAITPAVNHFDRTIWSDPERFDPSRFDEPRREDQHHRFAWVPFGGGAHKCIGMQFGTLEVKAILHRMLRSFTWKVPENYHVRWDNTSLPIPVDGLPLEMKRR

SEQ ID NO: 66431 - protein, 387 aa, Glycine max
MEHKVATTTEGQSIRCKAAICRKAGEPLCIEEIIVAPPMPGEARIRIICSSLCQTDISFRNMQDHPANFPTILGHEAIGVVESVGEDVTEVAKGDMVVPIFIAECGECIDCKSSKSNLCSKFPFKLSPWMPRHATSRFVDLKGEIIHHFLSVSSFSEYTVVDIAHLTKIDPEVPPSKACLLSCGVSTGVGAAWRTAGVEPGSTVAIFGLGSIGLAVAEGARLCGATRIIGVDINSEKYEIGKKFGITDFVHSGECENKSASQVIIEMTDGGADYCFECVGNASLMHEAYASCRKGWGKTIVLGSDKPGSKLSLSCSEILVSGKSLVGCMFGGLKPKSHVPILIKRYLDKELNLDGFVTHEVEFKDINKAFDLMIKGQCLRCVIWMDK

SEQ ID NO: 66432 - protein, 447 aa, Corynebacterium efficiens
MTVDEQVSNYYDMLLKRNAGEPEFHQAVAEVLESLKIVLEKDPHYADYGLIQRLCEPERQLIFRVPWVDDNGQVHVNRGFRVQFNSALGPYKGGLRFHPSVNLGIVKFLGFEQIFKNSLTGLPIGGGKGGSDFDPKGKSELEIMRFCQSFMTELHRHIGEYRDVPAGDIGVGGREIGYLFGHYRRLANQHESGVLTGKGLTWGGSLVRTEATGFGTVYFVQEMIKAEGETLEGKKVIVSGSGNVATYAIQKVQELGAVVVGFSDSSGWVSTPNGVDVAKLREIKEVRRARVSSYADEVEGAEYHTDGSIWDLTADIALPCATQNELDGDNARTLADNGCRFVAEGANMPSTPEAIDVFRERGVLFGPGKAANAGGVATSALEMQQNASRDSWSFEYTDERLHRIMKNIFKSCADTAKEYGHEKNYVVGANIAGFKKVADAMLAQGVI

SEQ ID NO: 66433 - protein, 602 aa, Coccidioides immitis RS
MGLTCRDIYSVPDLQFCPFASRRSVVHSTAGIVACTQPLAAAAGQKILQQGGNAADAAVAVAAALNMTEPSSTGIGGDMFCLFYNAKTKKVSALNGSGRAAGNLSLDAIRKDLGLAQGETGGIPMTSAHAVTTPGAAAGWVDTVERFGSGRLTLEQILMPAIELGEKGFPVSELASTFWEACEEPIRKASPNFREILKADPQARDGVRCPLPGELFKNPQLSQTFRTLAKEGKEGFYKGRIAEEIVKVVKDLGGYLSLDDLEYHVEVGSQEVDPISLKIDPGEIAGTKREGGGEVEVWEHPPNGQGIVALMALGILKELSRAGKIPHFSKDQHNSVPYLHAIIESLRIAFADAQWWVTDPDVEKVPSQDLISPAYLTERAKLFDPNKASDILDHGSPAHNHCDTVYLAVTDKEGNGISFINSLYGGFGTGIVPRGCGFPLQNRGSNFSLMPGHPNVIAPRKRPYHTIIPAMITNPQDNNSLHTVYGVMGGFMQPQGHVQVLMNMLAFKATPQSALDAPRICIGAGHPQSIDKVDRTVYLEEGISESVAEGLRQMGHQVKILKGFERAMFGRGQVIRCHVEDGQMLYSAGSDLRGDGGAFPAL

SEQ ID NO: 66434 - protein, 173 aa, Rhodococcus sp. RHA1
MAIYALGDREPDIHPDAYVHPDAVVIGNVTLAAGTSVWPQAVLRADYGTITVGADTNIQDGTVIHCTMIDPTVIGTGCVVGHAAHIEGSTIGDHCLIASGSVVLNGSVIGAGSVVGAGAVVPFKFEVPPRSMALGVPAKIRQGYEVPEGHLEMNVKMYAANAAYYRDSLRRLD

SEQ ID NO: 66435 - protein, 141 aa, Microcystis aeruginosa NIES-98
NQELRDEITEPLAQIKEFVKKIHSGAIKPPNRSKFTHVLCVGIGGSALGPQFVAEALAPDFPALEIAFIDNTDPKGIDRTLAHLPLATTLVIVTSKSGGTPEARNGMLEVRNAYEKQDLDFPQHAVAVTMPGSQLDKHAQD

SEQ ID NO: 66436 - protein, 358 aa, Lentisphaera araneosa HTCC2155
MDLKICVLPGDGIGPEIIEQAVVVLEKVCEKFGHNLTTEEAIIGGVSIDAHNTPLTQDTIDKCLASDAVLMGAIGGPKWDKIDKSIRPERGLLGIRKALGLYANLRPAKLWEELKDASFLKDSVIGNGLDIMVVRELIGGIYFGEPRGEGVDENGERYAYNTMVYKESEVKRIVKLAFEIARKRGSKLHSVEKANVLDVSQLWNEVAEEVSKDYTDVDYHTMYVDNAAMQLVRNPGQFDTIVTGNLFGDIISDEASMITGSIGMLPSASIGDGKVSLYEPIHGSAPDITGTGKANPLATILSVSMMLRYSFDLDAEANLIEETVAKVLAEGYRTADIMEDGKECLSCSEMGALVASKL

SEQ ID NO: 66437 - protein, 717 aa, Shewanella oneidensis MR-1
MSRNIMLIPIGTGVGLTSLSLGMVRALERHGVKVQFFKPISQLRPNDNGPERSTTILSKSPTVNPLEPFDMAHAEALIRADQTDVLMEQIIARAAECASNTETLIVEGLVPTRNHPFADDVNYAIAKAMDADVIFIATPGSDTPTGLMNRLEIAYNSWGGKNNKRLIGAVINKIGAPVDDEGRARPDLSEVFDHQGVQRSDASIMFQLPGKSPLRILGSVPYNLDLVAPRASDLAKHLRARILNAGEMNIRRLRKVTFCARSLPNMVNHIKTDSLLVTSGDRSDVIVSACLAAMNGVKIGALLLTGSYEPEPEILKLCEQAFETGLPVFLIDTNTWQTSLNIQRFDHEVPVDDAVRIDLVQEYVASHIDQTWIESVTKNSPREHRLSPPAFRYKLTELARAAHKTVVLPEGDEPRTIKAAAICAERGIARCVLLGKKDEILRIAAQQDVVLGEGVVIVDPDEVRARYVEPMLELRRSKGLTEVVAKEQLEDNMVLGTMMLAQDEVDGIVSGAVNTTANTIRPPLQLIKTAPGSSLVSSIFFMLMPDQVLVYGDCAINPDPNAEQLADIAIQSAESAKAFGIEPRVAMISYSTGNSGTGSDVDKVREATRIAKEKRPDLVIDGPLQYDAAVMPNVARSKAPNSPVAGQATVFVFPDLNTGNTTYKAVQRSADLISIGPMLQGMRKPVNDLSRGALVDDIVYTIALTAIQASQNDAKKS

SEQ ID NO: 66438 - protein, 1153 aa, Gibberella zeae PH-1
MVCMRQSRPFQAVLWSQFIQSRPTLVSRDRPMALARVTSDRQRELVRERETFRYDPSLITKSIVNSPDHLIPSHHLATSPDATLTSFCQLAALRLNASRSLVSLFDRSSQYVVAEATQSGRLVPNSLSASPDQGLWLCGTHFTRSFGVCERVIQEPAKSLKSSPQITVINDLAEDETLCLRPYCHGWPNNRFYAGIPLTTPRGIAIGVLCVFDSQPRSGLDSTSKTILQDLSRCIMSHLEDRRISERYRQADRVTRGIRRFFHGRTTKTDLQRDRLLAAEPRLRTPGADFSPQFNHSTDTRHGDDRLSSTCASAAHIMRDALEVDGLVLLDASNSHRSPGAELKDPIGASKNAQLAADDLCPVLSSSVTAEFKQEATSYFGHSTLHTSILRRLLHYCPRGTIWTFDSSDVDASDNPSDELSSDVSDNDGIAEESDESSPVDSEDTTKHHIKRQQLRKAIKTLLPGAKSVAFFPIWNAQKRRWFAGGFAYTTNTSRVFSHKRELSYLRALGTVLMAEVSFIKEREVEHSKLGVLDSISHELRSPLHGIFFGTEVLRSSKLNSSQNDALLSVEACSQTLLDTIDQILDWSKINHFSTSLEKGSGYTHTDVDSRVLRSSRTNSMEAGMMSIASDVNLPQLIEDVIESVHVGHEFQKHTLGTPGGSVKLVVHFEPNPRWRFHVQPGAIRRIVMNILGNSLRFTSSGAIHIRVGQSETDDVSVRLVTLTISDTGCGMSSEFLANDLFSPFTQQNMMDAGTGLGLSIVRRITENLGGNVEVQSLVSVGTTVRVTLPLQLTDKVAEGTHAALQQDLNKGLDGLKVSIVGLQDSKDENTTILGWDSLMSEKDCILAICRDWLGSHIVEMPDIQHQHPHVVLCDEHSVDRANLLLQGNNSASLIVICDDPVVARKLEMEKANDGSPGGDRVVLFTYRPVGPRKLQRLLSRLNQSQKAPQPKLIDSMMPISTDLPADGALKVRLDPPTPPDAECERRDGPGLHLPTSEEWCSSQQSPRPPLTIPPEKSNPIYNPESTEKTFLLVDDNSINLKMLVMFMKKLKLQYSTASNGQEAVTKYKENPASYKCVFMDISMPVMNGFEATRHIRTFEAECAIPKCSIFAITGLASRDAQQEAVLSGIDLFLTKPIALAEMKHLLESKELI

SEQ ID NO: 66439 - protein, 381 aa, Pisum sativum
CVFDAKSVLSSSRRKHVNGSGVRCMAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 66440 - protein, 456 aa, Ostreococcus tauri
MPAGTSSLSALASHARGHHRRGRCNNWRGRSARVEASASTERRPTTLGEETRKDFPILDQKTESGAQLVYLDNAATSQKPNEVVDAHMFYYKDYNSNVHRGVHYLSSKATDAYELSRRKIARFVNAKTDREIVFTRNASEAINLVANTWGTKYLEAGDEIILSVLEHHSNIVPWQLLAERTGCVLKFVKLTKDTQELDIAELRSLVNEKTKLITTAHVSNVTGGEAPVAEIVELARGVGAKVLLDACQSLPHMPVDVQSLGADWIVGSGHKMCGPTGIGFLWGRLDVLETMPPWMGGGEMIQDVFLERSTYAEPPGRFEAGTPAIAEAIALGAACDYLSRIGMDRIHEYEVEIGRYLYEKLSQVPKVTIYGPPPSRGRASLCAFNVEGIHANDLCTLLDQAGIACRSGHHCTQPLHRYLDVPGSARASLYFYNVREDVDAFIDALRSTIEFFSEFE

SEQ ID NO: 66441 - protein, 499 aa, Geobacillus kaustophilus HTA426
MAIHAVIGNAVYTCRGELETYFQPFRDGTIGRFHPFSTPFGKQRLIYADWTASGRLYRPIEEKLTHELGPFVGNTHTESNVTGTKTTLAYRYAKEIIKQHVHAGKNDVLIMQGAGTTSAVNKLQRLLGLRVPERWKRRLSLHDEERPVVFVTHMEHHSNLLPWVETIAEVVAVRPTENGDVDLDHLRELLERYRDRPQKIGAFTACSNVTGLETPYHKLAKIMHEHGGLCFVDFAASAPYVRIDMHPDDPMEQLDAIYFSPHKFLGGPGSAGVLIFDSRLYHQHAPDHPGGGTVYWTDPWGNYEYIQAIEEREDGGTPPFWQTIKAALAIQLKEQMNVKQMRAREKELVSLLLPALKSTPGVRVLEGHRDDRLGIISFVIDGLHYNLVVKLLNDRFGIQARGGCSCAGPYGHYLFGIDKEQSAALLQEVKNGNPLAKPGWVRLSLHPTMTNEEVYAIIRAVRQIARYGRRWQEEYEYDAGKNEFVHRDDDRYIRHFFLF

SEQ ID NO: 66442 - protein, 324 aa, Bacteroides thetaiotaomicron VPI-5482
MFTASQLLDKINNHLSEIQITRTPEGLYEPIEYILSLGGKRIRPVLMLMAYNLYKEDVSSIYDPATGIEVYHNHTLLHDDLMDRSDMRRGKPTVHKVWNDNTAILSGDTMLILAFRYVAGCAPEHLKEVIDLFSLTALEICEGQQLDMEFESRNDVAEDEYIEMIRLKTAVLLAASLKIGAILAGASAADAENLYNFGMQIGVAFQLQDDLLDVYGDPEVFGKKIGGDILCNKKTYMLIKALERANGEQLEELNRWLNADNCQPAEKIAAVTEIYNQLTIRSVCENKMREYYTLAMESLEAVAVAEEKKKELKNLVKLLMYREM

SEQ ID NO: 66443 - protein, 422 aa, Pseudomonas aeruginosa
MKDLKVAVVGLGYVGLPLAVEFGKKRTVVGFDINQGRIAELRQGIDSTLEVDAAELKEASELSFTFNLQDLQKCNVFIVTVPTPIDEHKQPDLTPLVKASESIGKVLKKGDIVIYESTVYPGATEEDCVPVLEKFSGLRFNEDFFAGYSPERINPGDKEHRVSSIKKVTSGSTPEIAELVDSLYREIITAGTHKASSIKVAEAAKVIENTQRDLNIALINELAIIFNRMGIDTEAVLKAAGTKWNFMPFRPGLVGGHCIGVDPYYLTHKAQSIGYHPEIILAGRRLNDGMGAYVVSQLVKAMLKRRIHVDGARVLLMGLTFKENCPDLRNTKVVDIVRELAEYNIQVDVFDPWVSAEDAMHEYGITPVGTPSHGAYDGIILAVAHSEFKNMGAENIRKLGKAEHVLYDLKYLLDEDQSDLRL

SEQ ID NO: 66444 - protein, 429 aa, Geobacter metallireducens GS-15
MSEITDVYAREILDSRGNPTLEVEVFLESGVMGRAAVPSGASTGEREALELRDGDKSRYLGKGVLKAVDNVNNIIAEQIIGMEATDQIGIDQRMLDLDGTEYKSNLGANAILGVSLAVAKAAAEEVGLPLYQYIGGSNAKELPLPMMNILNGGAHADNNVDIQEFMIMPAGAKSFAEALRMGAEIFHALKGVLKGKGYNTAVGDEGGFAPNLKSNEEALEVIMDAIQKAGYKPGEEVLLALDVASSELFNDGVYTLENEAEPKKTPAQMVDFYENLVNKYPIVSIEDGMAENDWDGWKLLTDRLGKRIQIVGDDLFVTNPRILKEGIQKGIANSILIKLNQIGSLTETLDAIEMAKRAGYTCVISHRSGETEDTTLADLSVAVNAGQIKTGSLCRTDRVAKYNQLLRIEDELDTTALFRGKDVFYNIRK

SEQ ID NO: 66445 - protein, 341 aa, Pseudomonas aeruginosa
MMSRYEELRKELPAQPKVWLITGVAGFIGSNLLETLLKLDQKVVGLDNFATGHQRNLDEVRSLVSEKQWSNFKLIQGDIRNLDDCNNACAGVDYVLHQAALGSVPRSINDPITSNATNIDGFLNMLIAARDAKVQSFTYAASSSTYGDHPGLPKVEDTIGKPLSPYAVTKYVNELYADVFSRCYGFSTIGLRYFNVFGRRQDPNGAYAAVIPKWTSSMIQGDDVYINGDGETSRDFCYIENTVQANLLAATAGLDARNQVYNIAVGGRTSLNQLFFALRDGLAENGVSYHREPVYRDFREGDVRHSLADISKAAKLLGYAPKYDVSAGVALAMPWYIMFLK

SEQ ID NO: 66446 - protein, 589 aa, Saccharophagus degradans 2-40
MDHSTIFNVLAYLGAAVVAVPLFRKLGLGAILGYLFAGAVIGPQGFQFIDHPESALHFAEFGVVMLLFLIGLELNPEKLWNMRVQIGLLGGGQLLISALIIAVSLVVGMQWGWHLAIITGLTLGLSSTAFAVQLMDEQGIMGTALGRKGFSILLLQDMAVIPLLLLVSAWAPTSIESTSGHALPWWSGLCAVIAVLLIGRFALGPILTLVARYGSKEVLTAGSLLIVLGTAVLMQYVNLSMGMGAFLAGIILANSSFRHQLEADIEPFKGLLLGLFFIAVGMSLDLQLLLKEPLVILGLALALMLAKATVIMLLTQLRACTWKEGFLLGLMLSQGGEFAFVVMTKAVGLNVIDQSLANYVVMVVGISMALTAPLVMLFKRFIHKPIPANTNYDAATGEEPEVVIAGFGRFGQIVGRILVANNIHFTALDKDPTHVDFVKQFGNKIFFGDAARMDLLRAAGIDHARVLIIAVDDMEDATRIAQQVRHEFPKLKIIARAHNRMHNYQLVAAGCNEIIRETFESSLHAARSTLVALGVNDGQAMFKVELFRMHDEELIQRAAKHRDDMPELLKIAQEGRKELERLFEQDKHN

SEQ ID NO: 66447 - protein, 188 aa, Burkholderia vietnamiensis G4
MPHSSSGAPLDPVAFIHSQIRTVPDWPQPGVMFRDITTLLQSPKALRILVDLFVERYVDAKLDYVAGLDARGFIIAPIVAYELSVGFVPIRKVGKLPYKTCSESYDLEYGSATVEIHEDACRPGDRVIIMDDLIATGGTMMAGRNLLQRLGAVVVEGAAIIDLPDLGGSTLLRNAGLPIYTVTEFAGH

SEQ ID NO: 66448 - protein, 420 aa, Physcomitrella patens subsp. patens
MEEDKAACSGGPRRRVISVSAGASHTVALLSGDLVCSWGRGEDGQLGHGDAEERHLPLVISALDDCEISSITCGADHTTARSESTRTVYSWGWGDFGRLGHGNSSDLFIPRAIKGLKGLEIKQIACGDSHCLAITGDGEVHSWGRNQNGQLGLGHTEDVLVPNKVAAFEGIAVKMLAAGAEHTAAVTESGKLYGWGWGRYGNLGLGDRNDRLVPGEVAAVPGEKMNLVACGWRHTIAVANSGNLYTFGWSKYGQLGHGDFEDHLVPHQVQALKNKTIQAVSGGWRHTVALDEDGELYGWGWNKFGQVGCGNTDDHNSPKLITGIVNEKVTRVTCGWRHTVAITDRGNVYSWGRGTSGQLGHGDAVDRCVPKRIELLSADGLACQGIESSPSGNCASSNWISPAERYAVVPDETIGSFTET

SEQ ID NO: 66449 - protein, 668 aa, Burkholderia vietnamiensis G4
MISPLEMTLLLLLASVVGVVVFRSLNLPPMLGYLTVGILVGPHAFGVAADLERAEHLAEFGVVFLMFSIGLEFSLAKLRAMQRLVFGLGLLQVVATLVLAVVLGALFERWVHIAWQGSVALGGALAMSSTAIVSKMLAERLEIETAHGRNIFGVLLFQDLAVVPLLIVIAAFGAESSKDLAITLGFAAVKIVIALALLLIVGQRFMTRWLNVVARRRSQELFVLNLLLVTLGAAFITDRFGLSLALGAFIAGMLIAETPFRHQVEEDIKPFRDVLLGLFFVTTGMLLDPRVIWEHPLLVLGFFVGQILFKATTIAGLARLFGATPGVAMRTGIGLAQAGEFGFVLLNLILDRHLVDATLLQAILASMLLSMLAAPFLIQNADRIVMRLSSTEWMQQSLQMTRIATQSLKQRGHVIICGYGRAGQNLARMLEQEGIPYVALDLDPDRVSAAATAGESVVFGDAARRESLLAAGIHRAAAVAITYANTPSALRVLHHVHELAPTLPAIVRTVDDADLEKLLAAGATEVIPEIVEGSLMLASHTLVLVGVPMRKVVRRVEEMRDERYSLLRGYFHGADDADDDDHEQVRLQSVPVDARADAVGRSLEELGLYVLGIEVTAIRRHGIRGVEPDPQTKLRASDIVVLRGLPEALAIAEERLSRLRREPPAAVA

SEQ ID NO: 66450 - protein, 468 aa, Physcomitrella patens subsp. patens
DEKALREALKKRRQQTRGILREHFMEASLSKTYSQLVVDNMPAFVDHILIQAVALKSQERYATSTFVARARACLAETKVAEVVKWMKHNHITVPRVGQLIDLKGVDLDTLRDRISFLKKNYVRGRDLGVVLTRHPVILDKPLKQLENMVQLLEDAGVRRDWVGVVISRSPGILALSIDELLDKISFFQELGVTPEHFGPMAFNFPASVGRFLLTEMQAKVEYMRCLGMADANIGKAIATRPQLLASDIGNGWVPLIKYFKLLGIQDAGILRIFCVHPSVFCMNLEKNIAPKVRFFRAIGIREDAIGQVLVAFPALLSYSLDRKIRPVVRFILEEAGVKEEHIGKVIALRPQLIGTSLTLRLQPLVKFLRNHQLKREHTGHMVADFPMLLRYNLAIVESKLRYFKRSMKRPLEDLVLFPRYFSYSLEERIKPRQQILKSHGLVFHLRYMLACNDETFDDRVKAALERRA

SEQ ID NO: 66451 - protein, 202 aa, Zea mays
MADPDVIEVTFGNDVINTTVTSSGQAVERWIAEILALHRPGSNGYSIIVGLDVEWRPSFGPHQNPVATLQLCVGHSCLIFQLLYADYVPGALAEFLGDRGIRFVGVGVEADAERLSDDHGLVVANAEDLRGRAAERMNRPDLRQAGLRALVQVVMGVNLVKPQRVTMSRWDASCLSYEQIKYACIDAFVSFEVARRLLGGAY

SEQ ID NO: 66452 - protein, 293 aa, Saccharomyces cerevisiae
MEEQEIGVPAASLAGIKHIILILSGKGGVGKSSVTTQTALTLCSMGFKVGVLDIDLTGPSLPRMFGLENESIYQGPEGWQPVKVETNSTGSLSVISLGFLLGDRGNSVIWRGPKKTSMIKQFISDVAWGELDYLLIDTPPGTSDEHISIAEELRYSKPDGGIVVTTPQSVATADVKKEINFCKKVDLKILGIIENMSGFVCPHCAECTNIFSSGGGKRLSEQFSVPYLGNVPIDPKFVEMIENQVSSKKTLVEMYRESSLCPIFEEIMKKLRKQDTTTPVVDKHEQPQIESPK

SEQ ID NO: 66453 - protein, 533 aa, Mycobacterium sp. MCS
MVQVLPDRVDDTAPGYLKNREGLSAQLDTIAEQLALVNGGGGAKYVARHRKRGKLLVRERIELMLDPDTAFLELCPFAAWGSKFPVGGSVVVGIGVVEGIESMIIAHDPTVRGGASNPYTFRKVFRGMAIARENRLPIINIVESGGADLPTQAEIFVPGGQLFHDLTQHSAAGLPTLALVFGNSTAGGAYVPGMCDYVVMVRNRSKVFLGGPPLVKMATGEVSDDESLGGADMHARTSGLADYMAEDEQDAIRIGRRIMARLNWRKNGPGPTTPPHPPVHDPDQLLGIASVDPKVPFDPRDVIARVVDGSAFDEFKPLYGTSLVTGWASIHGFPVGILANARGILFSEEAEKGSQFIQLANQIDTPLIFLQNTTGFMVGAEYEQGGIIKDGAKMINAVSNSTVPHVTITMGASYGAGNYGMCGRSYSPRFLFAWPNSKSAVMGPAQLAGVLSIVARESAADRGLPFDEQADAQMRAAVEEQIERESVALANSGRLYDDGIIDPRDTRTVLGFCLSVIHNGEVRGQRGYGVFRM

SEQ ID NO: 66454 - protein, 648 aa, Alkalilimnicola ehrlichei MLHE-1
MSTTTNEMQSLTLRRFKEGDHQPKDWQEQIFQAGWSHKCPTYVHRTPPCQGSCPAGEDIRGWLQIARGLDKPTADEPWQAYAFRRLTEANPFPAVMGRVCPAPCEQGCNRNAVEDHVGINAVEHKIGDWARENDLKFDAPGEPTGRHVAIIGSGPAGMAAAYQLRKRGHACTLFEAQEELGGMMRYGIPGYRVPRQVLDAEIQRILDLGVEVRTGVWVGRDITIEQLDNDYDAVLWAVGTHKGRDLPVEGFEAAPNCLTGVDFLRAFNEGRLHAVSDRVIVIGGGDTSIDVASVARRLGYSSELGDNQGVEHVVMGYTAHDAASLAVREGAKVTLTSLFPREEMTATDQEVEDALREGVDIKAGVMPVAVITDDEGRATAVRFAECRMEKNRPVPLEGTEFEVETDLVISAIGQMGNLEGLEALDNGNGFMDCDPHFQVKGRPGHFVAGDIIRPHLLTTAIGQARSAVASMDHYFQTGEPAKFPKINVLHFNLLQAMRKAGQEPTPYEPQPVRGTADSAFAVHNYEDRSKVEIIKHDQLFLGHFKPTPRHQRQHREISEDSVIGDFDERLHPLSDEEAVAEAERCMSCGLCFECDNCLIYCPQDAVERVPKKERATGRYVQTDYTRCIGCHICRDVCPTGYIEMGLGE

SEQ ID NO: 66455 - protein, 193 aa, Oryza sativa Indica Group
MKTTGGGGSPKEAVVPSAASGDTTLGRHLAHRLVQVGVNNVFAMPGDLKLTLLDHLIAEPGLHIVGCCNELNAGYAADGYAWARGVGACTVTFTVRGQLLDGRRRRSRRFWNQVTGDEAGAAFRNQERAGAAPSLPSAVACWSSSVVVDGGSASPSSPPSPSSETTASWTGTVEARGPQLQPASWASCYGCRK

SEQ ID NO: 66456 - protein, 141 aa, Microcystis wesenbergii NIES-104
NQELRDEITEPIAQIKEFVKKIHSGAIKPPNRSKFTHILCVGIGGSALGPQFVGSALAPDFPPLEIAFIDNTDPKGIDRTLAHLPLATTLVIVTSKSGGTPEARNGMLEVRNAYEKLDLDFPQHAVAVTMPGSQLDKYAQD

SEQ ID NO: 66457 - protein, 477 aa, Oryza sativa Japonica Group
MAAKRPAAGEGGGKAAAGAAAAKKRVALVNITNVAAAANNAKFNSATWAAPVKKGSLASGRNVCTNRVSAVKSASAKPAPAISRHESAPQKESVIPPKVLSIVPTAAPAPVTVPCSSFVSPMHSGDSVSVDETMSMCDSMKSPDFEYIDNGDSSSVLGSLQRRANENLRISEDRDVEETKWNKDAPSPMEIDQICDVDNNYEDPQLCATLASDIYMHLREAETRKRPSTDFMETIQKDVNPSMRAILIDWLVEVAEEYRLVPDTLYLTVNYIDRYLSGNEINRQRLQLLGVACMLIAAKYEEICAPQVEEFCYITDNTYFRDEVLEMEASVLNYLKFEVTAPTAKCFLRRFVRVAQVSDEDPALHLEFLANYVAELSLLEYNLLSYPPSLVAASAIFLAKFILQPTKHPWNSTLAHYTQYKSSELSDCVKALHRLFSVGPGSNLPAIREKYTQHKKFVAKKHCPPSVPSEFFRDATC

SEQ ID NO: 66458 - protein, 491 aa, Oryza sativa Japonica Group
MSSSLASRRSSSSSAAKRPAAGEGGGKAAAGAAAAKKRVALGNITNVAAAANNAKFNSATWAAPVKKGSLASGRNVGTNRVSAVKSASTKPASAISRHESAPQKESVLPPKVLRIVPTAAPAPVTVPCSSFVSPMHSGDSVSVDETMSTCDSMKSPDFEYIDNGDSSSVLGSLQRRANENLRISEDRDVEETKWKKDAPSPMEIDQICDVDNNYEDPQLCATLASDIYMHLREAETRKHPSTDFMETLQKDVNPSMRAILIDWLVEVAEEYRLVPDTLYLTVNYIDRYLSGNEINRQRLQLLGVACMLIAAKYKEICAPQVEEFCYITDNTYFRDEVLEMEASVLNYLKFEMTAPTAKCFLRRFVRVAQVSDEDPALHLEFLANYVAELSLLEYNLLSYPPSLVAASAIFLAKFILQPAKHPWNSTLAHYTQYKSSELSDCVKALHRLFCVGPGSNLPAIREKYTQHKYKFVAKKPCPPSIPTEFFRDSTC

SEQ ID NO: 66459 - protein, 356 aa, Oryza sativa Japonica Group
MSKEDAMSTGDSTESLDIDCLDDGDSEVVSSLQHLADDKLHISDNRDVAGVASKWTKHGCNSVEIDYIVDIDNNHEDPQLCATLAFDIYKHLRVAETKKRPSTDFVETIQKNIDTSMRAVLIDWLVEVTEEYRLVPETLYLTVNYIDRYLSSKVINRRKMQLLGVACLLIASKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKYKFVAKKYSPPSIPAEFFEDPSSYKPD

SEQ ID NO: 66460 - protein, 180 aa, Triticum aestivum
DLQELVLIGVNPTVQSLRMLGEHCRALERLALCGCETVGDTEIICLAERCAALKKLCIKGCPVTDRGMGALNGGCPSLVKVKLKRCRGVSYECVEHLKMARGGSFSISLDIVLEHDAVAPSENGVQETGQQAQVTELTGQMAAMDLPTNAAGAQSFAQANSRMRSVMSALRRRFGNPPPA

SEQ ID NO: 66461 - protein, 444 aa, Arabidopsis thaliana
MHRASSKHTNAKKEAISTSKIRDNNVRVTRSRAKALGVSNSPSKPAFKHETKRVARPSNKRMASDNITVCNQKRRAVLKDVTNTLAESIISTEGNVKVACKRGGKETKQIEEDGLVDVDGEKSKLAEDLSKIRMVESLDASASKQKLVDCAEEDRSDVTDCVQIVDIDSGVQDPQFCSLYAASIYDSINVAELEQRPSTSYMVQVQRDIDPTMRGILIDWLVEVSEEYKLVSDTLYLTVNLIDRFMSHNYIEKQKLQLLGITCMLIASKYEEISAPRLEEFCFITDNTYTRLEVLSMEIKVLNSLHFRLSVPTTKTFLRRFIRAAQASDKVPLIEMEYLANYFAELTLTEYTFLRFLPSLIAASAVFLARWTLDQSNHPWNQTLQHYTRYETSALKNTVLAMEELQLNTSGSTLIAIHTKYNQQKFKRVATLTSPERVNTLFSR

SEQ ID NO: 66462 - protein, 178 aa, Triticum aestivum
  misc_feature (47)..(47): Xaa can be any naturally occurring amino acid
  misc_feature (67)..(67): Xaa can be any naturally occurring amino acid
  misc_feature (79)..(79): Xaa can be any naturally occurring amino acid
  misc_feature (82)..(83): Xaa can be any naturally occurring amino acid
  misc_feature (94)..(94): Xaa can be any naturally occurring amino acid
  misc_feature (97)..(97): Xaa can be any naturally occurring amino acid
  misc_feature (109)..(109): Xaa can be any naturally occurring amino acid
  misc_feature (117)..(117): Xaa can be any naturally occurring amino acid
  misc_feature (120)..(120): Xaa can be any naturally occurring amino acid
  misc_feature (124)..(124): Xaa can be any naturally occurring amino acid
  misc_feature (128)..(128): Xaa can be any naturally occurring amino acid
  misc_feature (131)..(131): Xaa can be any naturally occurring amino acid
  misc_feature (134)..(134): Xaa can be any naturally occurring amino acid
  misc_feature (137)..(138): Xaa can be any naturally occurring amino acid
  misc_feature (142)..(143): Xaa can be any naturally occurring amino acid
KVAGHGCFGARLMYDPEFVGDAMSAIAANCDVPVSVKCRIGVDDRDXYERTLVHLVDKVVSNQPTKXILIIHAPEGVAXVAXXLPENRKVLPFXKYXYYYLLLPDFPKXYTFTLNGXFNXLLDXLCTXRQXPPXMVXXAAYXXPRDMLGTYELWMPKSRNLEQLWDPNGHRTQATEEL

SEQ ID NO: 66463 - protein, 283 aa, Bacteroides thetaiotaomicron VPI-5482
MSEEKWAIITGADGGMGTEITRAVAEAGYHIIMACYRPSKAEPIRQRLVNETGNANMEVMAVDLSSMASTASFADRIVERHLPVSLLMNNAGTMETGLHITDDGFERTVSVNYLGPYLLTRKLLPALTCGARIVNMVSCTYAIGHLDFPDFFRQGRKGSFWRIPVYSNTKLALMLFTIELSERLREKGITVNAADPGIVSTDIITMHQWFDPLTDIFFRPFIRTPKKGASTAVGLLLDEAVAGVSGQLYASSHRKQLSEKYLCHVQQKQLWQETEQALERWLK

SEQ ID NO: 66464 - protein, 380 aa, Zea mays
MAAAHLFCSAPAAYRAANPRPLATRGRANPATGTYLVLKGVWCSCAHFPRATPSRRFFPCRASLSPDGSLAMLGAPSPRMAPPMRKPYMREHSCLIFPPPRGRRPLAVIKFLGGAFIGAVPEVTYGYLLELLALEGFVVVCVPYNVTFDHEAAAREVFQSFHACYDALLASGLPEAGLSALDIAELPLYSVGHSNGALLQLLVGSYFSERIPEANAIVSFNNRPASEAVPYFEQIGPLFRQLMPMMEASPVYSMARNASGYAWKALFDLAGGLLREYDQEATVSLSKFIDQLPSVMNQVSEGVSESTPPENREFCKNSYSVPNTLLVKFTVDATPCIQDVKWQVGSEYTPADAIAQGLKSLALSETRVLSRTIADWFTSL

SEQ ID NO: 66465 - protein, 405 aa, Pisum sativum
MASATFSVAKPAIKANGKGFSEFSGLRNSSRHLPFSRKSSDDFHSLVTFQTNAVGSSGGHKKSLVVEAKQLKVAINGFGRIGRNFLRCWHGRKDSPLDVIAINDTGGVKQASHLLKYDSTLGIFDADVKPVGTDGISVDGKVIKVVSDRNPANLPWKELGIDLVIEGTGVFVDREGAGRHITAGAKKVLITAPRKGDIPTYVVGVNADAYTHADDIISNASCTTNCLAPFVKVLDQKFGIIKGTMTTTHSYTGDQRLLDASHRDLRRARAAALNIVPTSTGAAKAVALVLPTLKGKLNGIALRVPTPNVSVVDLVVQVSKKTFAEEVNEAFRESAAKELTGILSVCDEPLVSVDFRCTDVSSTVDSSLTMVMGDDLVKVIAWYDNEWGYSQRVVDLADIVANNWK

SEQ ID NO: 66466 - protein, 253 aa, Bacteroides thetaiotaomicron VPI-5482
MSIAAFNLFLGVMSLTALIVFIALYFVKAGYGIFRTASWGVAISNKLAWILMEAPVFLVMCWMWIHSERRFDPVILTFFVFFQIHYFQRAFVFPLLLTGKSKMPLAIMSMGILFNLLNGYMQGEWIFYLSPEGMYHSGWFTSAWFIAGSLLFFAGMLMNWHSDYIIRHLRKPGDTRHYLPQKGMYRYVTSANYLGEIIEWAGWAILTCSLSGLVFFWWTVANLVPRANAIWHRYREEFGSEVGERKRVFPFIY

SEQ ID NO: 66467 - protein, 750 aa, Haloarcula marismortui ATCC 43049
MGLDEDALEYHRSKPPGKIEIATTKPTNTQRDLSLAYSPGVAAPCEEIDKDPEKAFEYTAKGNLVGVVSDGSAVLGLGDIGPEAGKPVMEGKGVLFKRFADIDVFDVELDTDNAEAMIQTVEAMEPTFGGINLEDIAAPECFEVERRLSEKLDIPVFHDDQHGTAIISGAALVNAADIADKELDELEVVFSGAGASAIASAKFYVSLGVSKDNITMCDSSGIITEERANHEELNRFKQEFARDIPEGGLADAMDGADVFVGLSVGGIVDQEMVRSMASDPIIFAMANPDPEIAYEDAKAARDDTVIMATGRSDYPNQVNNVLGFPFIFRGALDVRATEINEEMKVAAARALADLARQDVPDEVVKAYGDQPLQFGPNYIIPKPLDPRVLFEVTPAVAEAAIESGAARTELDTAAYVEELEARLGKSREMMRVVLNKAKSDPQRVVLAEGHDEKMIRAAYQLVEQGIAEPILIGDADQIESTRRKFGLEFDPVVVDPETADVADYADRLYELRQRKGVTRREADELIRDGNYLGSVMVEMGDADAMLTGLTHHYPSALRPPLQVIGTADDADYAAGVYMLTFKNRVIFCADTTVNQDPDTDVLEEVTRHTGELARRFNVEPRAAMLSYSNFGSVDNLGTKKIRRAVSRLQDDDRVDFPVDGEMQADTAVVEDILQDTYEFSELDDPANVLVFPNLEAGNIGYKLLQRLGGAEAIGPMLVGMDKPVHVLQRGDEVKDIVNLAGVAVVDAQQE

SEQ ID NO: 66468 - protein, 478 aa, Oryza sativa Japonica Group
MPRTSVVESPGCPPLRALTTDILGLIKGSPSPPFPPPPPPRRRRAGLPPPSWRPRTKPAGVAKVVETWGAPEAPRAVLAASLADRAVDPVSVRDLPLFLPAVLAVARKNGVVELLNPLNGETLAGVNAAAGRAAPADSSAEEDPLATLHLFRRHALDSSMLGTFLACTEKGKAYVKSVAKENASSDMAVGPSSSWDVSNSGTVQFSSVDAGESYAMFGGKGIEVNLWDITSCSKIWSAKSPRGNSLQIFTAPWFTAGTFLCKDDHRKIVACTNNHQVRLYDTASQRRPVISVDFRESPIKAVAEDPNGHAVYIGTGRGDLASFDMRTELTLACTLFPGKLLGCFAGKCSGSIRSIVRHPELPLIASCGLDSYLRIWDTNTRQLLSAVFLKQHLTAVVIDSHFSTEELEETKSKQPDPVGAEVRKERKEKKNRTSEMDEDETRMLDHDDSDSEMHTSKRKKSGEKSKGMKKKSKKQQVA

SEQ ID NO: 66469 - protein, 525 aa, Physcomitrella patens subsp. patens
MGFLDVFSEKRNMRYQRGEKVHPASFDNLPASSIRTSSAALGTPSKGSSGKSKREPPMGWDKAGGFPNLPLPPPATQGRPRRKPSSSCSVCYCLSLFFSFLIIIIILAGLTILIFYIIFQPRLPKATILNVVVTSFNVTNKNGGPIASLADSQNPVLNANIAFTIQVENPNDKLGIHFRDLSVFVSYNGTQFAHSFVPPFYQGKKTKSEVIANLKATSAPLSQSQGQDLQAAIGQNDIPLSARITVGAALEIGSWIIPPGHIQVLCQLRVSPPTSPAGAKLLSKSCFYTQDPDHRSQDFGTSVTIHQYFLKSTEVVIAEFLDNSMLDDVCEAVDAKSMQIFDVQGRRLLGIRVRHMFWENQRLNTATLYLVSAFSVAEAAKGQFSNLTGRRADLTRNTVEMVEAVAVGVEAGPLQKNRELFTGYSFNLDFNYETLSPIQNSFIDNLGNPFIERNFGIPSRQFDVGVMDWFATLWESEKEISGWRMCLKMAGYMPGLRSYLFTRYFDFMPSGWTDKPLYIQGLLHE

SEQ ID NO: 66470 - protein, 216 aa, Zea mays
  misc_feature (27)..(27): Xaa can be any naturally occurring amino acid
LHPLRCARFPRAVRNLTWPCRRWWSTXVVFPPVARPPGSAGSHFLGGAGVRGLEIGGNFIKFTAIGVYLEDAAVPALAKKWGGKTADELASDAAFFRDVVTGDFEKFTRVTMILPPTRRRRSPSPSPPEARSGRASERTARRKKATRRLGGTASHTCRLRLRAPDRRDAARVQCSRRVMSVRALASCSCLSGRVDCLCPLVGPSGGTFEKNRRILL

SEQ ID NO: 66471 - protein, 155 aa, Triticum aestivum
  misc_feature (64)..(64): Xaa can be any naturally occurring amino acid
  misc_feature (125)..(125): Xaa can be any naturally occurring amino acid
MGKSKSKGAKFAAVKKIISKKTIKKYKEEVLDPRKKDTEKEKLGRNVPQVSSALFFSYNMASGXPYRVLFDTNSSISPSRKMGFGERMMDCLYAKSTPAPLDVLMAHFKNRTKNRGALRLLRSRXQELACPHKGTMLMTYLRDSSKMHIVHFIEN

SEQ ID NO: 66472 - protein, 251 aa, Aspergillus nidulans FGSC A4
MANYGKNAVIIGGTHGIGLATAQLLAGTGAQVLLTGRSQPPIDSAKDQLGDKAHVVQCDITSLSNIEKLVEESKFVFADQIDFLFINAGYACLEPVAAVTEESFHRTINTNVFGAFFVAQKFIPLIRDGGAIVFTSSVSTKHGFPGLAAYSASKAAVSSLVQTLAAELVDRQIRVNAVCPGFIKTPTMGVSGVTPADLVAFGEEGEKLTPLARNGTPEEVAKAAVFLAFDATFTTGTDLAVDGGLIYMHKH

SEQ ID NO: 66473 - protein, 1011 aa, Oryza sativa Indica Group
MEAATANIFHLSLTFFFMVLLTLGTSAAGVASDTLSNGRNLTDGNTLVSAGGSFTLGFFSLGLPSRRYLAIWFSESADAVWVANRDSPLNDTAGVLVNNGAGGLVLLDGSGRAAWSSNTTGKSSSATAAQLLESGNLVVRERDQLNTGVFIWQSFDHPSNTLIAGMRLGNNRQTGDAWFLSSWRAHDDPATGDCRRVLDTRGLPDCVTWCGGAKKYRTGPWNGQWFSGVPEMASYESIFSSQVVVTPDEIAYVFTAAAAAGSPFSRLVLDEAGVTERLVWDPSSKVWIPYMKAPRGVCDDYAKCGAFGLCNEDTASTLFCSCMAGFSPVSPSRWSMRDTSGGCRRNAPLECGNGSTTDGFVTVRGVKLPDTDNATVDTGATLDECRARCLANCSCVAYAAADISGRGCVMWIGDMVDVRYVDKGQDLHVRLAKSELVNNKKRTVVKIMLPLTAACLLLLMSIFLVWLYKCRVLSGKRHQNKVVQKRGILGYLSASNELGDENLELPFVSFGEIAAATNNFSDDNMLGQGGFGKVYKGMLDDGKEVAIKRLSKGSGQGAEEFRNEVVLIAKLQHRNLVRLLDHANKYVLDWPTRFKIIKGVARGLLYLHQDSRLTVIHRDLKPSNILLDVDMSPKISDFGMARIFGGNQHEAILTELLEHIKSDTYSFGVILLEIVSCLKISLPRLTDFPNLLAYAWNLWKNDRAMDLMDSSISKSCSPTEVLLCIQIGLLCVQDNPNNRPLMSSVVSMLENETTTLSAPIQPVYFAHRAFEGRQTGENSISLLEGRIKYRTSGVKPYIHDTGMLGGNKEVAIKRLSKHSGQGVEEFRNEVVLIAKLQHKNLVRLLGCCIHGEEKLLIYEYLPNKSLDYFLFGIFSVKSDTYSFGVLVLELISGSKISSPHLIMGFPNLIACAWSLWKNGKAEDLVDSIILQIYSLNEFLLCIHVGLLCVQEDPNARPLMSSVVAMLENEATTLPTPKQPAYFVPRNCMAGGAREDANKSVNSISLTTLQGR

SEQ ID NO: 66474 - protein, 390 aa, Helicobacter pylori J99
MPYSSKVQSLSESATIAISTLAKELKSQGKDILSFSAGEPDFDTPQAIKDAAIKALNDGFTKYTPVAGIPELLKAIAFKLKKENNLDYEPSEILVSNGAKQSLFNAIQALIGEGDEVVIPVPFWVTYPELVKYSGGVSQFIQTDEKSHFKITPKQLKDALSPKTKMLILTTPSNPTGMLYSKAELEALGEVLKDTKVWVLSDEIYEKLVYKGEFVSCAAVSEEMKKRTITINGLSKSVAMTGWRMGYAASKDKKLVKLMSNLQSQCTSNINSITQMASIVALEGLVDKEIETMRQAFEKRCHLAHAKINAIEGLNALKPDGAFYLFINIGSLCGGDSMRFCHELLEKEGVALVPGKAFGLEGYVRLSFACSEEQIEKGIERIARFVKSKG

SEQ ID NO: 66475 - protein, 838 aa, Oryza sativa Indica Group
MQGKKESTVMEAATTNIFYRPVIFFSVLLCFQYRAAGVASDTLSNGRNLTDGDTLVSANGSFTLGFFSPGLPSRRYLAIWFSESADAVWVANRDSPLNDTAGVVVIDGTGGLVLLDGAAGQAAWSSNTTGSSPSVAVQLLESGNLVVRDQGSGDVLWQSFDHPSNTLIAGMRLGRNPRTGAEWSLTSWRAPDYPATGGCRRVMDTRGLADCVSWCGAGKKYRTGPWNGLWFSGVPEMASYSSMFANQVVVKPDEIAYVFTAATAAAPFSRLVLSEAGVIQRLVWDPSSKGWNTFAQAPRDVCDDYAKCGAFGLCNVNTASTLFCSCMAGFSPMFPSQWSMRETSGGCRRNAPLECGNGSTTDGFVPVRGVKLPDTDNATVDTGATLDECRARCFANCSCVAYAAADIRGAGGGSGCVMWTGDVIDVRYVDKGQDLYLRLAKPELVNNKKRTVIKVLLPVTAACLLLLMSMFLVWLRKCRGKRQNKVVQKRMLGYLSALNELGDENLELPFVSFGDIAAATNNFSDDNMLGQGGFGKVYKGMLGDNKEVAIKRLSKGSGQGVEEFRNEVVLIAKLQHRNLVKLLGCCIHGDEKLLIYEYLPNKSLEAFIFDPASKYALDWPTRFKIIKGVARGLLYLHQDSRLTIIHRDLKSSNILLNVDMSPKISDFGMARIFGGNQQEANTNRVVGTYGYMSPEYAMDGAFSVKSDTYSYGVILLEIVSGLKISLPWLMDFPNLLAYAWSLWKDDKAMDLVDSSIAESCSKMEVLLCIHIGLLCVQDNPNNRPPMSSVVFMLENEAAALPAPIQPVYFAHRASGAKQSGGNTSSSNNNMSLTVLEGR

SEQ ID NO: 66476 - protein, 267 aa, Zea mays
LEGKVALVTGGATGIGEAIVRLFMEHGAKVCIADIQDEAGQQLRDALGGDAQGAMFVHCDVTSEEDVSRAVDAAAERFGALDVMVNNAGVTGTKVTDIRNVDFAEARRVLDVNVHGVFLGMKHAARAMIPRKRGSIVSLASVASAIGGTGPHVYTASKHAVVGLTKSVAAELGRHGVRVNCVSPYAVPTALSMPHLPQGARADDALKDFLAFVGGEANLKGVDAMPEDVAQAVLYLASDEARYVSAVNLMVDGGFTAVNNNLRAFED

SEQ ID NO: 66477 - protein, 482 aa, Bradyrhizobium sp. BTAi1
MNAILKNFIAGEWVDGSGVTRNINPSNTNDVVGEYAKADRAQTEKAIAAAKAAFPAWSRSTPQERYDALNKISAEILSRKEELGRLLAREEGKTLPEGIGEVARAGQIFAFFAGEALRLTGEKGASVRPGLDVEITREAVGVVGMITPWNFPIAIPAWKIAPALCYGNTVVFKPAELVPGSAHALSEIIARSGLPAGVFNLVVGSGSVVGQTLLEHPDVAAISFTGSVGTGRKIAQACVLSNPMKKFQLEMGGKNPLVVLDDADVKVAVEAAANGAYFSTGQRCTASSRLIVTEGIHDTFVAALTERLKGLVVDDAVKQGTHIGPVVDANQLEQDQRYLKIGQDEGAKLAWGGELLNRETPGFYMQPALFTEATNNMRIAREEIFGPVACVIRAKNYDEALAISNDTEFGLAAGVCTTSLKYASHFKRNSEAGMVMVNLPTAGVDYHVPFGGRKGSSYGAREQGSYAREFYTTVKTAYTFPV

SEQ ID NO: 66478 - protein, 320 aa, Burkholderia vietnamiensis G4
MSSHSHDGLMVFTGNANPALAQEVVNILGIPLGKAMVSRFSDGEIQVEIQENVRGKDVFVLQSTCAPANDNLMELMIMVDALKRASAGRITAAIPYFGYARQDRRPRSARVAISAKIVANMLEIAGVERIITMDLHADQIQGFFDIPVDNIYATPILLGDLRKQNYSDLLVVSPDVGGVVRARALAKQLNCDLAIIDKRRPKANVAEVMNIIGEVEGRTCVIMDDMVDTAGTLCKAAQVLKDRGAKQVFAYATHPVLSGGAAERIAASALDELVVTDTIPLSAESLACSKIRSLTSASLLAETFSRIRRGDSVMSLFAES

SEQ ID NO: 66479 - protein, 356 aa, Brassica napus
MRKTKKEDLNQFLIAHLNTIYDTLDNLQLFERTAFATEEKVNWNDVLQMSGHLSRQATIVGMLWSGEAPKAESLKETMESYFNALQGFILCCHGSTVGAGPTLSSLIHVSVKKIVDSSFRLLQGSVTLYEGSYEKDKKPSIPQLSGAVWEACSGFKKVPATNITAIGRAITQVAVSMKDVLREMKEVKPAPPEDEASGDNNNSDDDDDLGNDLSPEEMEVAQMVAEIVSETIMVIKELIRVITGMIKLENPKDNSGFVDSLEKMLKLCKGTGDQIDEVGARVYPPQEIVKMKQALKIIQGNLDEVESEVEGLKSASEAFTGACRKLSSSMKHMEAELDKRCEDEVVTEMQNVTLGS

SEQ ID NO: 66480 - protein, 584 aa, Alkalilimnicola ehrlichei MLHE-1
MLKRLLPFLAWPRPTADTLKADLLAGVTVALVLVPQSMAYATLAGMPPYYGLYAAFLPVIVAALWGSSPQLATGPVAVVALLTAAALAPLAEAGSGEFITLAIALAFMVGVIQLLLGAFRLGTLVNFISHPVIIGFTNAAAIVIVLSQLGSLLGLSMDRSGSFLLGVLDLLQRVPQAHGPTVLMGLAAIAMMVGCKRWLPRIPGVLLAVAVLTPVSLWLDFEGMGGAVVGGIPEGLPTLGIPELGVTTVTTLMTTALVIALVAFMEAISIAKAIATRTRDRIDPNQELIGQGLGNLVGSFSSAFPVSGSFSRSAVNYNAGARTGLSSVITGLLVALTLLFLTPLLYHLPLAVLAAIIMMAVLGLVNVKAVRHAWQAKRDDGIAAVVTFSATLIFAPHLDYGILLGAGLAIVLYLLRTMKPRVVLLARHPDGTLRDAEYFDLPRSPYIAAVRFDGDLYFANVGYFEDAILDARARHPEARFVLVVANGINQIDASGEETLHKLAENLHASGSTLVLAGLKLPLQELLERTGLKEVIGDENIYRNERHALAAIYQRMDVPGFDPARCPLNPEPAGEAGIADSAAER

SEQ ID NO: 66481 - protein, 388 aa, Escherichia coli
MKLYNLKDHNEQVSFAQAVTQGVGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 66482 - protein, 298 aa, Oryza sativa Indica Group
MAENVPSKSVKMPIDSADWNDYNTRVVCEIFADQVVAGNRPNTHLSNSGYDEVIEQFASKTGLRYTRLQIKNKWDKLRIEYNCWKKLKSQIGLGWDDARQTVTATAARWKQLKEDIAGCLKFRKAGLQNEELLEKMFEDIRNTGADHWSLGQGTIPSATTNGTIQIADVNEIDDETDEDEPSAKRKRGDSSKVDKLKKTKSGSQKMVEEMSKSNELSAQTLSSIQSFTKIREDPPGCSIKDVMTLVEECGAVEGTNEHFIAIEIFIKKDQRKMFVNSLRTPAGRFAWLKKKYDVKYGN

SEQ ID NO: 66483 - protein, 396 aa, Bacteroides thetaiotaomicron VPI-5482
MNKITMQKDGTLSVPDVPVVPYITGDGVGAEVTPSMQSVVNAAVQKAYGGKRRIEWKEVLAGERAFNETGSWLPDETMKAFQEYLIGIKGPLTTPVGGGIRSLNVALRQTLDLYVCLRPVRWYQGVHSPVKAPEKVNMCVFRENTEDIYAGIEWEAGTPEAEKFYQFLKNEMGVTKVRFPETSSFGVKPVSREGTERLVRAACQYALDHHLPSVTLVHKGNIMKFTEGGFKKWGYELAQREFGDALADGRLVIKDCIADAFLQNTLLIPEEYSVIATLNLNGDYVSDQLAAMVGGIGIAPGANINYKTGHAIFEATHGTAPNIAGKDVVNPCSIILSAVMMLEYLGWKEAAALIEKALEQSFLDARATHDLARFMPGGTSLSTTAFTREIVERIEK

SEQ ID NO: 66484 - protein, 447 aa, Pisum sativum
AALASTRIPTNTRFPSKTSHSFPSQCASKRLEVGEFSGLKSTSCISYVHSARDSSFYDVVAAQLTSKANGSTAVKGVTVAKLKVAINGFGRIGRNFLRCWHGRKDSPLEVIVVNDSGGVKNASHLLKYDSMLGTFKAEVKILNNETITVDGKPIKVVSSRDPLKLPWAELGIDIVIEGTGVFVDGPGAGKHIQAGAKKVIITAPAKGADIPTYVIGVNEQDYGHEVADIISNASCTTNCLAPFAKVLDEESGIVKGTMTTTHSYTGDQRLLDASHRDLRRARAAALNIVPTSTGAAKAVSLVLPQLKGKLNGIALRVPTPNVSVVDLVVNVAKKGISAEDVNAAFRKAAEGPLKGILDVCDVPLVSVDFRCSDVSTTIDSSLTMVMGDDMVKVVAWYDNEWGYSQRVVDLAHLVANKWPGTPKVGSGDPLEDFCETNPADEECKVYE

SEQ ID NO: 66485 - protein, 141 aa, Microcystis aeruginosa MCS3
NQELRDEITEPVAQIKEFVKKIHSGAIKPPNRAKFSHILCVGIGGSALGPQFVAEALSPLNPPLEIAFIDNTDPKGIDRTLAHLPLATTLVIVTSKSGGTPEARNGMLEVRNAYEKQDLDFPQYAVAVTMPGSQLDKYAQD

SEQ ID NO: 66486 - protein, 207 aa, Schizosaccharomyces pombe 972h-
MSTTTPNIWIAASDGKTDVVLKHLDSGISPNAADENGYTPIHAAVSYGHSDLLKILVERGGDINIRDQDGETPLFVCEKLEIAHDLINQYNADTTVKNNDGLIAAQVIEANGEFPELAKYLYSFTDLEPKDVNTLPNDTKIEYAKLMTEQEMDEEAGQPLLDQKAKAEIDRILALRDTGVNVDDELRKILTGALSGHFERNVRPRSN

SEQ ID NO: 66487 - protein, 405 aa, Geobacillus kaustophilus HTA426
MSFSYVSHLYCPKCERTYDVDQIHQLCECGSPLLVAYDLEAMRQKVKRDVLREREANLWRYHELLPVKHPEHIVSLGEGMTPLVPMPRLGREIGIEALYMKDEGVIPTGTFKARGAAVGISKAKELGVKQLAMPTNGNAGAAWSLYAARAGIQATVVMPVEAPELTRKECAIAGAELYFVNGLISDAGQIVAKAIREYGWYDASTLKEPYRIEGKKTMGLEIAEQFSWQLPDVILYPTGGGVGLIGIYKAIKELQALGWVDGRMPRLVAVQAEHCAPIVKAWKEKKRESEFWPNAHTVAFGINVPKALGDFLVLEAVYETNGCAIAISDEAILAQQQMVAKLEGAFICPEGAAAFAAARTLRESGWIRDGEKVVVLNTGTGLKYADLVQVVPPVLEPEDSLPMRE

SEQ ID NO: 66488 - protein, 321 aa, Pseudomonas aeruginosa
MALNPDIAAYLELVGNGRSSGKSLPMHQLTVQQAREQFDQSSALMDPGLDEPLPRVETLFVPARDGTPLPARLYSPQGLSASPPLPGVLYLHGGGYVVGSLDSHDALCASLAERAGCVVLSLAYRLAPEWRFPTAAEDAEDAWCWLAAEAARLGIDPQRLAVAGDSVGGSLCAVLSHRLALRGDASQPRLQVLIYPVTDASRTRQSIERYAVGHLLERDSLEWFYQHYQRSPEDRQDPRFSPLLGVVPADLAPTLLLVAECDPLHDEGIAYAEHLRQGGARVELCVYPGMTHDFLRMGAIVDEADEAKDMIADALVAALAP

SEQ ID NO: 66489 - protein, 325 aa, Robiginitalea biformata HTCC2501
MIESIEQYRQSFDDYLQKILQFGEPAGLYEPIGYIMDLGGKRMRPVLVLLSAELFGAPAENALPAAAAVEIFHNFSLVHDDIMDAAPLRRGRPTVHRKWDPNTAILSGDAMLIRAYQQLDGYPPELFQPLTRLFSRTALEVCEGQQYDMDFESRDDVGIPEYLRMIEFKTAVLLGCALQMGAIIGGAEVAEQEAVYDFGIRLGLAFQLQDDYLDVFGNPETFGKQVGGDIIENKKTYLYLQALERCGADDARELRDLYSVRPTNPQSKVDRVRQIFETCGADRQTRNQIGGYTREAFARLDTLTGNPRAKAALRDFGEWLLRRDF

SEQ ID NO: 66490 - protein, 280 aa, Vitis vinifera
MTKDVETSGQEFSNKDYHDPPPAPLIDPDELTQWSLYRAIIAEFIATLLFLYITVLTVIGYKSQSDTDPCGGVGILGIAWAFGGMIFILVYCTAGISGGHINPAVTFGLFLARKVSLVRALMYMIAQCLGAVCGVGLVKAFQSSLYNRYGGGANELAGGYNKGVGLGAEIIGTFVLVYTVFSATDPKRNARDSHVPVLAPLPIGFAVFMVHLATIPITGTGINPARSFGAAVIYNNDKAWDDHWMFWVGPFIGAAIAAFYHQYILRAAAIKALGSFRSNA

SEQ ID NO: 66491 - protein, 524 aa, Zea mays
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYIAVRFLIGFSLATFVSCQYWMSTMFSSKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 66492 - protein, 469 aa, Xylella fastidiosa Dixon
MSLENVEKLVKDKKIEFVDLRFVDMRGVQQHVTFPVNILEPSLFKDGKMFDGSSIAGWKGINESDMVLLPDASTAYLDPFYADPTLVMTCDILDPATMHSYVRDPRGIAKRAEIYLNSLGIADQAFFGPEPEFFIFDSVRFANDMGHSFFQIASEEAAWNTGAEFERCNSGYRPAVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLPPEEEKLIPQVCSSLDQALEALDKDRDFLKAGGVMSDDFINGYIALKMQEVTQFRAATHPLEYQMYYAN

SEQ ID NO: 66493 - protein, 355 aa, Vitis vinifera
MKGPLDRTKVMVRHLPPMILEAAFLEQINTVFKGRYTLVKFRPGKNSQQRQSYSRAYLDFKRPEDVIEFAEFFDGHVFVNEKGTQFKTIVEYAPSQRIPKHWPKKDSREGTIFKDPEYLEFLELLAKPFENLPSAEIQLERREAERAEKSFQGCIPSLSNGKLSRRASGSSSGNPSLGSSKRGSGKRRLSTTMYVLRDAAKNTSAKDKSTFSLVPKRDDQLLSDKSVNLAAGGGAEALKEESGVSGAVDAGKKKVLLLKGKEREISHHLQQQNVTSPVKNILGANSPKQNQRREGSGRIIRSILLNKDARQSQSSMFQSGQQSQASNLEKEKRPPRPPQLYTQPAMQRKVRDAAV

SEQ ID NO: 66494 - protein, 834 aa, Oryza sativa Indica Group
MSSMFLIILSCMLLLSNSGRTTTGAELGDTLGKGRNITDGERLVSAGGSFTLGFFSPASSSSSSTSRRYLGIWFSVSDDVVCWVANRDRPLTDTSGVLVITDAGSLLLLDGSGHVVWSSNTTTGGGASMAAQLLESGNLVVSDRGNGGAGAVVVWQSFDHPCDTLLPGMKIGKNLWTGAEWYLSSWRSSGDPSPGNYRYRTDTKGVPENVLWDGDGEVYRTGPWNGLWFSGIPEMGTYSDMFSYQLTVSPGEITFGYSANAGAPFSRLVVTGVGEVQRLVWEPSSRAWKNFFQGPRDLCDDYGKCGAFGLCDAGAASTSFCSCVEGFTPASPSPWKKMRDTSAGCRRDAALGCATDGFLAVRGVKLPDAHNATVDKRVTVEECRARCLANCSCVAYAPADIGGGGGGGAGSGCIIWADDLVDLRYVDGGQDLYVRLAKSELGKDGIRQRRPPAAVVIGASIASVVGVLLIILLVLLYVIRRRQRPRVSDDDAGVPAATAAVHARPNPALAAPSINLSSVKEATGNFSESNIIGRGGFGIVYQGKLPSGRKVAVKRLTQSLVTDKRKEDFIREVEMMSNTRHAYLVELLCYCQEGGEMILVYEYMENMSLDLYIFGEDRRLRASLNWVQRLDIIRGIAIGVEYLHNVKVIHRDLKPSNILLDDNWRPKVADFGTAKLFINDQTDPTLVLSAGYIAPEYAAQGNLTLKCDVYSFGVVLLEIISGKRNRTLPTFLRDTWESWKQHEIEDILDLGLIKPEPDLLLGLDRCIQIGLLCVQQSPDDRPTMNQVVSMLTKYSSQIAMPKNPMINSRCEPSVSQVVSDTEPASHDRPGPSLN

SEQ ID NO: 66495 - protein, 579 aa, Oryza sativa
MAPLPAAATATASSAATPADDEAHSLLPSTPSNEEDDDDLEERAYEATEKVIVSISDFPDADDDEEESGLATSTAASGIPPFSWRKLWLFTGPGFLMSIAFLDPGNLEGDLQAGAVAGDTLLWLLLWATSMGLLVQLLAARVGVATGRHLAELCRDEYPSWARRALWLMAEVAMVGADIQEVIGSAIAIKILSRGFLPLWAGVVITALDCFIFLSLENYGVRKLEAVFAILIATMAVSFAWMFTDTKPNMKNLFIALVQSRKIDPNKEHQVREALRYYSIESTIALAVSFMINLFVTTVFAKGFYGTKEAGNIGLENAGQYLQEKFGGGAGACIVKLGHGEHAAAALEELTGIVQQHLGIEGSLLCLVSCGRKASSFGGVATTSADGFGPASLPIPGKPSLSAEPTRGRRPWCQGLCPHRRCDAPLIGPLRSPPLPVPGPSPMPSSVSASASALAAATTTTTSSKHRRPEVLSVLPRHPLRLLSPRCRRRHRPKVLPILPRQRSMRTSRTRSRSTSARRQRLVHDRGAAATKMTVVADGGLDDDTATGGGPDVGSALMGRDGQGKGGGWDEVRGGSSLN

SEQ ID NO: 66496 - protein, 759 aa, Oryza sativa Indica Group
MAKATTGICLVDVILFSFFLVAPRAFAAAAAVTDTLRGGRNITDGETLVSADGTFTLGFFSPGVSAKRYLDSPLNVTSGVLSISDAGSLVLLDGSGGGHVAWSSNSPYAASVEARLSNSGNLVVRDSSGSTTTLWQSFDHPSNTLLPGMKMGKNLWTGAEWDLTSWRSPDDPSPGAYRRVLDTSGIPDVVLWQDGVERYRSGPWNGRWFSGNPEAATYTTNLITFQVTVSPGEISYGYVSKPGAPLTRSVVLDTGVVKRLVWEATSRTWQTYFQGPRDLCDAYAKCGAFGLCDANEPSTSFCGCLRGFSPTSPAAWAMKDASGGCRRNVPLRCGNTTTTDGFALVQGVKLPDTHNASVDTGITVEECRARCVANCSCLAYAAADIRGGGGGSGCVIWTGGIVDLRYVDQGQGLFLRLAESELDEGRSRKFMLWKTVIAAPISATIIMLVLLLAIWCRRKHKISEGIPHNPATTVPSVDLQKVKAATGNFSQGHVIGQGGFGIVYKGQLPDGRMIAVKRLHQSTLTKKGKKDFTREVEVMARLRHGNLLRLLAYCSEGSERVLIYDYMSNRSLDLYIFGDSGLRLMLNWRKRLGIIHGIANGVAYLHEGSGEGYASPEYAWRGEMTLKCDVYSFGVVLLETLSGQRNGPMYSLLPHAWELWEQGRVMSLLDATIGLPLSVSGPDHTEMEDELARCVQIGLLCVQDAPEERPAMSAVVAMLTSKSSRVDRPKRPGVHGGRSRPPLRESELLGATDIDDDLT

SEQ ID NO: 66497 - protein, 412 aa, Arabidopsis thaliana
MVNISEIPDDSNDGCDPNKKPEEQVLRRSRRIATRNENQNKKPKEEEEEDNRSVSFPIPNELTEACVALIRKCDYPSLSSVSSYFFNLIASSGLYETRSRLGLSETFLYAAIKFPDTNPANWYILHRNKVSSLRLTEVGSLPPVPWGCSVVTVGQEMYVIGGLLDIRRLQVMTLIDCRTHKFRSLPSMKRGRCKAAAGVVDGKIYVIGGFRMRKPDAEWIEVFDLKTQIWESLPGPYPKTSSCCELDAYVVMEEKLYMLGSKFCLVYEPKRNGEWDASVGATPLKDLWDKTCCVVDDMLYTTDPRRTLGHPIVVYHPKDKTWRPVKGESLWSLPSYFFSKSEMANFGGKLVILGSNKSYVTGDCIGEKGIWCVMIELEKREGGEIWGKVESLDCVLGDINFLSVRLCQTLTI

SEQ ID NO: 66498 - protein, 217 aa, Enterococcus faecalis V583
MKLAPSILSADFANLERDIRLVEELGADYIHVDVMDGQFVPNITLGPNIVSAIRPVTKLPLDVHLMIVQPENYINAFAEAGADIITVHQEATPHIHRALQMIKNAGVKAGVTINPGTPLSMIENVLDLADQVLVMTVNPGFGGQSFIENSLEKIAQLKEWKETKGYTYEIEVDGGIVPETAARCKEAGAEVFVAGSYIYNAENPQERIDALRAVLDK

SEQ ID NO: 66499 - protein, 532 aa, Zea mays
SSLDAVFNRNRKAVKLKECKVKSEVIVTIPDSEKEKKGKFPGDSEKEKKGKLPGGQRVCRRVPTLFDNLTKCSRASDGITTPKKKDPYDIDAPDSCNELAVVEYVEDIYRFYKSTEGTCLPLSSYMSSQAEISERMRAILIDWIIEVQYRLTLMPETLYLTVYIIDQYLSMESVPRKELQFVGISAMLIASKYEEIWAPLSILRLAYTTSSDILQVKDLMCLCDNAFTRDQVLTKEKAILDRLHWNLTVPTMYMFIVRYLKAAMCDTELENMAFFYSELALVHYSMLVYPPSVTAAAAVYAARSTLGMNPPWTDILEHHTGLAEPQLLLWQTLERRMGLRVTGKETFYTCLMFPIIHCLSCCAVQIPIHLPLTCPGHSHNSLQCSATLPVTYPLDVLQLRLAVQSGHNTLSQVALNMLREEGLASFYGGLGPSLVAIAPYIAVNFCVFDLMKKSVPEKYKNRPETSLATALLSATFATLMCYPLDTVRRQMQMKGTPYNTVFDAIPATSQADYSWDYPHTKVTNWLAVEAQR

SEQ ID NO: 66500 - protein, 148 aa, Gossypium hirsutum
MASKRILKELKDLQKDPPTSCSAGPVAEDMFHWQATLMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATACGWTQKYAMG

SEQ ID NO: 66501 - protein, 511 aa, Gerbera hybrid cultivar
MNTLQLIFLLFFFPTLLFLYCLPYKRNQNHRRLPPSPPSFPIIGHLHHLGPLIHQSFHALSTRYGSLIHLRLGSVPCVVVSTPDLAKDFLKTNELAFSSRKHSLAIDHITYGVAFAFAPYGTYWKFIKKLFTVELLGTQNLSHFLPIRTHEIRELLRTLMVKSRAKERVNLTEELLKLTNNVISQMMMSIRCSGTNSEADEAKNLVREVTKIFGQFNVSDFIWFCKNIDLQGFKKRYEGTHRRYDALLERIIMGREENRRRGKIKDGEGKDFLDMLLDVLEDGKAEIKITRDHIKALILDFLTAGTDTTAIAIEWALVELINNPNALEKARQEIDQVIGDERLVQESDTPNLPYIQAIIKEALRLHPPIPMLIRKSTENVIVQGYDIPAGTLLFVNIWSIGRNPQCWETPLEFKPHRFLDGGDLKSSLDIKGHNFQLLPFGTGRRGCPGVNLAMRELSVVIANLIQCFDWDVVGERLLNTDERAGLTAPRAVDFVCVPLERGNTLKILGSN

SEQ ID NO: 66502 - protein, 718 aa, Enterococcus faecalis V583
MIEIGKKLNGRYHIIGSIGSGGMANVYLAHDLILDRDVAVKVLRFDFQNDQAAIRRFQREALAATELVHPNIVSVYDVGEEDGLQYLVMEYVKGMDLKRYIQTHFPIPYSTVVDITQQILSAVAMAHEHRIIHRDLKPQNILIDEHGTVKITDFGIAIALSETSITQTNTMLGSVHYLSPEQARGSMATNQSDIYAVGIILYEMLTGNVPFDGESAVTIALKHFQEEIPSVKMFDPGIPQSLENVVRHATAKDPSDRYKTANEMAEDLYTSLSASRLNEPAWEPTALLGETKVLTPIPEDIAEPEETTPVEVPEDIADDILAEQPPKKNRKKLWIGLAIAALISLAIGGLAFAMSGGKDVEVPDVTNETKADASQALKSAGLKVDSETKKIPDDKIEEGKVVKTDPEAKSSVKKGRSVTLYISSGTEKIEMADYTKESYESAVEALKKLGFSEDQITTKKEYSDSVSTDSIIKQKPAAGKKVDPKKDNVTLTVSQGPETVTLPSYAGYSYENAVNALAQLGISDSQITRVDQASDTVEPGLVITQDPAPGGTVTPKNGQVTLYVSKGSDKVTLSDYSGISYDNAVSRLIALGIPESQIKRVDEESDKVEKDTVISQEPASGTAVDPKNDTITLHVSKGSDSVTVPDISGYSPKAAEDSINNAGLKINEQGLSGSGDGQVVERTSPSAGSKVKKGDSVTVYYSKANDSKSTTSESSTSN

SEQ ID NO: 66503 - protein, 388 aa, Escherichia coli
MKLYNLKDHNERVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 66504 - protein, 388 aa, Escherichia coli
MKLYNLKEHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 66505 - protein, 504 aa, Coprinopsis cinerea
QIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVIYDDNDPHAALYDEDDENTIITLADWYHIPAPSIQGAAQPDATLINGKGRYVGGPAAELSIVNVEQGKKYRMRLISLSCDPNWQFSIDGHELTIIEVDGELTEPHTVDRLQIFTGQRYSFVLDANQPVDNYWIRAQPNKGRNGLAGTFANGVNSAILRYAGAANADPTTSANPNPAQLNEADLHALIDPAAPGIPTPGAADVNLRFQLGFSGGRFTINGTAYESPSVPTLLQIMSGAQSANDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTVV

SEQ ID NO: 66506 - protein, 420 aa, Zea mays
MAAAEGQWVLMATGRTPTNIAVIKYWGKRDEALILPINDSISVTLDPDHLSATTTVAVSPSFPSDRMWLNGKEISLLGGRFQSCLREIRKRARDFEDKEKGVKIKKEDWDKLHVHIASYNNFPTAAGLASSAAGLACFVFTLGKLMNVKEDYGELSSIARQGSGSACRSIYGGFVKWCMGEKDDGSDSIAVQLADETHWNDLVIIIAVVSSKQKETSSTSGMRDSVETSPLLQYRAQTVVPGRVLKMEEAIKNRDFESFAKLTCADSNQFHAVCLDTSPPIFYMNDTSHRIISLVEKWNHSEGTPQVAYTFDAGPNAVLIAQNRKTAAHFLQKLLYYFPPQDNDLSSYLVGDKSILGDAGLHSMKDVEALPAPPDTKIPDQKFKGDVSYFICSRLGAGPKVVVDEGQALIDSVTGLPKGV

SEQ ID NO: 66507 - protein, 199 aa, Ostreococcus tauri
MSTTTPVAGVAHAVDARALGACAASAMAPGRITSVWVINKSGGLIDHRAFDAVDGRGETHAMRLDANATLRLASVWHSMHAIARKVSPTRGCVGIESVECDTFDLYCFQAETGTKIVMTTTKGTVDARGTLRRAHQAFYAYALQNPFYEMEMPVRCELFDAEIANVVRSVNERTRLTNISLARVSPDQTRISIGATRSP

SEQ ID NO: 66508 - protein, 609 aa, Nostoc sp. PCC 7120
MFLSSFPGKSIKMPMFTKSKRVVCTVFSLGVLCYTQLASATITLPLRSKKGMVVSAHPLASETGVAMLRKGGNAVDAAVATTLAISVVEPFSAGIGGGGFLLMRSQKTGEIKALDFRERAPLKATRKMYLDDAGKVRPNASVNGYLAVATPGTIAGMYEVHRRYGKLPWHEVVKPAIALAKDGFVLDQKPTWRSIQVYETRKQAILSNQAAREIFTRNGEFYQPGEKLVQRDLAGTLEAIAQNPQSFYTGNIARAIAADMAKNGGLITLADLKAYKPIWRNPVCGNFRQAKICSMPPPSSGGVLLLQMLNIIGDTDLKSWGWHHPDALHLFTEAMKITYSDRSQYLGDPDFVKIPLQALISPAYGKKRRAEIDLHRATPSTQVKPIAPEILQQLEKAEIPQRIYANRYESPETSHINVVDEERNAVSLTFTVNYGFGSGVVASGTGILLNDEMDDFAAAPGVPNVFGLVGSEANAISPRKTPLSSMTPTIITENERLRMVVGAPGGSTIITQVLQIILNVLEYNMNVGAAVSVPRIHHQWLPDELRVETWGLDALTLQDLRRRGHNIKETNPWGNINAIVVTKEGDLEGAADPRGEGSPRGDMKLITND

SEQ ID NO: 66509 - protein, 319 aa, Nostoc sp. PCC 7120
MEKRTLGTSDVKISPILMGTWQAGKKMWVGIEDADSIKTIRAAFEAGITTIDTAEVYGEGHSEQIVAEALSDVRGQVEYATKVFANHLKYDQVIEACDRSLKNLQTDYIDLYQIHWPAGAFNSAIVPIEETMNALNYLKEQGKIRAIGVSNFSRTQLAEASQYGRIDSLQPPYSLFWRQVEKDAAPYCVENHISILAYSPLAQGLLTGKFTRGQEFDPADNRAKNKLFQGENFERAQQALDKLRPIAERHNATLAQLALAWLIAQPQTNAIAGARYPEQAKDNAQAANIQLSTDEISEIDAIGRIVTDHHDDSPVMWNW

SEQ ID NO: 66510 - protein, 457 aa, Yersinia pestis KIM
MNFNSEIERMKVTVFGIGYVGLVQATVLAEVGHDVLCIDIDANKVADLKKGRIAIFEPGLAPLVKENYEAGRLQFSTDAQAGVAHGVIQFIAVGTPPDEDGAADLKYVLDVASTIGTYMDSPKVIIDKSTVPVGTADKVHQVIQAILEQRGEKIDFSVVSNPEFLKEGAAVADCKRPERIVIGIDTDDSGALELISELYEPFNRNHDRMLVMDIRSAELTKYAANGMLATKISFMNEIANIAERLGADIEKVRQGIGSDSRIGYHFIYSGCGYGGSCFPKDIQALIRTAEDKGYKPQLLQAVEQINNQQKYKLTEFIKSHFNSQLAGKTFAVWGLAFKPNTDDMREAPSRVVMESLWEAGATIQAYDPEAMDETQRIYGARDDLRLMGTKESALQGADALIICTEWQSFRAPDFDMIKSRLKHPVIFDGRNLYDPERLNSRGFTYYGIGRGVSINLS

SEQ ID NO: 66511 - protein, 195 aa, Triticum aestivum
RVLKPRVPPPSQAIYLHISAWPPTVRALSATSVGPFQGVKSTAGLPVSRRSNGDSLGSVSNGGRIRCMQVWPIEGIKKFETLYYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 66512 - protein, 176 aa, Ostreococcus tauri
MCDDPVWGENDPFGAPSVILHTTHGDVALELYYKHAPKTCENFFELARRGYYDGTVFHRVIADFMVQGGDPTGTGRGGESVFGGKFEDEISKGLKHVGAGILSMANSGPNTNKSQFFITLAATPWLDGKHAIFGRVESGMHAVRAMGAVKVDKNDRPLKEIKIINCTCDDRGFKWY

SEQ ID NO: 66513 - protein, 476 aa, Desulfovibrio vulgaris subsp. vulgaris str. Hildenborough
MNSDKKGRSLQPRVPMPCQPAHERVGNFHEVALGYSREDAMREASRCLQCKKPKCVKGCPVEVQIPQFIAALAKGDVESAYRTLRETNSLPAVCGRVCPQENQCEGACILGAKGQPVAIGRLERYAADTYMALDACDQLTGRPECPLIDPDLKVACIGSGPASLTVAGYLSSRGFKVTVYEALHELGGVLVYGIPEFRLPKSDIVEKEIAALRQQEVEFVTNWVGGRTFSIDDLFAEGYKAVFIGVGAGLPRFLDIPGENLVGVFSANEYLTRVNLGRAYGFPDYDTPVYRGREVTVFGGGNVAMDAARTALRLGAESVRIVYRRTRDEMPARLEELEHAEEEGVRLELLAAPLGFKGDADGRLTAVTLQRMELGEPDASGRRSPRPVEGAVYDLPTDLAVIAVGTRPNPILLEATPGLTLDRRGYIAVDEATGMTSIPGVYAGGDIVTGAATVILAMGAGRRAAKDIEARLRPAT

SEQ ID NO: 66514 - protein, 175 aa, Glycine max
MTMKSVGSAALKMVEEVRRQFNTIPGLMEGTAKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATQGGLLFKYL

SEQ ID NO: 66515 - protein, 148 aa, Gossypium hirsutum
MASKRILKELKDLQKDPPTSCSAGPVAEDMFHWQATIMGPSDSPYAGGVFLVSIHFPPDYPFKPPKVAFRTKVFHPNINSNGSICLDILKEQWSPALTISKVLLSICSLLTDPNPDDPLVLEIAHMYKTDRAKYEATARGWTQKYAMG

SEQ ID NO: 66516 - protein, 479 aa, Oryza sativa Japonica Group
MSWSGDYEKYMATAAAVAGTAMVVRGVVSELVPDELREMLRSAARGIRARVSSTHTVVIDETEGLSTNQIYDAARTYLAARINTDMQRLRASRVDDAQGIMITMDQGEEMLDVHDGVEYTWRLVSRDTAAAATAHAAPYGIGGGGAANRRGRSRFEVKSFEVSFHKKHKEKALRSYLPFVIDTAKAMNDKHRNLKMHMIEYDAWTAVDLRHPSTFDTLAMDHSLKHSVMYDLERFVKRKDYYRRIGRAWKRGYLLYGPPGTGKSSLIAAMANYLKFDIYDLELTEVKSNSDLRRLLVGMSNRSILVVEDIDCTIDLQQRDEGEIKRAKPTYSGEENEDKVTLSGLLNFVDGLWSTSGEERIIVFTTNYRERLDPALLRPGRMDMHIHMGYCTREAFRVLASNYHNVENHAMYPEIEQLIEEVLTTPAEVAEVLMRNDDVDVALQVLAEFLKAKRNEPGETKAENKNGNQKINKYEQSMV

SEQ ID NO: 66517 - protein, 148 aa, Gossypium arboreum
MASKRILKELKDLQKDPPTSCSAGPVAEDMFHWQATLMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATARGWTQKYAMG

SEQ ID NO: 66518 - protein, 570 aa, Aspergillus nidulans FGSC A4
MAQLWGWISVYCLLILSFTVRSLGQEQSAFCEHSSLARECWGQYNISTDYHAITPDTGVTREYWLVAENTTLAPDGYERQVLVFNGTLPGPLIEANWGDELVIHVTNGLEHNGTAIHWHGIWQRGTNQYDGVPGVTQCPISPGQTYTYRFRATQYGTTWYHSHFSLQLAEGLFGPLVIHGPASADYDVDLGSVFISDWYHKSAFILWEESTRYGGVPVRANAVPPTGLFNGSNVFGGGGRRSEMIVEKGKKYRLRLIDSSVDGWMKFSIDGHKLTVISADLVPIEPYETDAVILTSGQRYDVVFEANQKIGNYWTRVIYQTACNGLDIKDPDIRGILRYAGAEISDPTSSQWSSIRNSCGDEPYDKLVPYVKRTVGKAAGQENLNVGWYYDLPELYFHWTLNTKALTIDWGTPTNKLIYNNESVFPTEYNIYEVPNRDQWTYWVIQDVGLVNAYHPFHLHGHDFFILAQGRGLYTPLVKLNRDNPPRRDTATMAGNGFLVIAFESDNPGSWLMHCHIAWHASQSLALQFVERESEIGPLIEPVIGEIESDCKKWEKYHAESVYHQDDSGI

SEQ ID NO: 66519 - protein, 388 aa, Escherichia coli
MKLYNLKDHNERVSFAQAVTQGLGKNQGLFFPHDLPEFSLTEIDEMLKLDFVTRSAKILSAFIGDEIPQEILEERVRAAFVFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 66520 - protein, 148 aa, Gossypium thurberi
MASKRILKELKDLQKDPPTSCSAGPVAEDMFHWQATIMGPSDSPYAGGVFLVSIHFPPDYPFKPPKVAFRTKVFHPNINSNGSICLDILKEQWSPALTISKVLLSICSLLTDPNPDDPLVPEIAHMYKTDRAKYEATARGWTQKYAMG

SEQ ID NO: 66521 - protein, 531 aa, Mycobacterium avium 104
MTVLQSTLDREATAFTDAASAAMAKLEEIDTELANALAGGGPKYVERHHARGKLTARERIELLVDQDSPFLELSPLAAWGSSFKVGASTVTGIGVVEGVECMIVANDPTVKGGTSNPWTLKKILRANQIAFENRLPVISLVESGGADLPTQKEIFIPGGRMFRDLTRLSAAGIPTIALVFGNSTAGGAYVPGMSDHVVMIKERSKVFLAGPPLVKMATGEESDDESLGGAEMHARVSGLADYFAVDELDAIRIGRRIVARLNWVKQGPTPKPVTEPLFDTEELIGIVPADLRIPFDPREVIARIVDGSEFDEFKPLYGSSLVTGWARLHGYPIGILANARGVLFSEESQKATQFIQLANRSNTPLLFLHNTTGYMVGKDYEEGGMIKHGSMMINAVSNSTVPHISLLIGASYGAGHYGMCGRAYDPRFLFAWPTSKSAVMGGAQLAGVLSIVARAAAEARGQQFDEQADAAMRAAVEGQIEAESLPLVLSGMLYDDGVIDPRDTRTVLGMCLSAIANGPIEGTSNFGVFRM

SEQ ID NO: 66522 - protein, 531 aa, Bradyrhizobium sp. BTAi1
MPNQFSNRQEIRKPAVTSKGGIVAAQSRRAAEIGAEVLAAGGDCIDAVVATGFALGVLEPWMSGLGGGGAMVLYRAKENRVEVIDYGMRAPDSLRVEDYPLANDGSVAADLFPWPRVKDDRNLHGPGAVAVPGVVAGMEAAHSRYARLPWQDLVTPSVRLAAEGLLVDWWTTVMISSCAADLRRYPASAAAYLKDGLPPNPQWGAKAVTRLPQEQLKATLAHLASAGARDFYQGDIARSLTRDIQAAGGALSVEDLAAFAAHVREPLRIPYRGGTVFATPELTAGPTLAHALRLMQASIAASGQAPDASAFIAYAQALQSAYRERLNDMGDAPGKRALGAEYLAPACTTHYSVVDRDGNMAAVTQTLLSGFGSKFQAPQSGIMMNNGIMWFDPTPGTTNSLAPGKRCLTNYTPVVAQAADGKRLALGASGGRRILPAVAQMLSFVMDYGMDLDAAIHQPRIDASEGDVVGADTRLPAEVMNALAAKFETVPSPVQTMPMKFACPSIVLRNGDTNSGATEIFHAWGDAVAEG

SEQ ID NO: 66523 - protein, 335 aa, Xanthomonas oryzae pv. oryzae KACC10331
MNMAIKVGINGFGRIGRNVLRSAVQNFANDIEIVAINDLLEPDYLAYMLQYDSVHGRFKADVSVDGNTLIVNGKKIRLTQERDPANLKWDAVGADVVIESTGLFLTKDTAQKHIDAGAKKVILSAPSKDDTPMFVYGVNDKTYKGEAIVSNASCTTNCLAPLAKVINDKWGIKRGLMTTVHAATATQKTVDGPSNKDWRGGRGILENIIPSSTGAAKAVGVVIPALNKKLTGMSFRVPTSDVSVVDLTVELEKPATYAEICAEVKAQSEGALKGVLGYTEDKVVATDFRGETCTSVFDADAGIALDSTFVKLVSWYDNEWGYSNKCLEMVRVVAK

SEQ ID NO: 66524 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNRLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 66525 - protein, 272 aa, Vitis vinifera
MRKRERENPCGVCGHYHKYEEGEVCGVCGHRIPASSEKTSIQVSAFPSEILPEFLYLGSYDNASRSELLKTQGISRVLNTVPACQNLYKNSFTYYCLPDDKSLPFDDAIQFLEQCEKDKARVLVHCMSGKNRSPAIVIAYLMKCKGWRFAQSYQWVKERRPSVELSQAVHEQLQEYERSIFGSMESISPTMPIFQPSGAASFTFGFPKANDPLPAPAFNTIGAASIFARPPADVPPHEFKFGAGQTDKNIVESPFIANPSNPNSSDIPMDSS

SEQ ID NO: 66526 - protein, 491 aa, Parvularcula bermudensis HTCC2503
MALSNRPATDRHSLFQANVLALRFTQLPNALWHPQEAERVGLDPQLIHLNHAALPAVGLMAAADRTALTRLLAGHEASAQTDAPRSFATVYAGHQFGHFVPQLGDGRAITIAEGVGRDGPFELQLKGAGRTPFSRFGDGRAVLRSVIREYLASEHMAALGVPTTRALSIVASHEGVQRETLEPGAVMARFAPTHVRFGHFEYFHHRGETAHVKALADWVIGEFDTDLADSADPYGQFFDRVVERTAHLCAKWQAVGFAHGVLNTDNMSILGLTIDYGPYGFLDRYDPNFICNHSDHQGRYAFGRQPEIVFWNLRALAVALSSLVPVERLVQGLERFGPQFDEGWRAAYGPKFGMETAQPEDGPLLVDFLTGLRTLGADYPTSFQALTRWIEGEGELPPFDGAGEWGERWRERGLDPAQAAKVAERANPAITLRNWVAETAIRAVERDQDLVFFDRLFNALTAPFEELPEVLAPLAGPPPPELAGLAVSCSS

SEQ ID NO: 66527 - protein, 236 aa, Zea mays
MAGRVADKDPELKVLGVWSSPFVIRARVALNLKGLAYRYVEDNLDSKSELLLASNPVHGKVPVLLHDGRPVCESRVIVEYIDEAFPASGPCLLPADPYRRAVDRFWASYADDKLFPTWIPVYNGRTSEDRVAAARQVVAVLEKFEQAFDECSGSGGKAFFGGDAAGLVDVVLGGFLGWLRASEAMCGVRVIDPAKTPLLAAWADRFAALDGVREVIPDVQRLLEYNKIRRARRGLP

SEQ ID NO: 66528 - protein, 439 aa, Parvularcula bermudensis HTCC2503
MAEPSLRSALTELLGHVQNGKEVRAYLDRFGEAAKTRFAIFKLGGAVLEYGYEELAAALSLINTVGLTPIVVHGAGPQLDREVKARGLDRGKVDGLRVTDDRIAELAGTTVMEISTALAAAIGRAGGRAVPLPPMALAADPIDEATYGRVGEPTGIAKSLIEDVVASGAIPILGSLGIDRTGRLLNINADSVARALAIDFEPLKIVFVTGTGGLLDQEGRRIPAINLDAELDGLVKDGTVHSGMKLKLEEIQKLLDPLPRSTSVSITSPRGLVRELFTHGGDGTLVRRGEIITAHTHFETLDITKLSTLIEDAFGRSLKPGYLDNLQVAKIYASADMRAAAVVIEVEGMAVLDKFAVSRGARGEGLSHALWRRMSEDFPLLFWRSRAQNGFNAFYSERADGCVRRGMWQVFWQGEIDLNTVAPAVAAIAGRPEAFEASS

SEQ ID NO: 66529 - protein, 542 aa, Pediococcus damnosus
MAKSPVEILNDPFLNKGTAFTKEERQSLGLVGLLPPYVQTLDEQAAQTYAQVESKTSSLEKRIFLMEIFNENRVLFYKLFSQHVVEFMPIVYDPTIADTIENYSELFVQPQNATFLSIDDPDSMKDSLKNAADGRDIRLIVVTDAEGILGIGDWGTNGVDISVGKLMVYTAAAGIDPSQVMPVALDTGTNNQDLLKDPMYLGNRHERVTGDRYYKFVDQFVNTAEDLFPKLYLHFEDFARDNDANILNTYKDKITTFNDDIQGTGIIVLAGILGALNISKQKMTDQVYLSFGAGTAGAGITKRIYDEFLQQGLSADEAKKHFYLVDKQGLLFDDDKTLTPEQKPFARSRSEFANADDLTTLEAAVKAIHPTILVGTSTQPGTFTESIVKEMAAHTDRPIIFPLSNPTKLAEAKAEDLIKWSDGKALVATGIPADDVEYNGVTYQIGQANNALVYPGLGLGVIASTAKVLNDEMISKAAHSLGGIVDGNKAGAAVLPPVSKLDQFSYTVAKAAAQSAVDQKLNQEPISDVDKAITDMKWEPKY

SEQ ID NO: 66530 - protein, 232 aa, Debaryomyces hansenii CBS767
MVKSIIAPSILASDFANLGCNCHRMYDSGADWLHIDVMDGHFVPNISMGPPIIDSLRKEIPRSETKASFFDCHMMVSEPEKWVPEIAKAGGDQYTFHYESTKDPVALVKLIKSHGMKAACAVKPGTPVDVLYPLAEDLDMALVMTVEPGFGGQKFMPEMMPKVESLRQKFPELNIQVDGGLGHETIPAAAEAGANVIVAGTAVFKAQDPKEMIQLLRNAVNKNLKSRGLLDE

SEQ ID NO: 66531 - protein, 331 aa, Parvularcula bermudensis HTCC2503
MKHFLTTEDWPREDLEQLLVDADRLRGLKDQSLKGKTAALIFFNPSLRTRASFQVAMIEMGGNALVLDTAGTWSLEVEPGAMMDQGAEEHVKEAARVLSTYVDVICIRCFPKFQDWSVDRQDRLLHAFAEYATVPIVNMETIVHPCQELAHMLAVKDRLGAPDGKKYVLTWTYHPKPLNTAVANSSLLIATKFGMDVTLLCPTEEYLLDPRFMSASEENVKRSGGSLTISHDPQTAYRDADVVYAKSWGALPYFGRWEEEKPIRDAHRHFRVDEDKMALTNNALFSHCLPLRRNVKVTDAVADSPQSMIIEEAANRLPVQKAVLQRLLKGN

SEQ ID NO: 66532 - protein, 350 aa, Xylella fastidiosa Dixon
MDIPDVGHTVVKQSNASNVNTVSVADVLAAQARLRRYLMPTPIHYAERFGVMLKLENLQRTGSYKVRGALNAMLVALERGDNRPVICASAGNHAQGVAWSAYRLGIQAITVMPHGAPATKVAGVSHWGATVRQHGQSYDEAYTFACELAEQNDYRFLSAFDDPDVIAGQGTVGIEITAHEPDVVIVPIGGGGLASGIALVLRSQGVRVIGAQVEGVDAMARAIRGDTREIAPVSTLADGVKVKIPGFITRHLCANLLDDVVIVREAELRETLVRLLLEEHLIAEGAGALALAAGRRVSGKRKCAVVSGGNIDAAVLAKLLSEVRPRPPRKPRRRSADRPNNSGNLPLPFN

SEQ ID NO: 66533 - protein, 514 aa, Aspergillus nidulans FGSC A4
MIFFFPILFALAGTCITLLFSNRIRQYRALVSKTRQPDRDRVVVKGHTYSEAVSGDQKTEVEFRSEGLSTISQIENVRQVCIIGAGKEGVITGIILASHNPEVEFCVADTDEELIRLWKSDTLPFSEPGLENMFFDDGALHATRSEDEKEDGKHANIDHGQDQDQQRLTGKETAAHVERRKKLSNLTFSADIHAALVPAQLVFLCLEMDPSAGASLQAISSPKATHTVLANPVLAVPFPGSLIASMITPSSVIIGHIFSSTASTPAITALKRLYASFVPEDRIVTMDAYSAELGTISAKAVIVQQMMALNSVHMICGKVEASPGNVGWILGGLDIAAVRTGVWMRREVRCLVNLAKGLGMEEVKAYWEGVLKLEGMKYRRDVRNFLETLNQGEDRKKAALILTDAMGDQETALVLLDELKRAEVTIRAWVDCATKEQSHNVLQTVRGRVEGLEVANSLESACAGSNVVILHGSLGIRDEAMQAIADNMERPKALLNLGDRMDEMKMRQLGFRLV

SEQ ID NO: 66534 - protein, 224 aa, Zea mays
  misc_feature (41)..(41): Xaa can be any naturally occurring amino acid
MSQDQENGGTNGQHAADVMEVEPKRRAPRLNERILSSLSRXGPEAPAVFNVVVEITKGSKVKYELDKKTGLIKVDRILYSSVVYPHNYGFVPRTLCEDNDPLDVLGLMQQEPVLPGAFLRARAIGLMPMIDQGEKDDKIIAVCADDPEYRHYNDISELSPHRLQEIRRFFEDCTRACSLSLSLGARFLLSLSLSLGARCVRARCSVSARAPLYECVCGCCVSRS

SEQ ID NO: 66535 - protein, 278 aa, Marinobacter sp. ELB17
MIKKCLFPVAGYGTRFLPATKAMPKEILPIVNKPLVQYGVEEASDAGIHEFGFVTGRGKRAIEDHFDISYELEHQIAGSGKEGMLTSIRDLIDHNTFAFTRQSEMKGLGHAILTGRNLVGDNPFAVVLADDFCVGPDGGDGVLAQMVKLYSQFRCSIVAIEEVPADETHKYGVIAGECMKDGLFRVTDMVEKPAPEDAPSNMAIIGRYILTPDIFDILERTPPGKNGEVQITDALLEQAKTGCVLAYQFKGRRFDCGSIDGFVEATNYVYENIYKKGL

SEQ ID NO: 66536 - protein, 311 aa, Triticum aestivum
MAMVTAKLSSPAAARLAPSAGSARRASRVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIAQDNGLVPIVEPEILLDGDHGIERTLEVAEKVWSEVFFYLAENNVLFEGILLKPSMVTPGAEHKEKASPEAIAKNTLTMLRRRVPPAVPGIMFLSGGQSELEATMNLNAI

SEQ ID NO: 66537 - protein, 418 aa, Physcomitrella patens subsp. patens
MASLSLSINGVAQESAMPASQNSDPPRVQVAKRLEQFKTTIFTEISILASKHNAINLGQGFPNFDGPEFVKNAAIEAIRDGGKNQYARGFGVPQLNAAIAESFNKESGIVVDPETHVTVTSGCTEAIAATVLGLVNPGDEIIVFEPFYDSYQATVSMSGAILKTVTMRAPEFAVPEEELRAAFSSKTRAILVNTPHNPTGKVFPRHELELIASLCKEHNTLAFCDEVYNKLVFKGEHVSLASLDGMYERTVTMNSLGKTFSLTGWKIGWAVAPPHLTRGIRLAHSYLTFATATPLQWASVEALRAPDSFYAELIKSYSAKKDILVEGLNSVGFEVYEPEGTYFVMVDHTPFGFENDVAFCKYLIEEVGIAAIPPSVFYTNPEDGKNLVRFAFCKDEETLKTAVERLRTKLKKAVSLSS

SEQ ID NO: 66538 - protein, 284 aa, Rhododendron catawbiense
MAKEMGVAEQGSFSAKDYHDPPPAPLIDPQELVKWSFYRAVIAEFITTLLFLYITVLTVIGYKSQTDNADPCGGVGILGIAWSFGGMIFVLVYCTAGISGGHINPAVTFGLFLARKVSLIRALMYMVAQCLGAICGVALVKAFQKSHYDRYGGGANSLALGYSKGTGLAAEIIGTFVLVYTVFSATDPKRSARDSHVPVLAPLPIGFAVFMVHLATIPITGTGINPARSLGAAVIYNNDKAWNDQWMFWVGPFIGAAIAAFYHQFILRAGAVKALGSFRSGSHV

SEQ ID NO: 66539 - protein, 765 aa, Medicago truncatula
MMQILKSLQIVLLLIFCSRHITAQTKNTYIIHMDKSTMPETFTDHLNWFDTSLKSVSETAEILYTYKHIAHGYSTRLTNQEAETLSKQPGILDVIPELRYQLHTTRTPQFLGLPKTNTLLPHSRQQSQVIIGILDTGIWPELKSLDDTGLGPIPSNWKGVCETGNNMNSSHCNKKLIGARFFLKGYEAALGPIDETTESKSARDDDGHGSHTLTTAAGSVVAEASLFGLASGTARGMATEARVAAYKVCWLSGCFTSDIAAGMDKAIEDGVNILSMSIGGSIMDYYRDIIAIGAFTAMSHGILVSSSAGNGGPSAESLSNVAPWITTVGAGTIDRDFPSYITLGNGKTYTGASLYNGKPSSDSLLPVVYAGNVSESSVGYLCIPDSLTSSKVLGKIVICERGGNSRVEKGLVVKNAGGVGMILVNNEAYGEELIADSHLLPAAALGQKSSTVLKDYVFTTKNPRAKLVFGGTHLQVQPSPVVAAFSSRGPNSLTPKILKPDLIAPGVNILAGWTGAVGPTGLALDKRHVNFNIISGTSMSCPHASGLAAIVKGAYPEWSPAAIRSALMTTAYTSYKNGQTIVDVATGKPATPFDFGSGHVDPVSALDPGLVYDINVDDYLGFFCALNYTSYQIKLAARREFTCDARKKYRVEDFNYPSFAVALETASGIGGGSNKPIIVEYNRVLTNVGAPGTYNATVVLSSVDSSSVKVVVEPETISFKEVYEKKGYKVRFICGSMPSGTKSFGYLEWNDGKHKVGSPIAFSWT

SEQ ID NO: 66540 - protein, 413 aa, Arabidopsis thaliana
MAHYINIYGKRLFDIGLYLKTSVDLILQQQHVLMSQQKFTDISLCHREAPNPVKLEDIGQQSKTLGTAIHRKISEQKRVIESGSVASIVEHKRTNLSAIMATRANIPEQVRGAPLVDGLKIQNKNGAVKNRRALGDIGNLVSVPGVQGGKAQPPINRPITLSFRAQLLANAQLERKPINGDNKVPALGPKKEVAMSPKNKKVTYSYVLSAQSKAACGIVNKPKILDIDESDKDNHVAAVEYVDDMYSFYKEVEKESQPKMYMHIQTEMNEKMRAILIDWLLEVHIKFELNLETLYLTVNIIDRFLYVKAVPKRELQVVNDLVYVTDNAYSSRQILVMKKAILGNLEWYLTIPTQYVFLFCFIKASISDPEVSTFLLKVQFFCYYNVDWFSFVVQFLDLIVPKLRDNYSTHKMF

SEQ ID NO: 66541 - protein, 156 aa, Yersinia pestis KIM
MLLLDVVFVDFIPCQRTAKMAKELNPTENIEKLSDIQRYVTQERGTEAPFTGKLLHNKRDGVYQCLCCHQPLFISESKFDSGCGWPSFYQPIDADSIRYIDDYSHNMHRIEIRCGNCDAHLGHVFPDGPQPTGERYCINSASLNFVDDQNGEQTAG

SEQ ID NO: 66542 - protein, 363 aa, Nostoc sp. PCC 7120
MTLSLSVAKSHRQPWPGLIEAYREYLPVSDKTPVVTLLEGNTPLIPVPAIAERIGRQVSVFVKYDGLNPTGSFKDRGMTMAISKAKEDGAKAVICASTGNTSAAAAAYARRGGMKAFVLIPDGYVALGKLAQALLYGAEVLAIKGNFDQALEIVREMAESYPITLVNSVNPYRLEGQKTGAFEVVDALGNAPDWLCIPVGNAGNITAYWMGFCQYHQAGKCDRLPQMMGFQAAGAAPLVNGQPVSHPETIATAIRIGKPASWDKAIAAQSASQGSFNAVTDEEILDAYRLLASSEGIFCEPASAASVAGLLKVKDQVPTGATVVCVLTGNGLKDPDTAIKHSHSQFKQGIEADLSSVAKAMGF

SEQ ID NO: 66543 - protein, 493 aa, Oryza sativa
  misc_feature (416)..(416): Xaa can be any naturally occurring amino acid
MVLSKAVSESDMSVHSTFASRYVRASLPRYRMPENSIPKEAAYQIINDELMLDGNPRLNLASFVTTWMEPECDKLIMAAINKNYVDMDEYPVTTELQNRCVNMIAHLFHAPLGEDETAVGVGTVGSSEAIMLAGLAFKRRWQNKRKAEGKPFDKPNIITGANVQVCWEKFARYFEVELKEVKLRDGYYVMDPEKAVDMVNENTICVAAILGSTLNGEFEDVKLLNDLLDKKNKETGWETPIHVDAASGGFIAPFLYPELEWDFRLPWVKSINVSGHKYGLVYAGIGWCIWRNKEDLPEELIFHINYLGTDQPTFTLNFSKGSSQVIAQYYQLIRHGFEGYRNIMENCHENAMVLKEGLVKTGRFDIVSKDEGVPLVAFSLKDRSRHDEFEISDMLRRFGWIVPAYTMPPDAQHVTXVLRVVIREEFSRTLAERLVLDIEKVMYQLDALPSRLMPPVPPAPLLVVAKKSELETQRSVTEAWKKFVLAKRTNGVC

SEQ ID NO: 66544 - protein, 209 aa, Vitis vinifera
MWMTWTVRAWNKCQEAKQGFNGGGWSTSVSGGLISPKSMASPTLITPTTKPKPLFLIKSKLPTTTTNAAPPPTPQPRRRELIAVTAGVLSHALLLPVAPQAVAANDEEYVKETADVINKVRTTINMDKTDPDVATAVADLRDASNSWVAKYRREKALLGRPSFRDMYSALNAVSGHYISFGPTAPIPAKRKARILEEMDTAEKALLRGR

SEQ ID NO: 66545 - protein, 355 aa, Burkholderia mallei ATCC 23344
MKIAVLPGDGIGPEIVNEAVKVLNALDEKFELEQAPVGGAGYEASGHPLPDATLALAKEADAILFGAVGDWKYDSLERALRPEQAILGLRKHLELFANFRPAICYPQLVDASPLKPELVAGLDILIVRELNGDIYFGQPRGVRAAPDGPFAGAREGFDTMRYSEPEVRRIAHVAFQAARKRAKKLLSVDKSNVLETSQFWRDVMIDVSKEYADVELSHMYVDNAAMQLAKAPKQFDVIVTGNMFGDILSDEASMLTGSIGMLPSASLDQRNKGLYEPSHGSAPDIAGKGIANPLATILSAAMLLRYSLNRAEQADRIERAVKAVLEQGYRTGDIATPGCKQVGTAAMGDAVVAAL

SEQ ID NO: 66546 - protein, 850 aa, Haloarcula marismortui ATCC 43049
MSLPPYIYADRRVPDEETVRETLDQRTMTAFGDTEQLERLHRVFYPVFKIDYEYETGKGKLLGTTTKSETAFLDGLWADNDRAVSQYVDDTDAVVRRATSDYDFGRSDPVLGRSVLLQFQVTDDDARSLLPQRVAEYRDQQQDAASGTANVFLRKLRESYGLPGDFDPDGFDGVTGVDRLYLPFWLAEYHSPDSTDVKLVTFRDPDASTEELQRHGWLAEFLSAEPRRLAEYGYEVNPDRLERNIRERIDQSDESGTAGMGGDSGSDSTDGAPSINRERPSDDGTVVQPDGVDMEADGLVDPDPSRSFADVGGMSELLETLNHKVVRPLQDPSAFEEYGIGVVNGVLLHGPPGCGKTHVAGALAGEVDHAFIEVTPADVTSKYMGEPAQKVEELFQIARANAPCILFIDEIDGIAGARDGDSNMNSSEQQLVNQLLTELEGIADEDVVVLGATNLVEDVDDAIRRSGRFDERVEVPPPDPQARKQILEIHLAGRPTADDINLDPVVEETAGFAASDIELLAEDAARKALRADAPIGTDHLLQAATETDTSIPDWVDPEMVAENGVVQPDSVDLQASSLVETDPGRDFADVGGMGELKDRLEDTVLDPLENADAYAEYGIDVLSGLLLYGPPGCGKTHLAGALAGELGHSFVEISPADVTSKWMGEPARNVAEVFEVARANAPCVLFIDEIDGIAGSRRGSMNTSEQQLVNQLLTELEGAAADDIVVVAATNFVEDIDTALRRSGRFDERVEVPPPDAKARRQILEIHLQDRPVAGDIDWDAIVEPTAGYAASDLELVAEDAARHALRDGSEITQEHLEIAVWETHSSIADWDDRDRYQGAEGTADLGLGP

SEQ ID NO: 66547 - protein, 411 aa, Physcomitrella patens subsp. patens
MNVNFRRLGVDVGPHIKRNLLEEGAPVPSSPTDSGELSKSLVYLLGFGSALVIVIVISISAIAYFRYKRRSTAVRPWKQGMSGQLQRVFGTEAPLLRREEVEVACEDFSNIIGSSSDNIVYKGTLSNGTEIAATSMRVSIENWSTQKELSFRRKVEALARMRHPHLVNLVGYTSEEEPFTRILVFEYASNGTLYDHLHNKESEHLDWATRMRIIMGTAYGLSYMHHELVPPASHLNLDSNSIFLTDDYAAKVANFGVSKMSLTRSERQKNSWLAPRVIGYDDSEGSDRLSPDFESNMYAFGLLLLEIISGRVQHSELTGNLVDWANEYLSDSKMVWYMVDPSLKSYNHDDLVALCKIIQLCLLSRNRRPSMRKITNMLAEVLKMSPEAVGPKSTALLWATLELNDDNTETH

SEQ ID NO: 66548 - protein, 362 aa, Oryza sativa Japonica Group
MDRAALTVGPGMDMPIMHDGDRYELVRDIGSGNFGVARLMRSRADGQLVAVKYIERGDKIDENVQREIINHRSLRHPNIIRFKEVILTPTHLAIVMEYASGGELFERICNAGRFSEDEARFFFQQLISGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPDEPKNFRKTIQRILGVQYSIPDYVHISPECRDLIARIFVANPATRISIPEIRNHPWFLKNLPADLMDDSKMSSQYEEPEQPMQSMDEIMQILAEATIPAAGSGGINQFLNDGLDLDDDMEDLDSDPDLDVESSGEIVYAM

SEQ ID NO: 66549 - protein, 786 aa, Haloarcula marismortui ATCC 43049
MATGTSLIVVEDGTNESMPTLWLDEIGADDLARVGGKAASLGELTGAGLPVPSAFVVTADTYRSFIEATGIDEPLFEAVDVDSDDSQALAEAAERAQELILETDTPPSVREDLLAAYDEMGDEDVAVRSSATAEDLPDASFAGQQDTYLNVSRTDLLQRVKECWASLFTQRAIYYRNENDFAHDAVDIAVVVQQMVDAEKSGVMFTSHPSTGGPTAIIEAAWGLGEAVVSGAVSPDNYIIDRETETIDEVTVADKKVMCVRGEDGETIERSVPEEKRNERVLSDEEIHRLLEVGERVEEHYDTPQDVEWAVYEDEVYLLQSRPITTIDDPEGSAGSANEAESQPPGAKSGVADGGAMESQSEAVRLSGIGSAPGRVTGVVRIVDKLDNLDKVEDGDIIVAEMTTPDMVPAMKRANGIITDEGGMTSHAAIVSRELGVPAVVGAEDATQKLRDGETITLDGDKGTVEKGANVPETTEEDKDAGPVETHSAVKPMTGTEVKVNVSIPEAAERAAATGADGVGLLRIEHMILSTDKTPSRYVEDHGERAYVDEIVEGVRSVAEAFYPRPVRVRTLDAPSDEFRQLQGGEDEPSEHNPMLGYRGIRRSLDRPGEFKLELRAFERLYDLGYDNVELMLPLVTDAEDILRAKALMQEVGIDPEKRDWGVMVETPASALSIEGICEAGIDFVSFGTNDLTQYTLAVDRNNGNVADRFDELHPAVLELMRQVIGTCREHDVATSICGQAASKPQMVDFLVDEGVTSISPNIDAVRDVQHEVKRVEQRLLLESVR

SEQ ID NO: 66550 - protein, 221 aa, Zea mays
MSRRGDWVYENNGGTCVAIAGADYCVVAADTRLSVGYSILTRDHSKICDLADKCVLASSGFQGDIKALQKNLAARELLYQHQHNKRMSCPAMAQLLSNTLYYKRFFPYYAFNVLGGLDSEGKGCVFTYDAVGSYERTGYSAQGTGSTLIMPVLDNQLKSPSPLLLPVRDAVTPLSESEAIDLVKDVFASATERDIYTGDKLEIVVINKAGTKREYIDLRKD

SEQ ID NO: 66551 - protein, 451 aa, Arabidopsis thaliana
MYRTAASRARALKGVLTRSLRPARYASSSAVAETSSSTPAYLSWLSGGSRAALTSLDMPLQGVSLPPPLADKVEPSKLQITTLPNGLKIASETTPNPAASIGLYVDCGSIYEAPYFHGATHLLERMAFKSTLNRTHFRLVREIEAIGGNTSASASREQMSYTIDALKTYVPEMVEVLIDSVRNPAFLDWEVNEELRKMKVEIAELAKNPMGFLLEAIHSAGYSGPLASPLYAPESALDRLNGELLEEFMTENFTAARMVLAASGVEHEELLKVAEPLTSDLPNVPPQLAPKSQYVGGDFRQHTGGEATHFAVAFEVPGWNNEKEAVTATVLQMLMGGGGSFSAGGPGKGMHSWLYRRVLNEYQEVQSCTAFTSIFNDTGLFGIYGCSSPQFAAKAIELAAKELKDVAGGKVNQAHLDRAKAATKSAVLMNLESRMIAAEDIGRQILTYGES

SEQ ID NO: 66552 - protein, 625 aa, Oryza sativa
MAKSLLVSSLLAVVAAVVVGAGPNPQYCPPSSCGHLGNISYPFRLQGDSRDCVATPRPWYNLSCSSGRAAIQINTGTYYVSSINYTGEVFSVVDATLQDDDTNSSCPLPRSDHLPFPDWYRDYRPADSYGFFDLATASGTWACFVNCSRAITDIMPWYKPVTCLLPNNSFVFVSFVNCAVGELQPSCRYLAMIPFESRHISDNSSQLQNASYTDIIGFIRKGFSVRFPYRPDQYQSPRMSARECLKDSNRLVLGSLVVFIFLAHKYWKTRITIDAVEKFLRMQQMIGPTRFAYTDIIAITSHFRDKLGQGGYGSVYKGVLLPGNVHIAVKMLTGSSSCNGDEFISEVSTIGRIHHVNVVRLVGFCSEEMRRALVYEYMPRGSLDKYIFSSEKSFSWDKLNEIALGIARGINYLHQGCEMQILHFDIKPHNILLDDNFVPKVADFGLAKLYPRDKSFVPVSAARGTVGYIAPEMISRSFGVISSKSDVYSFGMLLLEMAGGRRNADPNAANSSQAYYPSRVYRELTRRETSEISDIADMHELEKKLCIVGLWCIQMRSCDRPTMSEVIEMLEGGTDELQVPPRPFFCDDEQLPGVESYNMPSDLTAISEEHEDDDDDSICLFESYQ

SEQ ID NO: 66553 - protein, 350 aa, Haloarcula marismortui ATCC 43049
MLQRAEPQDFERVLSSMCTVPHPSAREAAERFLATNPGDPGTYETIAGLEREAVEYLGDITGLSDPAGYVASGGTEANLQAIRIARNRADTDDPNVVAPVHAHFSFTKAADVLGVELRTAPAADYRVNMAAMAELVDEDTVCVVGVAGSTEYGYVDPIPAIADLAETVDALCHVDAAWGGFYLPFTDHDWHFGHADIDTMTIDPHKVGQAAVPAGGLLARDRTLLDELAVETPYLESTDQLTLTGTRSGAGVASAVAAMESLWPAGYRQQYETSMANADWLADQLSARGHDVVGPELPLVAADLSMPMTDELRDRGWRVSKTGAGEMRVVCMPHVTRSMLRSFVADLDWY

SEQ ID NO: 66554 - protein, 504 aa, Solibacter usitatus Ellin6076
MAVQSEVALKTVDHWIGGARITSKSGRSGTVWNPATGRAQALVAFASIEEVDHAVAAAKAAFPAWRATPLSRRAETMFKLRDLIDANRRRIAEALTLEHGKTTADAMGEIARGLENVEFACGIPQMLKGGYSEQASRGVDVYQIRQPLGVVAGITPFNFPAMVPMWMFANAIACGNTFILKPSEKDPSVSLLLAELIHEAGVPAGVFNVVQGDKVAVDRLLEHPDVKAISFVGSTPVAKAIYETGTRNGKRVQALGGAKNHMLVLPDADIGMAADAAVSAAYGSAGERCMAISVVVAVGGVADPLIAAIQERMLKIKVGPGMDEGNEMGPLITREHRDSVAAHLDAATAEGATLTVDGRQNPVTGRDGFFLGTSLIDNVKPGMSCYDDEIFGPVLGIVRVKTYAEALKMINDNPFGNGTAIFTRDGGAARQFQFDVDAGMVGINVPIPVPVAYYSFGGWKASLFGDVHMYGPEGIQFYTRAKVVTSRWPDPETSKVDLGFPQVR

SEQ ID NO: 66555 - protein, 601 aa, Xylella fastidiosa Dixon
MSYLVLARKWRPKRFAELVGQEHVVRALSNALESGRLHHAFLFTGTRGVGKTTIARIFAKSLNCEQGTSADPCGRCTACLDIDVGRYIDLLEIDAASNTGVDDVREMIENAQYMPSRGKFKVYLIDEVHMLSKAAFNALLKTLEEPPPHVKFLLATTDPQKLPVTVLSRCLQFNLKRLDEEQIQRQIAKILTAEQITADDAAIIELSKAADGSLRDGLSLLDQAIAYAGGTLREGAVRDMLGTVDRTQVEVMLAALIAGDGDRLLRVIATLAEFSPDWGGVLEALAEALHRIQVQQLVPSVVFAGDGLNVALLAEQTQPEVVQLWYQMAINGRHDLHLAPSPRVGFEMAVLRMLAFRPVPVVAPCMVSTDGQGQSVNAPLMASVGRDAHGANGYTMSQSRSDLQSALPPTSIAVPPMGKSSLLRSTAVAPRQLENVSVWAEQYVLSSSEGAMEGVPLTTEVNKVGVGSLDGKITDVGQWLALVERIELSGPSKQLAAHAAFVSHENNVLSLALAPEFEYLQSTRSVADLTQGLTRLLGQAPEVKIEARNIQVETLHERTYRQKSERQQLAEEAFMSDHVVQHLIYQQAAKVVTDSIRPYDE

SEQ ID NO: 66556 - protein, 566 aa, Physcomitrella patens subsp. patens
MVRESTALVATKWVGLVAGMWVQASAGNAYMFSFYSPTLKSVLNYNQLQLNNLGVAKDIGENVGLLAGLLCNKVPAWTLLFIGALSGFFGYGTMWLVVSEQIPPLPYWQMCVIQCIGSNSTTWFNTAVLVTCMRNFPHSRGTVVGILKGLVALSAAIFAQIYTSLLTDDTNMLLLFLTLVPTVVCLGSMAFVRPVPAAGNVRDPEESHYFHYVTAVCVALAGYLLAVNLTEEFVKTNRFTAVIFAAIMVMFLIAPLAIPIKTLSAECCGISPIGEDTPQGIQKPLLKETNETNISSSHSALIIREEDAETLLVVGEGAVKRPKRKPRRGEDFNLRQALVKADFWILFFTFFCGVGTGVTAINNLGQIAEAQGYHNVNIFVSLISIANFLGRLGGGSLSEHHVRKDAVPRTLWLALAQITLVFVHLMFASALPGTLYVGSVLLGLCYGIHFSIMVPTASELFGLKHFGMIYNFLTIASPLGSFLFSGLIAGYLYDIEAAKDSGGSQLFGKEVCNGAHCFRLTFYVMAAVSASGALMTTVLTYRIRSVYFALYRKSPHPSASDLKSLE

SEQ ID NO: 66557 - protein, 678 aa, Candidatus Kuenenia stuttgartiensis
MDFFFVNSKISERKVKIWNSNGLHARPATKFSEIANKYTSEIRVEAKGKNIDGKSIIELLTLGAENGTELLISAKGVDCAEALDALEELVNSKFEEEFMEIRKGIAVSPGVVIRQAFLFESEGFRIPRHVIKNEAVEDEVCRLEKAIDASKKEIEDLEKKVSENLGSEIGSIFGTHRMVLQDARLKDEIIKRIRKTNFTPEFAVSLALRVYIRKFQDIKDSYLAERVTDIFDVERRLLRNLLGEKREELKNLEEEVVLVAHDLTPSQTAMLDPQKVKGFATDGGGRTSHTAIVARALGIPAVVGLGTVTSDVFGGDIVIVDGNRGLVIVRPDDETLATYQSKVKSIDVFEKKLAIELKDQPSTTADGRHISIFGNIEFPREIGVNLNYGAEGIGLYRTEFLYLNSPTPPTEEQHLEAYTTVVQELKGRPVIIRTLDLGADKLPYLEHRKEGNPFLGCRSIRYCFENPSIFKIQLRALLRASALGEVKILFPLISSIQELRRAKQMVYETMEDLDKENISFDKNVKMGTMLEVPSSVMISDMLAKECDFFSIGTNDLIQYSLAVDRNNERVAYLYCPVHPAILRFLKFAIKSAHENDIPVGICGEMGGELEYTIPLVGLGLKEFSVAPATIIPEMKKIIRSVSFEEAREVAETVFKFDNPEKTKKYLNDFVRKILPEVY

SEQ ID NO: 66558 - protein, 346 aa, Xylella fastidiosa Dixon
MIDSKQKIAVLGAGSWGTALAALVARHDYPTILWGRDVRVIQSIDIQHQNFRYLPSIMLPQTLRATTDLAAAVSGADWILVAVPSYAFTETLCRLAPLLSIGVGVAWATKGFEPGSGRFLHEVAREILGGDVPLAVVTGPSFAKEVTLGLPTAVTVHGEDVCFTQMVANAMHGPMFRAYTGNDVIGAELGGAMKNVLAVAIGVADGMQLGMNARAGLITRGLNEMLRLSAVIGARPETLMGLAGLGDLVLTCTGDLSRNRRLGFALGRGQSLSDAIREIGQVVESVQTSDEVMRQAEQNGVELPISEAVRAVLREEITPYAGMKALLAREQKPEYLDILFKANCSL

SEQ ID NO: 66559 - protein, 475 aa, Anabaena variabilis ATCC 29413
MSHEFDYDLVIIGAGVGGHGAALHAVSCGLKTAIIEAGDMGGTCVNRGCIPSKALLAASGRVRELRDAHHLKSLGIQIGNVEFDRQAIANHANNLVSKIQGDLTNSLKRLGVDIIRGWGKIAGTQKVTVTGDGGEKTITARDIILSPGSVPFVPPGIEVDGKTVFTSDQGVKLETLPEWVAIIGSGYIGLEFSDIYSALGCEITLIEALDQLMPGFDRDIAKLAERVLITPRDIETKVGVYAKKVIPGSPVVIELADFKTKEVVDVIEVDACLVATGRIPATKNLGLESIGVELDRRNFIPVDDRMAVLSAGEVVPHLWAIGDANGKMMLAHAASAQGIVAVENIIGKERTVDYRSIPAAAFTHPEVSYVGLTETGAKELGQAEGFEIATSRSYFKGNSKALAENEADGIAKVIYRKDTGEVLGVHIFGLHASDLIHEASAAVANRQTVQTLAHLVHAHPTLSEVLDEAYKRAIV

SEQ ID NO: 66560 - protein, 366 aa, Triticum aestivum
  misc_feature (173)..(173): Xaa can be any naturally occurring amino acid
  misc_feature (197)..(197): Xaa can be any naturally occurring amino acid
  misc_feature (219)..(219): Xaa can be any naturally occurring amino acid
  misc_feature (231)..(231): Xaa can be any naturally occurring amino acid
  misc_feature (252)..(252): Xaa can be any naturally occurring amino acid
  misc_feature (295)..(295): Xaa can be any naturally occurring amino acid
VTLLEQVCTKKQAGTGPEFPGYRRPTRPDMAASADEEACMYALQLVSSSILPMTLKNAIELGLLETLVAAGGKLLTPAEVAAKLPSTANPAAADMVDRMLRLLASYNVVSCTMEEGKDGRLSRRYRAAPVCKFLTPNEDGVSMAALALMNQDKVLMESWYYLKDAVLDGGIPXFNKAYGMSAFKYHGTEPRFNRVFXRGMKNPSIILTKKLLEVYKGFXGLGTIVDVGGGXVGATVGAIVAAYPAIKGINFXLPHVISEAPPFPGVTHVGGDWSDEHCATLLKNCYDALPAHGKXVVLVECILPVNPEATPKAQGVFHVDMIMLAHNPGGRERYEREFEALAKGAGFKAIKTTYIYANAFAIEFTK

SEQ ID NO: 66561 - protein, 152 aa, Arabidopsis thaliana
MASLFTPSPTTTSSSGDTIYVAAVPLKAAAGPPQLIMSMAYSLNISNLQHFMVLIKPSSPIRQEVLVFDFQPRNPESIEAAISLLSGNLIPGVVLQRRLKNVPRQRCWMVGPSKGNDAMEMAMEFNKSWETDLRVGFHDCRHYTNGLVLYKL

SEQ ID NO: 66562 - protein, 286 aa, Triticum aestivum
  misc_feature (199)..(199): Xaa can be any naturally occurring amino acid
VTLLEQVCTKKQAATGPEFPGYRRPTRPGGWVTAKLSSPATARLAPVRSAQPARRASLVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGAXRFAKWRTVVSIPWGSYWHYLSREAAWGDLLAMLAIAPRTMGLSAHLGEPENPPSTGTMAFQEELFEVAKKKGWAEGGSSYLGKYRFV

SEQ ID NO: 66563 - protein, 339 aa, Guillardia theta
MPTKIGINGFGRIGRLVTRAAFSNKKADCQVVAVNDPFIDLDYMVYMFKYDSTHGIWKGSCEKKGDKLVIDGCEITCFTERDPTAIKWAAAGAIYVVESTGVFTTIDKAQAHLSGGAKKVVISAPSADAPMFVMGVNNKAYDGTPTIVSNASCTTNCLAPLAKVVERNFGIVEGLMSTVHATTATQKTVDGPSGKDWRGGRGAAQNIIPSATGAAKAVGKVLPELNGKLTGMAFRVPTPDVSVVDLTVKLAKPASYQQICDAIKAATTDPEYCGVIAYTDDEVVSTDFLGNSYSSIFDAKAGIALNDTFVKLVSWYDNEWGYSNRVVDLIAHMATVDKF

SEQ ID NO: 66564 - protein, 408 aa, Xanthomonas oryzae pv. oryzae KACC10331
MSTAADSPLSLAHYYLPVYRPRQVVLERGQGSRVWDDQGREYLDLSSGIAVSGLGHNDPDLMAALTEQAAKLWHTSNVFFSAPPLKLAEELVTASRFALKVFLCNSGTEANEAAIKLVRKWASSHGRPADKRVIVTFGGSFHGRTLASVTATAQPKYQEGYEPLPGGFRHVDFNDVTALEAAMASGDVAAVMVEPIQGEGGVMPAAPGFLSRVRALCDQHDALLVLDEIQCGMGRTGTLFAHWQDQVTPDIVTLAKALGGGFPIGAMLAGPKVAETMQFGAHGTTFGGNPLAAAVARVALRKLASPQIADNVARQSAALRAGLEALNADFDLFAQIRGRGLMLGAVLAPAHAGQAGAILDLAAKHGLLLLQAGPDVLRFVPALNLTDAELADGLACLRLALAEYVAQS

SEQ ID NO: 66565 - protein, 339 aa, Pyrenomonas salina
MSIPIGINGFGRIGRLVTRAAFTNEGANCKVVAVNDPFIDLDYMVYMFKYDSTHGIWKGQVEKKGDKLVINGTEVTCFTERDPTAIKWGDAGAKYVVESTGVFTTIEKASAHVAGGAKKVVISAPSADAPMFVMGVNNKTYDGTPQIVSNASCTTNCLAPLAKVIDTNFGIVEGLMSTIHAITATQKTVDGPSGKDWRGGRGAAQNIIPASTGAAKAVGKVLPQLNGKLTGMSFRVPTPDVSVVDLTCKLAKPASYQAICDAVKKAESDPEYCGVIQYCDEEVVSTDFQGNSKSSIFDAKAGIALNETFVKLVSWYDNEWGYSNRVVDLIAHMQTVDKL

SEQ ID NO: 66566 - protein, 470 aa, Medicago truncatula
MERKQGFFSSLKDEVVRGLSPARSRAKSPARSASPMSGLLRRRRKNQGVPPELFMTRSGSLRPLEALSPLKEGPDGTDGEDVGNREGKWGHWMKGQLARAPSVSSSSSACKKSDLRLLLGVLGAPLAPVHVCTTDPFPHLSIKDIPIETSSAQYILQQYIASSGGLKIQNSINNAYAMGKVRMIASEFETANKVTRNRNSSKAAESGGFVLWQMNPDMWYVELALGGSKVHAGCNGKLVWRHTPWLGAHAAKGPVRPLRRALQGLDPRTTASMFINARCIGEKKINEEDCFILKLCADPSTLKARSEGPAEIIRHVLFGYFSQKTGLLVHLEDSHLTRIQNNGGDAVYWETTINSFLDDYRPVEGIMIAHSGRSVVTLFRFGETALSHTKTRMEEAWTIEEVAFNVPGLSIDCFIPPSELRFASISEASELPHGQRVKSAAAAAAYQAKVAQFQKSHESNTNNINWTVDV

SEQ ID NO: 66567 - protein, 188 aa, Brassica napus
  misc_feature (3)..(3): Xaa can be any naturally occurring amino acid
  misc_feature (17)..(17): Xaa can be any naturally occurring amino acid
  misc_feature (19)..(19): Xaa can be any naturally occurring amino acid
  misc_feature (21)..(21): Xaa can be any naturally occurring amino acid
  misc_feature (28)..(28): Xaa can be any naturally occurring amino acid
  misc_feature (32)..(33): Xaa can be any naturally occurring amino acid
  misc_feature (36)..(36): Xaa can be any naturally occurring amino acid
  misc_feature (43)..(43): Xaa can be any naturally occurring amino acid
  misc_feature (67)..(67): Xaa can be any naturally occurring amino acid
  misc_feature (76)..(76): Xaa can be any naturally occurring amino acid
  misc_feature (81)..(81): Xaa can be any naturally occurring amino acid
  misc_feature (86)..(87): Xaa can be any naturally occurring amino acid
  misc_feature (90)..(90): Xaa can be any naturally occurring amino acid
  misc_feature (103)..(103): Xaa can be any naturally occurring amino acid
  misc_feature (122)..(122): Xaa can be any naturally occurring amino acid
  misc_feature (131)..(131): Xaa can be any naturally occurring amino acid
  misc_feature (133)..(133): Xaa can be any naturally occurring amino acid
  misc_feature (137)..(138): Xaa can be any naturally occurring amino acid
  misc_feature (144)..(144): Xaa can be any naturally occurring amino acid
  misc_feature (146)..(146): Xaa can be any naturally occurring amino acid
  misc_feature (148)..(148): Xaa can be any naturally occurring amino acid
  misc_feature (150)..(150): Xaa can be any naturally occurring amino acid
  misc_feature (152)..(152): Xaa can be any naturally occurring amino acid
  misc_feature (165)..(165): Xaa can be any naturally occurring amino acid
  misc_feature (169)..(171): Xaa can be any naturally occurring amino acid
  misc_feature (175)..(175): Xaa can be any naturally occurring amino acid
  misc_feature (177)..(178): Xaa can be any naturally occurring amino acid
  misc_feature (180)..(180): Xaa can be any naturally occurring amino acid
  misc_feature (182)..(183): Xaa can be any naturally occurring amino acid
MSXFTSKFADELIANAXYXGXPGKGILXADEXXGTXGKRLASXNVENVESNRRALRELLFTAPGALXCLSGGILFXETLYXKSSDXXLFXDILKEGGVLPGIXVDKGTVELAGTNGETTTQXLDGLGERCXKXYEAXXRFGKWXAXLXIXEXEPSELSIHENAYXLVRXXXICQXKXXLXPXXNPPPP

SEQ ID NO: 66568 - protein, 875 aa, Zea mays
MGSAAAADVVIPACAAVGIAFALWQWFLVSRVKMSAYAAPGNGGHHGGPVFRMEDDEEDVGMGGAGDRDEEEEETAGDGTVAVARCAEIQSAISVGANSFLFTQYKYLAAFTVVFAVVIFLFLGSVHRFSTDSRPCQYTSGRTCKPALANAVFSSVAFLLGAATSVVSGYLGMRIATYANGRTTLEARRGVGAAFATAFRSGAVMGFLLASLGLLVLYITIKVFGLYYGDDWESLYESITGYGLGGSSMALFGRVGGGIYTKAADVGADLVGKVERNIPEDDPRNPAVIADNVGDNVGDIAGMGSDLFGSYAESTCAALFVASISSFGADHNFAALIISTVLMTVAALVVSLAALPAKFTMFDFGEAKQVKNWHLFLCVAIGLWAGLAIGFTTEYFTSNAYRTGAATNVIFGLALGYKSVIVPVFAIAVSIYVGFTLASIYGIAVAALGMLSTVATGLAIDAYGPISDNAGGIAEMAGMSRRIRQRTDALDAAGNTTAAIGKGFAIGSAALVSLALFGAFVSRAGVEDVNVLNPKSVGSAALKMVEEVRRQFITIPGLMEGRAAPDYARCVRISTDASLKEMMPPGALVLLAPLVAGTFFGVSTLAGLLAGALVSGVQIAISASNSGGAWDNAKKYIEERRTGTLQADVSVHCAVDLRLLHRVWAKGCLRGASASLHGMTSRFPAVFIEIRAPAWSRRKSSRGTTTVRRSGRMRDSRVVGGRGRAQARRRICLRAKLVVGRGGEITRSLDPGSGEAEGLRPRAEPCFARGGEIAPEGQSALLVVLGVSSEGGRQRDNSDNPNYYPTLRLACASDHAKSLGPKGSDAHKAAVIGDTIGDPLKDTSGPSLNILIKLMAVESLVFAPFFAAHGGLIFK

SEQ ID NO: 66569 - protein, 475 aa, Glycine max
MTVFLATRLVLRRSPPLLWRRSFSRAAVEAEKDTVAVPSLPLFDYSPPPYAGPTADEILAKRREYLSPSILHFYKNPVNIVEGKKQYLFDEKGRRYVDAFGGIATVCCGHCHPDVVEAIVNQTKKLQHSTVLYLNNAIADFAQALTSKLPGNLKVVFFTNSGTEANELAILIARLYTGCHDIISLRNAYHGNAAGTMGATAQSIWKFNVVQSGVHHAVNPDPYRGIFGSDGEKYARDVQDIINFGTSGNVAAFISEAIQGVGGIIELAPGYLPAVYNTIKKAGGLFIADEVQAGFGRTGSHFWGFEAHNVVPDIVTMAKGIGNGIPLGAVVTTPEIAEVLTRRSYFNTFGGNPVCTAAGLAVLKVIEKEQLQQNAFVVGSYLKERLTALKDKYELIGDVRGRGLMLGVELVTDRELKTPAKGETLHVMDQMKELGVLIGKGGYYGNVFRITPPLCFTKEDADFVADAMDLTLSRM

SEQ ID NO: 66570 - protein, 250 aa, Zea mays
  misc_feature (222)..(222): Xaa can be any naturally occurring amino acid
  misc_feature (231)..(231): Xaa can be any naturally occurring amino acid
MDQTTSVAACLTISIFFLTIKMIKRRTLHQEGPSLPPAVSVVSLSAYLPTFLSKGLSAVIQDLHTKMGSVFTISLFGLKKVTFLVGPEVTAHFFQGSESEIRQSDIYKVTVPVFGRGVLYDVDLATRSRQISFCLDSIKPMNLRGHVDSMVKEVEDYFTKWEQHGVVDIKHEMGNLILLIANRCLLGKQFRENMFEEVSTLAHDIFDNGFHLISLFFPYLPXPPHHRRDKXRAKLGEMIHEVVRSRRSSG

SEQ ID NO: 66571 - protein, 175 aa, Triticum aestivum
MAPAVMASSATSVAPFQGLKSTAGLPVSRRSSSAGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 66572 - protein, 149 aa, Glycine max
MSTYRDEDPRLHDIKTKIRVVPNFPKPGIEARGFIFGSPIALAIGAKFVPLRKPKKLPGKVISQEYILEYGRDCLEMHVGAVEPGERALVVDDLIATGGTLCAAMDLLERVGAEVVECGCVIELPELKGRERLNGKALYVLVECFECCQ

SEQ ID NO: 66573 - protein, 591 aa, Chlamydomonas reinhardtii
MRTRLYLNRWLTFVASCLMQASAGLSYSFSIYAPVLKEIWGYHETQIATVGSCFNIGGYLAIPSGALYDRLEKHKRFGPRFVAVMGSLTLALGYLGLYAAASGLLQPHFALVCLFAVLGGNSSTWFDTACVVTNVRNFPRDRGTVVGILKAFVGLSASIYSAIYAADFMSGSGASPPPPASPPFSPPPSSDHHVPPASALRSLLSFAAHLPPAARPAASRFTTQARFTFTYCLVVVVAVYQTVAALLEGPAAHATPIERQELLAGLLGLLGVLLLVPLASGDCVHRKPRPDAVERVRRNLLMRLARRALSTAAASAASAASAASFGIRGWSISRRESAATSTTPDTAATVALTEPTGPQGGTGGVGVRDQDLEAALERLESVPALPDLTLGQAARTPMFWLLMFQFSVGLGTGLAYLNNLGSIVVALGGKQGGQVVFVSLFSVANATGRLMGGVLSEHVLRRYGTPRTLVLLAVSCLSLLAVGGAAASDLGDLYAVSLVAGLAFGAHWGVIPAVTSDLFGLTHFGSNYTGLQLYDRAARQHGDSLFCQGADCYFATWCVLGGLNLLSLLGTRELYALTVRQYRRMVRAGGV

SEQ ID NO: 66574 - protein, 103 aa, Nostoc sp. PCC 7120
MSVYVGNLSYDVTEDSLNAVFAEYGSVKRVQLPTDRETGRMRGFGFVEMGSDAEETAAIEALDGAEWMGRDLKVNKAKPKEDRGSFGGGNRGGYGGGGGRNRY

SEQ ID NO: 66575 - protein, 313 aa, Triticum aestivum
  misc_feature (221)..(221): Xaa can be any naturally occurring amino acid
MATAFDSPTSSPAAAPFHDDPFLSFADSPAPAAADVHVSGGADDSSFPASPDPYAFRHDSAAAHPFGMPDSNGNGMHHDAEDDGLFTDSGPVLPDPAQMGADEGFLLREWRRQNALLLEEKEKHEKELRSQIILEAEEFKKGFVEKRKLNLETSKDHNREREKLFLSNQEKFHKGADKQYWKAISELIPQEIAHIEKRTGKKDKDKKPGIIVVQGPKPGEXTDMARMRQILSKLKHTPPPHMKPPPPPAAAPAGKDGTPAAAGKDGAKAVATPAAKDAPANGTVPEKENAAPAAAAAPAAAAPAPPAEPIAAA

SEQ ID NO: 66576 - protein, 509 aa, Arabidopsis thaliana
MSSTKTIMETIYLILSLFFFFIFLSLKLLFGPRPRKLNLPPSPSRPFPIIGHLHLLKLPLHRRFLSLSESLNNAKIFSLSLGSRLVFVVSSHAVAEECFTKNDVVLANRPEFLVGKHIGYNSTTMVGAAYGDSWRNLRRIGTIEIFSSLRLNSFVSIRQDEIRRLIICLAKNSQHGFVKVEMKPLFMCLTINNIIRMVAGKRFYGDGTENDNEAKHVRQLIAEVVVSGGAGNAADYFPILRYVTNYEKHVKKLAGRVDEFLQSLVNEKRVEKVKGNTMIDHLLSLQETQPDYYTDVIIKGIILVMILAGTDTSAGTLEWAMSNLLNHPEVLRKAKTEIDDQIGVDRLVEEQDIVKLPYLQHIVSETLRLYPVAPMLLPHLASEDCIVDGYDVPRGTIILVNAWAIHRDPKLWEEPEKFKPERFEKKGEDKKLMPFGIGRRSCPGSGLAQRLVTLALGSLVQCFEWERVEEKYLDMRESEKGTTMRKATSLQAMCKARPIVHKVLDASCP

SEQ ID NO: 66577 - protein, 429 aa, Pseudomonas stutzeri
DQAGKSPNAVRYHGGDEIILQGFHWNVVREAPNDWYNILRQQAATIAADGFSAIWMPVPWRDFSSWSDGSKSGGGEGYFWHDFNKNGRYGSDAQLRQAASALGGAGVKVLYDVVPNHMNRGYPDKEINLPAGQGFWRNDCADPGNYPNDCDDGDRFIGGDADLNTGHPQVYGMFRDEFTNLRSQYGAGGFRFDFVRGYAPERVNSWMTDSADNSFCVGQLWKGPSEYPNWDWRNTASWQQIIKDWSDRAKCPVFDFALKERMQNGSIADWKHGLNGNPDPRWREVAVTFVDNHDTGYSPGQNGGQHHWALQDGLIRQAYAYILTSPGTPVVYWDHMYDWGYGDFIRQLIQVRRAAGVRADSAISFHSGYSGLVATVSGSQQTLVVALNSDLGNPGQVASGSFSEAVNASNGQVRVWRSGTGSGGGEPGA

SEQ ID NO: 66578 - protein, 556 aa, Phytophthora erythroseptica
MINDTPAWKALAEHAAEIKSTHLRELLNDDARNAAMRTEQQGIYLDFSRQNATSKTLDSLFELAETAELKKKLQAIASGEHVNATEDRAVMHMALRAPKTEKIVVDGHDVVPDVHEVLDAIRAFTSNVRDGKFVGATGKQLKNVISIGIGGSHLGSEFVFESLRYEPVAKAAAEGRILRLLANVDPVDVARATSGLNPEETLVVVVSKTFTTAETMLNARTLRKWLVDDLTKKGSSEAGAVAKHMVAASSAVPLVQQFGIDRANIFGFWDWVGGRYSVTSAVGILPLALQYGFDITEKFLAGAHATDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLRAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66579 - protein, 340 aa, Physcomitrella patens subsp. patens
MGKGQIGINGFGRFGRLVARVSLERDDIELVAVNDPFVSTDYMAYMFKYDTVHGRMMKTDIYAEDEQTFSFDGKKVAVLGYKELSEIPWGEYGVDYVVECTGNYTTKDRAAEHLKGGAKKVIITGNSKDAPMFVMGVNECDYRSEYNVVAMASCTTNCLTPLIKVLDDRFGVVEGVMTTVHSLTATQKFLDGPPLKDWRGGCANIIASSTSATKVIGRLIPRMNGKISGMAFRVPTSDASLIDLAVKLDQLVSYEQVCEAIKEAADGPMRGILGYTEEDAASTDFIGDSRSSILDAKAGLSLGNGFFKLVTWFDNEWGYSHRVVDLIVHMASMQHSPFYF

SEQ ID NO: 66580 - protein, 418 aa, Bacillus clausii KSM-K16
MATKMTMPQLGESVTEGTISRWLVGPGDTVQKYEPIAEVLTDKVSAEIPSSYTGTIEQLLVDENETVAVGVDICTIVEEASSEAEESNKEIKTEQKPNPPAKEQTKAEPSQKSRYSPAVVRLAQEHGLDLTTISGSGRGGRITRKDVEAYIAGNHTPEPQQPPAQAKQQEPVRSTPSQAIAAHDQEIPVTGVRKAIAENMVKSKMEVPHAWTMVEVDVTNLVKLRDKKKAAFKEQEGISLTYFPFFMKACVEALKEFPEINAQWNGTTIVRKKDINLSLAVATEDALYVPVIHQADELTIKGLAKKADELAKKARTGKLTGADMQGGTFTLNNTGSFGSILSQPIINSPQAAILSVESIVKRPVVRETEEGDVIAIRHMVNLCLSLDHRVLDGLVCGRFLASMKRRLEQMNEDSTSIY

SEQ ID NO: 66581 - protein, 357 aa, Solibacter usitatus Ellin6076
MRTAIIGLPMTGKTSLFTILTGVAQETRIGSTAVRQGVAKVPDARLEALGRLFEPPKVTHATVEYVDMPSISKETLRDAGAMASMRNVDAFAHVLRLFASDTIPHEKGSVDPVRDMEDLETELILSDFAVVEKRLERLEKDRKKIKNPELDREYELLVKCTTLIENNQPLRQLELDIEDEKRIRGFQFLSQKPMLYVLNLGEEDASRLHEREEEYRNGPLAGRARTAVAAVCGKIEAELAELPREEQREYLASYGLSESGLERLISATYSLLGLMSFLTAGEDECRAWTIPMHSNAVKAAGAIHSDFEKKFIRAEVVNWQTLIDLGGYSGARDKGQLRLEGKEYIVKDGDVLVIRHS

SEQ ID NO: 66582 - protein, 440 aa, Bradyrhizobium sp. BTAi1
MKALAEQISDIDAVNTYGRVVGVKGLMVEIAGPIHAMSVGARIVIETGNNVIPAEVIGFSGKNAVVMPFAGLEGVRRGCRAVIANAANQVRPSPAWLGRVINAMGEPIDGKGPLPQGAAPVPYRNNPPPAHSRKRVGSPLDLGVRALNTFLTCCRGQRLGIFAGSGVGKSVLLSMLARNVDAAVSVIGLIGERGREVQEFLQDDLGEEGLARSVVVVATSDEPALMRRQAAYLTLAISEYFRDEGKDVLCLMDSVTRFAMAQREIGLSAGEPPTAKGYTPTVFTELPKLLERAGPGSGEGTITGIFTVLVDGDDHNEPVADAVRGILDGHVVMQRSIAERGRYPAINILKSVSRTMPKSADPVFLPTIMRARQVMATYADMEELIRLGAYRAGSSPEVDEAIRLHEPLEAFLRQRKDEVCGLAQGYRELEQILGRLETES

SEQ ID NO: 66583 - protein, 556 aa, Phytophthora erythroseptica
MINDTPAWKALAERAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVREVLDAIRAFTSNVRDGKFVGATGKQLKNVISIGIGGSHLGSEFVFESLRYEPVAKAAAEGRILRLLANVDPVDVARATSGLNPEETLVVVVSKTFTTAETMLNARTLRKWLVDDLTKKGSSEAGAVAKHMVAASSAVPLVQQFGIDRANTFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66584 - protein, 398 aa, Pneumocystis carinii
MQSEAYQTNLQCSGETSHKLGIKEAKSTSKTSLIDQIPILTLSIPSRRSIPHIFDATRITDNSDNSHNENQDFKGILEENGSPDPFSYNRSYFTKIMLDEVWQRSAHSDEIIELEKLGEGISGSVSKCILKNTGTLFALKTILVDTNPEIQQQILRELSINRTCSSEYIVQYYGTFVDEASSNISMAMEYCAGGSLDRLYKKVRANGARIGEYPILKIAENALKGLNYLHTRKIIHRDIKPSNILMTLEGQAKLCDFGVSGELVSSMAKTFTGTSYYMAPERIKGETYSITSDIWSLGLTLMEISQNRFPFPPEGPPLVPIELLNYIVNISNFELVDEPDNKIKWSEDFKHFLKTCLERDGAKRPNSQRMLEHPWVMKHSIIKIDMAKWIKQILELPL

SEQ ID NO: 66585 - protein, 257 aa, Streptomyces virginiae
MTDRQGLLTDRIALITGASSGIGAAQRGLFAREGAAVVVTARREERLAGLVDELRAQGARAAYVVADVTRSEDAVRAVEFTVERFGRLDAAFNKRRHGAGRTPLHLMDDPVYDDIMDTNVRGVFNCLRPEIAAMLASGAGGSIVNTSSTGGLVATPVAAPYVVSKHAVLGLTKGPAAEYGAHGIRVNAIAPGTTRSEMVADWFAQNPDAEELLHRATPQPRTAEPQEIAEAAAWLCSERASFVTGSTLVVDGGFTIL

SEQ ID NO: 66586 - protein, 556 aa, Phytophthora erythroseptica
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETPVVVVSKTFTTAETMLNARTLRKWLVDGLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSSYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66587 - protein, 46 aa, Sorghum bicolor
NRIRHIPVIDGTGMLGMVSIGDVVRAVVAEHREELNRLNDYIQGGY

SEQ ID NO: 66588 - protein, 473 aa, Bacillus clausii KSM-K16
MAENYDLVIVGGGIGGYVSAIRAAQEGLKTALVEQALLGGTCLHKGCIPSKALLRSAEVLRTAKEASVFGVATGPVAFDFAGAQKRKQEIVDRLAQGVKALMSKGKIDVYEGRGRMLGPSIFSPSPGTISVDLANGDNQMLIGKNVILATGSVPRPLPHTPFDGKQILSSDDVLQLKELPASMVIVGGGVIGIEWASMLVDFGVSVTVVEASETILPTADQAVAAEMEKQLKARGVVFYTNAQLDEQTVATTSSGIKATVHQNQEEHTIEADKMLVAIGRVANVSDIGIDNTDIALAHGCIAVNEYGQTKESHIYAVGDCVGGLQLAHVAAHEGIAAVSHIIGKQVEPVDPLAVPSCVYSFPEAAQVGMTETQAREAGHAVKIGTFPFAMNGKALIHGEAGGFVKLIADKDTSDLLGVHIIGTHATDLISEAALAKFLDAADFELAETVHPHPTLAEAIGEAALAVDGYAIHK

SEQ ID NO: 66589 - protein, 91 aa, Medicago truncatula
MKPAFAAMLLVCLILSSFMFEMSIAGTDSGRFCSSKCGQRCSKAGMKDRCMKFCGICCGKCKCVPSGTYGNKHECPCYRDMKNSKGKPKCP

SEQ ID NO: 66590 - protein, 582 aa, Physcomitrella patens subsp. patens
MGVVDAEKLESRKSLPCGMSDETLACVLNHIESPQDRAAVSMVCQQWRRVDGMTRKFVTIANMYATSPASLTRRFKGLEGIKLKGKPRAAEYNLVRSDWGGYGEPWLKVLGRQYADLHILQLRRLTVLDSDLELIASSTFSSALHVLHLHKCVGFTTKGLLPVVRACRSLRRLSLEDSEVEDKGGEWLHALALNDSTLEELHFGVLGIEAIDIEDLTILVEKSKSLVCLKVAEIELLDMIDVLQRVPSLEDLGAGSCNYLGAKDVDDFVSIPWPKKLNALSGMWSLMDSGLPQILPIAPNLIKLDLKYTLLSCEGHCLLLSHCFSLQELQTRNTLGDDGMETLSRSCKGLKKLRVEDDETGAITQRGIVAVAQGCEQLVQLILYVANISNAALAMVGQGCPHLVDVRIVLEPSARYAPDFPLDDGLKLMLKGCVNLRRLAVYLRYGGLTDKGMEYIGVYGKNLQWLLVGCAGNSDVGLANFAHWAQRIQRLEIRDCPFGETGMAEAVSAMSSLKYLWVQGSRALEAGEKLSALSLPCLNVEVCPPPAGQPGGQLFAYYSLAGPRKDGPTGLKTFISNTVKDQ

SEQ ID NO: 66591 - protein, 318 aa, Arabidopsis thaliana
MVTGKRYYGDEVHNEEEANVFKKLVADINDCSGARHPGDYLPFMKMFGGSFEKKVKALAEAMDEILQRLLEECKRDKDGNTMVNHLLSLQQNEPEYYTDVTIKGLMLGMMIAGTDTSAVTLEWAMSSLLNHPEALEKAKLEIDEKIGQERLIDEPDIANLPYLQNIVSETFRLYPAAPLLVPRSPTEDIKVGGYDVPRGTMVMVNAWAIHRDPELWNEPEKFKPERFNGGEGGGRGEDVHKLMPFGNGRRSCPGAGLGQKIVTLALGSLIQCFDWQKVNGEAIDMTETPGMAMRKKIPLSALCQSRPIMSKLQAHLKG

SEQ ID NO: 66592 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDDLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAHLSASRTENAPVKGFNSATTSMLEAYLAHKA

SEQ ID NO: 66593 - protein, 396 aa, Medicago truncatula
MEPKSVNPTRRPQREAKKKAVAALCEQQRKRKRVPLGEITNDVNTNANANANDVVLPTQKKRNVSTSSNSDGTPVPEKLEKFEDPQLCETYVSDIYDYLRNMEVDSSKRPLCDYIQKVQRDVNASMRGVLVDWLVEVAEEYKLVSDTLYFSVSYIDRFLSLNDLTRQKLQLLGVASMLVASKYEEIKPPEVEDFCYITDNTYSKEEVLTMEADILKSLKFELGGPTIKTFLRHVCFIDYVSLYVEWYYCFCIVAHISFSFSVCRRFITKVGLEGVDASELQFEFLCSYLAELSLLDYNCVKFLPSMVAASVVFLARFMLSPKTHPWNSAIYEFTRYKPADLKECVLNIHDLYLGRKGGSLQAVRDKYKQHKFKCVATTPSPPEISLSFFEFRGADP

SEQ ID NO: 66594 - protein, 773 aa, Cryptococcus neoformans var. neoformans B-3501A
MSASASGSSWTEPTKAQAPPKDADLKQAWAFLSVGVDHIMTRLSFGMSYSYYILLYTAIYNYCTQPGKTGLPSFSPQRGGASLQGADLHRSLHNWLSAHCKSMREEAEKLPDQELLKYYARQWDRYTRGALYVNKLFNYLNKHWVKREKDEGRKDVYQVYTLALVSWKNNFFDHFTDNKGTSRLTQALLRQIQQQRNGEEVDSGLLKKVIDISLGLDEADAQRQNLDTYRKHFQTQFLEATDTYYRAESSAFVGSNSVADYMKKAEARLQEEADRVNLYLHDNTRNDLKTRCEKVLIEEHQAIMWDEFQTLLDSDRVDDLARMYGLLSRVLNGLDPLREKFGQHVRRAGRAAVEKVLPAPGAVNEAGKAESLDPKAYVEALLEVHGKYTSMVEGPFRGEMGFNRALDQACGDFCNSNAACTVSTKSPELLASYCDLLLRKSNKDSDAESLEASLSKAMIIFNFIDDKDVFHKFYQKKLAQRLVGSLSASDDAESSMITKLKELSGFEYTNKLSKMFTDVNLSKDLMERFNEREREKGIASDIDFQPLVLGSNSWPLHPQQTDFAIPREIQALYDRFNAFHGEVHQGRTLNWLWHISKNELRTTYLNQKYILMTSAYQMAILTQFNVSDTLSYKDIEAGTKLSPTVLKPQLGLLVKLKILLNTNEEYSLNTGFKSKKIRVNLNQTIKSEARAEQKEVIAAVDEDRKFVYQATIVRLMKGRKTMQHQALIQEVTAQISSKFTPKIPEIKKAIEYLIDKEYLERAPDSNNTYNYLA

SEQ ID NO: 66595 - protein, 492 aa, Oryza sativa Japonica Group
MYAYVGLVGGAAALVLLLLLRHQARRWRNPRCGGQLPPGSMGLPLVGETFQFFSSDASLDIPPFIRHRLASLGCKFRYGPIFKTSLVGHPVVVSADEELNHMVFQQEGQLFQSWYPDSFVEILGKDNVGEQQGAMFRYLKNMVLRYFGPESLKEGIIRDVERAVSSSLCTWSTLPAVELKEAVSTMVFDLAASKLLGLEPSRSKILRKSFFDFVRGLISFPLYLPGTAYYSCMQGRRRAMVVLEQVLEERKQSTGLQRGGEAQQHGDFLDYVIQEITKEKPVMTEKMALDLMFVLLFASFHTTSLALTLAVKLLADHPLVLEELTVEHETILKDREAGSELDRITWKEYKSMAFTSQVINETVRLANIAPVIFRKALKDIRFNGYTIPAGWGVMVCPPAVHLNPYIYPDPLTFIPSRFKDKPEINRGSKHFMAFGGGLRFCVGADFSKLQLAIFLHFLVTKYRWIPLGASRVVRTPGLEFPDGYRIKVIQRH

SEQ ID NO: 66596 - protein, 338 aa, Alkalilimnicola ehrlichei MLHE-1
MTVCDGFAGAVGNTPLIRLKRLSEETGCEILGKAEFMNPGGSVKDRAALYILLDAERRGLLRPGGTVVEGTAGNTGIGLAHLCNARGYRCVIVIPETQTQEKIDLLRTLGAAVHTVPARPYKDPNNYQKVAGRMAEEMDNAIWANQFDNTANRQAHYETTGPEIWSQTGGRLDGFVAATGTGGTLAGVARYLKAQSPDVRCVLADPHGSALYGYVKTGTPEVTGSGSITEGIGSTRVTANLEGTPIDDAYSIPDQEAVDRVYQALYQEGLFLGSSSGINLAAAVRLARELGPGHTIATILCDGGARYYSRLFNPEWLREKGLTPETNRETGRDDPEAP

SEQ ID NO: 66597 - protein, 303 aa, Oryza sativa Japonica Group
MEKYEKLEKVGEGTYGKVYKAQDRATGQLVALKKTRLEMDEEGIPPTALREISILRLLSQSLYVVRLLSVEQATKNGKPVLYLVFEFLDTDLKKFVDAYRKGPNPRPLPTNVIKSFLYQLCKGVAHCHGHGVLHRDLKPQNLLVDKEKGILKIADLGLGRAFTVPMKSYTHEIVTLWYRAPEVLLGSTHYSTGVDIWSVGCIFAEMVRRQALFPGDSELQQLLHIFRLLGTPTEEQWPGVTDLRDWHEFPQWKPQILERQVPSLEPEGVDLLSKMLQYNPANRISAKAAMEHPYFDSLDKSQF

SEQ ID NO: 66598 - protein, 393 aa, Vitis vinifera
METGVTCYARGAFLHTSVSSQHSTALVSPPSISPSFSSKSLRSSSLFGESLRVVPRSSLKVSRTKNSSLVTRCEVGDSLEEFLTKATPDKGLIRLMMCMGEALRTIAFKVRTASCGGTACVNSFGDEQLAVDMVANQLLFEALNYSHFCKHACSEEVPDLQDMGGPVEGGFSVAFDPLDGSSIVDTNFTVGTIFGVWPGDKLTGVTGRDQVAAAMGIYGPRTTYVLALKDIPGTHEFLLLDEGKWQHVKDTTEIGEGKLFSPGNLRATFDNPDYDKLINYYVREKYTLRYTGGMVPDVNQIIVKEKGIFTNVTSPSSKAKLRLLFEVAPLGFLIEKAGGFSSDGTQSVLDKVINNLDERTQVAYGSKNEIIRFEETLYGSSRLKAGVPVGAAV

SEQ ID NO: 66599 - protein, 476 aa, Solibacter usitatus Ellin6076
MPNQLQDFLTLSYAELEELNLQAKAERLGRAPTHQIQEQRLKYLTDEKRIKAVTVLFSDLEGRLHMLDYDKKFLVKSWDNLTFDGSSIRGFTAQRESDLRLSMDWSSFYWAPSDVFGAGKVLVFGEVIDKDGTPYSADIRGVLKAYAQSLYEKQGYTLNAANEIEGFLFNGSDAERRYHETAKFDYVNTGGYYHSLPGDPLRTFIDSCAEVQRAMGFQNEKDHPEVAPSQFEINYSYAEVVAAADQIQLYKLICRQVATRMGLTASFLPKPVVGVNGSGMHTNVSITKGGKNIFWDPKGEEKMSKFAWQFVDRILTHGNDLCLLLNASVNAYRRLDPHFEAPNQIKASAVDRGSMIRIPIGNERSSRVEVRSVGPDANPYMVMLGVFRTGLEGEISRIKNLRGAERYLPDNIYDAMANFKNAEWTTKLLGEDVKGRYADLKQASADRCPRLLGTFVKTPEVQYHHEVYNQFLWNMF

SEQ ID NO: 66600 - protein, 198 aa, Luziola leiocarpa
GQTPVFPRILGHEAGGIVESVGEGVTELVPGDHVLPVFTGECKECAHCKSEESNMCDLLRINVDRGVMIGDGQSRFTINGKPIFHFVGTSTFSEYTVIHEGCLAKVNPEAPLDKVCVLSCGISTGLGATLNVAKPKKGSTVAIFGLGAVGLAAMEGARLSGASRIIGVDLNPAKYEQAKKFGCTDFVNPKDHKKPVQE

SEQ ID NO: 66601 - protein, 321 aa, Propionibacterium acnes KPA171202
MSTSTRSLPVLLDCDPGIDDAFALAYVACRDDVETVGVVTTAGNVGQDDVLRNALGVTDLLGMGVPVARGADVPLVEPLMTAEETHGPHGLGHAVLGECGRHPDSRSGAQLWVDLARQYPGKLVGIVTGPLTNLALALREEPELPRLLRGLHVMGGAINYRGNTGPTSEWNIAVDPEAAHEVFEAWGKASQRVVLGALQATEAVRLDEKHRQAVAQLKDHPVGAVLADALQFYFEFHQADGLGWCAYLHDPLVVANAVTGQFAKTRPLAVDVELTGTLTRGQTVGDELGRWGKEPNVDLLCDVDAEGFIEHLLTTLRTGLG

SEQ ID NO: 66602 - protein, 111 aa, Triticum aestivum
  misc_feature (76)..(76): Xaa can be any naturally occurring amino acid
MDANRRQSGIQQLLAAEQEAQQIVNAARAAKSARLKQAKEEAEREIAEYRAQMEAEFQRKVAESSGDSGANVKRLXGKETAAKIEQLTQQAASISPDVIQMLLRHVTTVKN

SEQ ID NO: 66603 - protein, 372 aa, Solibacter usitatus Ellin6076
MPIVSVPDAIQEIRAGRIIVVVDDEDRENEGDLTIAAEKVTPEIINFMAVQGRGLICLALTAERCDYLRLPLMSPTNTSMFGTAFTESIDALHGVTTGISAADRTRTILQAIDPDCRPSDLARPGHMFPLRAREGGVLVRAGQTEASVDLARLAGLTPAGVICEIMNDDGTMARVPQLIEFCKRHDMKMLSVAELIRYRMKNEKFIRRVAEGIIPTEFGDFRTIAYASDLNPEYHLALVRGDVSGKESVLVRMHSRCVFGDVFRSSQCECGQLVQNSLRAIAKEGQGVLVYLHETGPGFRVDSGQLVSHGRDFMHLKGEDGQRQLQHEHGLGAQILSDLGLHTIRLLTNHPRKIVALEGFGIEVEAQIPVGH

SEQ ID NO: 66604 - protein, 750 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCEGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 66605 - protein, 236 aa, Glycine max
  misc_feature (104)..(104): Xaa can be any naturally occurring amino acid
  misc_feature (167)..(167): Xaa can be any naturally occurring amino acid
LCRYCVVFDPLDGSSNIDCGVSIGTIFGIYLIKEDHEPTVEDVLQPGKNMLAAGYCMYGSSCTLVLSTGSGVNGFTLDPSLGEFILTHPDIKIPKKGKIYSATXAPPPNEGNAKNWDRPTATYVEKCKFPEDGSSPKSLRYIGSMVADVHRTLLYGGIFLYPADKKXPNGKLRVLYEVFPMSFLMEQAGGQSFTGKERALDLVPTKLHERSPIFLGSYDDVEEIKALYAAAEGEQE

SEQ ID NO: 66606 - protein, 465 aa, Glycine max
MAVSEGSPTPQTVGNAFVEQYYSILHQKPDQVHRFYHESSILSRPEEDGTMTMVTTTLEINKKILSLDYTSFRVEILSADAQPSFKDGVIVVVTGCLTGSDNLKRKFTQSFFLAPQDKGYFVLNDVFRYVDEYKSVDIESVPANDAATADESAPTDAFVPEPEVIHVAEDVPPSQTAVVDADISVSKEVSQPLENGNVSVTEKVVPVNHVKESSHQEHSHYHAEKAASNNALEDTPKKSFASIGNALKENAAPFHVRVSPVKLVEQPRVSSIPAPEAPAPSIESPPEKNNENGGKAYAIFVANLPMNATVEQLERAFKKFGPIKQDGIQVRSNKQQQSCFGFVEFESATSMQSALEASPPVTLDGRRLSIEERRANNDRGRYSSGRGGYRNDRNDNFRGRGNFSGGRGGGGYGNRNDSFEKRSEFSGRPRGGNNNGGGRSNGEAVPRSYQNGGGAKVTRQSVKVQ

SEQ ID NO: 66607 - protein, 285 aa, Arabidopsis thaliana
MEGKEEDVRVGANKFPERQPIGTSAQSDDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRTIPFKSRS

SEQ ID NO: 66608 - protein, 749 aa, Chlamydomonas reinhardtii
MAGVPAPASQLTKVLAGLRHTFVVADATLPDCPLVYASEGFYAMTGYGPDEVLGHNCRFLQGEGTDPKEVQKIRDAIKKGEACSVRLLNYRKDGTPFWNLLTVTPIKTPDGRVSKFVGVQVDVTSKTEGKALADNSGVPLLVKYDHRLRDNVARTIVDDVTIAVEKAEGVEPGQASAVAAAAPLGAKGPRGTAPKSFPRVALDLATTVERIQQNFCISDPTLPDCPIVFASDAFLELTGYSREEVLGRNCRFLQGAGTDRGTVDQIRAAIKEGSELTVRILNYTKAGKAFWNMFTLAPMRDQDGHARFFVGVQVDVTAQSTSPDKAPVWNKTPEEEVAKAKMGAEAASLISSALQGMAAPTTANPWAAISGVIMRRKPHKADDKAYQALLQLQERDGKMKLMHFRRVKQLGAGDVGLVDLVQLQGSELKFAMKTLDKFEMQERNKVARVLTESAILAAVDHPFLATLYCTIQTDTHLHFVMEYCDGGELYGLLNSQPKKRLKEEHVRFYASEVLTALQYLHLLGYVYRDLKPENILLHHTGHVLLTDFDLSYSKGSTTPRIEKIGGAGAAGGSAPKSPKKSSSKSGGSSSGSALQLENYLLLAEPSARANSFVGTEEYLAPEVINAAGHGPAVDWWSLGILIFELLYGTTPFRGARRDETFENIIKSPLKFPSKPAVSEECRDLIEKLLVKDVGARLGSRTGANEIKSHPWFKGINWALLRHQQPPYVPRRASKAAGGSSTGGAAFDNY

SEQ ID NO: 66609 - protein, 316 aa, Parvularcula bermudensis HTCC2503
MVGHQSSDRQDHLAEAAETIEAEALRLKGVVESRLADLIPAVGPPAEAARHSLLAPGKRIRAVLTLLAARECGGSLERALDTACAVEMIHTASLVIDDLPAMDDADLRRGRPTCHRAFGESTAILAAIGLLNGAYGVVMAAEPLSAAEKTKIASILSSAVGWRGLVQGQALDLNPGTTSLETIQDGKTGVLFEAAVLAGEQTAGWVSEKSVALAAFATALGRAYQALDDLLDLIDSVSALKSTGRDDGKRTALSEGGESEDTVSKAVETARHHLDEARAALPETSRLSAYLTLIEGHFQSVLSKASPAMTAAVSSL

SEQ ID NO: 66610 - protein, 66 aa, Brassica napus
  misc_feature (50)..(50): Xaa can be any naturally occurring amino acid
RPTGQKQRLQLIVKGVTTIIGGGDSVPAVKKVGVADKISHISTGAGASLXLKENKPLPAVLAVGDA

SEQ ID NO: 66611 - protein, 269 aa, Oryza sativa Japonica Group
MDRYQRVEKPREEAPIKENEIRITTQGRMRNYITYATTLLQDKGSDEVVFKAMGRAINKTVMIAELIKRRIVGLHQNTTTGSTDITDMWEPLEEGLLPLETTRHVSMITITLSKKELDTSSIGYQSPLPADKVKPLVEYENEEDAPSPAGRGRGRGGQGRGRGRGRGTRGNGYMDYADGGWEDDHAPPAYAGNGYTRGRGRGFRGRGRRGGGYGAQPDYQQDGGYYDEAPVHAPPRGRGRGRGRGRGPVRGRGRGGNVNGVMHATAVGA

SEQ ID NO: 66612 - protein, 1207 aa, Solanum pimpinellifolium
MKAHKTVFNQHPLSLNKLFFVLLLIFFLPPASPAASVNGLYKDSQQLLSFKAALPPTPTLLQNWLSSTDPCSFTGVSCKNSRVSSIDLSNTFLSVDFSLVTSYLLPLSNLESLVLKNANLSGSLTSAAKSQCGVTLDSVDLAENTISGPISDISSFGVCSNLKSLNLSKNFLDPPGKEMLNAATFSLQVLDLSYNNISGFNLFPWVSSMGFVELEFFSLKGNKLAGSIPELDFKNLSYLDLSANNFSTVFPSFKDCSNLQHLDLSSNKFYGDIGSSLSSCGKLSFLNLTNNQFVGLVPKLPSESLQYLYLRGNDFQGVYPNQLADLCKTVVELDLSYNNFSGMVPESLGECSSLELVDISYNNFSGKLPVDTLSKLSNIKTMVLSFNKFVGGLPDSFSNLLKLETLDMSSNNLTGVIPSGICKDPMNNLKVLYLQNNLFKGPIPDSLSNCSQLVSLDLSFNYLTGSIPSSLGSLSKLKDLILWLNQLSGEIPQELMYLQALENLILDFNDLTGPIPASLSNCTKLNWISLSNNQLSGEIPASLGRLSNLAILKLGNNSISGNIPAELGNCQSLIWLDLNTNFLNGSIPPPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGAMYYLSILNLGHNDLSGMIPQQLGGLKNVAILDLSYNRFNGTIPNSLTSLTLLGEIDLSNNNLSGMIPESAPFDTFPDYRFANNSLCGYPLPIPCSSGPKSDANQHQKSHRRQASLAGSVAMGLLFSLFCIFGLIIVAIETKKRRRKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKIGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDASIEIELLQHLKVACACLDDRHWKRPTMIQVMAMFKEIQAGSGMDSTSTIGADDVNFSGVEGGIEMGINGSIKEGNELSKHL

SEQ ID NO: 66613 - protein, 396 aa, Oceanobacter sp. RED65
MNPNLKQLQPYPFEKLTALKAAAKINCDLPHIALSIGEPKHESPKFVLDTMAQNLGKLANYPTTKGLPELRQTISDWAKQRFSLSSLDIETQVLPVNGTREAIFSFTQAMVEGKDNALVVCPNPFYQIYEGATYLAGAEPHYLPCLEENSFLPDFDKVSEEIWQRTQILFICSPGNPTGAVHDQDTLKKLIRLADQHDFIIASDECYSEIYVESAKPPVGLLEVCAEMGRHDYQRCVVFHSLSKRSNLPGLRSGFIAGDATLLKPYFQYRTYHGCAMSIPNQLASISAWQDEKHVEENRCLYTEKFSAVLDILQPVMDVQQSDASFYLWAKTPINEEEFAQRLFAEHQVTVLPGSYLSRTVDGINPGQNRIRMALVAETHECVEAAKRIRNLIESL

SEQ ID NO: 66614 - protein, 346 aa, Candidatus Kuenenia stuttgartiensis
MRVAVYEKFAQPLTIQEVPDPAPEKTGVVIRVGATGMCRSDWHGWMGHDPCIRLPHVPGHEIAGVVEETGKEVSLWKKGDRVTLPFVCGCGACPQCASGNHQVCDRQSQPGFTHWGSFAQYVAIDYADVNLVQLPEDIDFVTAASLGCRFSTSFRAIVAQGKVSAGQWVAVHGCGGVGLSAIMIASALGANVVAVDIQKEKLDFAGSVGAVALVNAGEVEDVAGAILDITKGGVHVSVDALGSSNTCFNSIATLRKRGKHLQVGLMLAEHRHPPIPMDKVIANELEILGCHGMQAHEYGAMLEMVCEGKLRPEKLIGKTIGLEDAARELPDMNRFGSVGVIVINEF

SEQ ID NO: 66615 - protein, 129 aa, Triticum aestivum
  misc_feature (112)..(112): Xaa can be any naturally occurring amino acid
MHPTRWELSHMVDLQAAALVISVVAAEVADLSSKPFFAGLVEYIVSGPVVAMVWEGKSVVSTGRKIIGATNPLASEPGTIRGDFAVDIGRNVIHGSDSVESARKEIALWFPXEGIAEWRSSQHNWIYEA

SEQ ID NO: 66616 - protein, 556 aa, Phytophthora infestans
MINDTPAWKALAEHAAEIKSTHLRELLNDDARNAAMRTEQQGIYLDFSRQNATSKTLDLLFELAETAELKKKLQAIASGEHVNATEDRAVMHMALRAPKTEKIVVDGHDVVPDVHEVLDAIRAFTSNVRDGKLVGATGKQLKNVISIGIGGSYLGPEFVFESLRYEPVAKAAAEGRNLRFLANVDPVDVARATSGLNPEETLVVVVSKTFTTAETMLNARTLRKWLVDGLTKKGSSEADAVAKHMVAASSAVPLVQQFGIDRANIFGFWDWVGGRYSVTSAVGILPLALQYGFDITEKFLAGAHAMDKHLLETPLRNNLPVIMGLLGVWNSSFLGHSSRALLPYSQALLRFAAHIQQVDMESNGKRVTVEGVDLPFQAGEVNFGEPGTNGQHSFYQLIHQGRVVPCDFLGFCESQNPVQLAGEPVSNHDELMSNFFAQPDALARGKSIEDLKAEGVPEKLQNHKLFPGNRPSISLLFKKLDAFSTGQLLALYEHRTVVQGAIWGINSFDQWGVELGKVLAKQVRAQLSASRTENAPVKGFNSATTSMLEAYLAHKA

SEQ ID NO: 66617 - protein, 634 aa, Physcomitrella patens subsp. patens
MCSIPFGRKKSKKGDLAQDLLGDVFSTYSENGKLDAEGLLKFLQTEQGDSKSSLDDAKHLVELIRNERHKSKFPGFIVSSDLSKGDFKNYVLSPDLNGVLESTVHQDMTQPLSHYFIFTGHNSYLTGNQLSSDSSDVPIAAALQRGVRVVELDLWPDDKGGIKVTHGNTLTSPVAFEKCIKAIKANAFVSSKYPVVITLEDHLSSPLQALAAETLTNILGEDLYYPPSSDGFKELPSPESLKGKILISTKPPKEYLEAAVAQKSALKDEKILNELKKADKLQEQSTAPVKSPVEKKIAVPPSEKTKSISEEKDLSEKVGNLRVDSEGESADPAPASSPDGKKATLTADSESDDDDNKKNPEYARLITIHQSKPSKGTTVEDRLKVEGTVVRISLSETKLEKVTEEFPELVVKFTQRNILRVYPAGNRVNSSNYDPTAAWIHGAQMVAQNMQGYGKELWQAHGKFRGNGGCGYILKPKYLLEDLPNGKPFNPSAPGDTKMILKVKVMTTMGWDKAFPKYHFDLFSPPDFFTRLLVTGVPADVAKWKTSVIDDVWEPHWNEDHEFYLKCPELALLRIEVRDHDEESQDEFEGQACLPMHEIKDGYRCVQMYDKKGSVLKGVKMLFHFQKRSFSPVQ

SEQ ID NO: 66618 - protein, 550 aa, Zea mays
MITSCTLSGSRTGLISSLPLHSAARSIPIPIHRTGSAQSGSLMESLVAALPAGGAAAAAAFGGLVAAAALAGKVGLVGSKKHLNAPPAVSGLPLIGNLHQLKEKKPHQTFTKWAEIYGPIYTIRTGSSTVVVLNSAQVAKEAMIAKFSSISTRKLSKALSALTRDKTMVATSDYGDFHKMIKRYIMTFMLGTSGQKQFRDTRNMMVDNMLNTFHTLLMDDPNSPLNFREVFKNELFRLSLVQALGEDVSSIYVEEYGKVISKEEIYKATVVDMMMCAIEVDWRDFFPYLSWIPNRTFETRVLTTEARRTTVMQALIKQQKERIARGETRISYLDFLLAENTLTDEQLLMLVWEAVIEAADTTLVTTEWAMYEIAKHPEKQEYLYQEIQKVCGNKTVTEDHLPELPYLNAVFHETMRRHSPVPLVPPRLVHENTNLAGYEVPAGTEIIINLYGCNMNKNDWAEPEEWKPERFLDGRFEAVDMHKTMAFGAGRRACAGSMQAMNISCTAIGRFVQEFAWRLEEGDEDKVDTIQLTTNRLYPLHVYLAPRGRK

SEQ ID NO: 66619 - protein, 628 aa, Bacillus clausii KSM-K16
MNLEEIQDPSFLKNYSNKQLEELAADIRRFLIEKLSATGGHIGPNLGVVELTLALHQLFDSPKDKLLWDVGHQAYVHKILTGRAPQFDTLRQYKGLCGFPKRTESEHDVWETGHSSTSLSGAMGMATARDLKGTNENIVAIIGDGALTGGMALEALNHIGHEQKHLIVVLNDNEMSIAPNVGALHSILGRLRTAGKYQKAKEDLETIIRKIPAFGGKLADTAERLKDSLKYLMVSGMFFEEMGFTYLGPVDGHDLDDLKHQLSYAKKTSGPVLVHVLTKKGKGYKPAEEDATGAWHGTGPYKMESGEMVKKPGPPSYPSVFANTLKRIAREDERVVAITPAMPGGSKLDLFAEEFPDRMFDVGIAEQHAATMSAGLATQGMKPVYAVYSTFLQRGYDQVVHDICRQNLNVLIAIDRAGLVGADGETHQGVFDIAFLRSLPNITILNPKDENEFQHMLYTGICYDDGPIAIRYPRGNGTGVKMDASLSRLPIGKWNVLQEGTDAAILTFGTMIPVAEKALAQLKQAGYNIRLINANSVKPLDEKLLEALAEEELPLLTIEESVLQGGFGSAVLEFYNEKGMHVELKRMGIPDYFVEHGSVSELYQEVGLTPERIADTLISMLPQKRKRA

SEQ ID NO: 66620 - protein, 377 aa, uncultured archaeon GZfos26G2
MEDIFRFADELGPAKVIHVYEPSVGLKAVLVVDNVARGPAIGGLRIAPDVSAEECFRLARAMTLKNAAADLPHGGAKSVIYGDPKMPTKEKESLIRAFASSLREIQEYIFAPDMGTDEECMAWVKDEIGRVVGLPSDFGGIPLDEIGATGWGLSHATEVALEYCDFDMEGARVVVQGFGAVGKHTARFLTEKGAMLVGVADSRGTIYNPQGLDVLALIELKTAGKSVADYPDGKKLDRDAVINIECDVWIPAAQPDVIDENNVNLLKTKLVIEAANIPITEGAEKYLHENGVLYVPDFIANAGGVICAAMEYQGADQSAAFEAIEEKLCRNTRLVLEEAASRGILPREAAVDLAVQRLKKSMSYRRWSLFSSAPGFV

SEQ ID NO: 66621 - protein, 295 aa, Bacillus clausii KSM-K16
MSALFQTFLEEARQLVDKKLPEYVRELEAEHRLKEAMLYSLEAGGKRVRPVLLLAVLEAYNQPILHGLDTACAIEMVHTYSLVHDDLPAMDDDDLRRGQPTNHKVFGEATAILAGDALLTQSFALIANADAPLSAKTKVSIIAALSKAAGASGMVGGQLADMFAEGKQLTVEQLANVHKRKTGELLAFSIEAGALIAGVSNEERSKLNEFGQEIGLLFQIKDDILDVEGDSIAIGKPVGSDAVNNKSTYPGLLGLDGAKTMLHTHYDRALQVLDELHLRGTLLEDLAKYIVTRDH

SEQ ID NO: 66622 - protein, 107 aa, Physcomitrella patens subsp. patens
WSTGLFDCCADMPMCCFTMFFPCLAFGWNAQALDESKNSCWTAATAWWVLQHTIALGCLYSASYRGKLRSKYNIPEGPFSDSLIHCLCWPCAFCQEYRELHYRSFGP

SEQ ID NO: 66623 - protein, 440 aa, Medicago truncatula
MHPWLENIVNLCRNRKNDNLALFDEWPSLASSINLKNHCYGEFSSAFVQANEDMEDRSQVEVASRNALFLGVYDGHGGFEASQFISEHLFDDLLRLTNENENKITEATLRDAVSATEASFLDSVKRNYMINRNLGKVGSCCLAGIIWKGTLHVANLGDSRAVIGTMVNKRIRAEQLTRDHNCSDPAIREELKSMHPGDPTIVKEKNGVWRVKGIISVSRSIGDTYLKRLEFTLCESFPKFKKVPEPFTRGVVSAEPEMRTRVLTYSDKFLIFASDGLWDFLSNEQAVEIVQNNPRNGIAKRLVSTVLAKAAANGNVTCNSMMHANLGRGDGNRRSFHDDISVIVVFFDKTSFLRMPVHNLSYKSSSDRPTPSAFARSGLTTHWLQRLKKTIKDRFKGSSSNASGSQDQNPETPEGESSQTQSLLGQSSRAQSPWKNLKQN

SEQ ID NO: 66624 - protein, 429 aa, Coccidioides immitis RS
MTESTPLYHPESDVEDLEGYRPGGYHPTLIGDTFCDGRYTVVHKLGSGGYSTIWLARDQQLQHYVSLKILVAGASQDTHESEILQLLSKSNLNCPGKQFIPTLLHQFSFDGPNGHHQCLVGVPTGCSVASSKENSTNFMFPPDAARSLAAQLIMGLAYLHSNDVCHGDLHLHNFLLRAPSFNHLSTTELYEHHSKLYEVPVRRLDGKPTAPHAPPRATYPMIWRMPANKVADPEILISDYGTSFIASQTPSPTLHTPALYAPPEEFFNKPIAIPKAADIWTLGVVLYDAVGECPLFETFAWDPDDIIAEMVNTLGDMPARWWAAWANRSEFFNPDGSWISNFQRISTPEFRRLHQRMWDMGRGETPETCQWDVAAGEFKALEDMLRSMMTFEPAERPTAKQLLESEYIVKWAMPAWERQVERKSALTKH

SEQ ID NO: 66625 - protein, 159 aa, Escherichia coli
QAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGG

SEQ ID NO: 66626 - protein, 201 aa, Rhodococcus fascians
MTDKSELEVTDRIATVPNLLSAVRLAGVPLFLFLLLGPQADGWALVILLVSGGTDWLDGKLARLLGQSSRLGAILDPLVDRLYVVSTLVAFVVRGIIPWWVAAILIGRDAVLGLTMFVYRRRSLPPPDVIYLGKAATFVVMIALPVLLVSVGTGSVADAAGPLGYALLIWGTVLYTWTGALYLGKAVAVARAIAPTSAPGR

SEQ ID NO: 66627 - protein, 134 aa, Mycobacterium avium 104
MTSPKVQLTDDEWRQRLTPEEFHVLRQAGTERPFTGEYTDTKTEGVYQCRACGAELFRSTEKFESHCGWPSFYDPANSDAVILLPDHSLGTTRTEVLCANCHSHLGHVFTGEGYPTPTDQRYCINSICLRLVPS

SEQ ID NO: 66628 - protein, 599 aa, Oryza sativa Japonica Group
MGNTCVGPSISKNGFFQSVSTVLWKARQDGDDALPGANGAPDGGGQGRLPAPPPPTSDAPLAVQNKPPEHVKIVSTTDTASAEQDASKSSAGSDSGEAARPRPRVPPVKRVSSAGLLVGSVLKRKTESLKDKYSLGRKLGQGQFGTTYLCVERATGKEFACKSILKRKLVTDDDVEDVRREIQIMYHLAGHPNVISIRGAYEDAVAVHLVMELCAGGELFDRIVQKGHYTERKAAELARVIVGVVEVCHSMGVMHRDLKPENFLFADQTEEAALKTIDFGLSIFFRPGQVFTDVVGSPYYVAPEVLKKKYGQEADVWSAGVIIYILLCGVPPFWAENEQGIFEEVLHGRLDFQSEPWPSISEGAKDLVRRMLVRDPKKRLTAHEVLRHPWVQVGGLAPDKPLDSAVLSRMKQFSAMNKLKKMALRVIAENLSEDEIAGLKEMFKMIDTDNSGQITFEELKVGLKKVGANLQESEIYALMQAADVDNSGTIDYGEFIAATLHMNKIEREDHLFAAFQYFDKDGSGYITADELQLACEEFGLGDVQLEEMIREVDEDNDGRIDYNEFVAMMQKPTMGLPAKKSGGLQNSFSIGFREALRMS

SEQ ID NO: 66629 - protein, 151 aa, Chlamydomonas reinhardtii
MEAQYAAVCQGIDTLLAQLQQEGILDEQFSQLMALQDETNPDFVAEVVQLYFEDSVQKIERMGAMLTAPAPDFKELDQLVHQFKGSSASLGAATIAQLCIKMREGCQTSNQAMCAALLGQLRDSYLLLKGKLDMFMALEQQRKQLLAAMGR

SEQ ID NO: 66630 - protein, 325 aa, Alkalilimnicola ehrlichei MLHE-1
MKLFALNASRDFGARVAEALGSPLAEHEEREFEDGEHKARPLTGVRGEDVYVLQSLHGDPAQGVNERLARLLFFLATVRQAGAARVTAVIPYLAYARKDRQTKPRDPVTTRYLAQLLEAMGIDAVITLEVHNRAAFQNAFRCQAHPLDTRRLFAAHIRGRCENDPVVVASPDPGGVKRAQGFQETLAALLDRPVGAAFVEKRRSEGVVSGEALVGDVAGASVWLMDDLISSGGTLARAAAACRRQGAARVVGLAAHGLFTGDAGRVLSDSALERILITDTVPPDRLDPAVAEQRLEIVSAAPLFAEAIRRTHKGGSLTELLEGPG

SEQ ID NO: 66631 - protein, 582 aa, Oryza sativa
  misc_feature (163)..(163): Xaa can be any naturally occurring amino acid
MRLSSLLFLVCFFTVAMSQCAAAAKARHFRWEVSNMFWSPDCEEKVVIGINGQFPGPTIRAKAGDTIVVHLKNGLHTEGVVIHWHGIRQIGTPWADGTASISQCAINPEETFTYRFVVDKPGTYFYHGHYGMQRAAGLYGSLIVDVADGDEEPFKYDGEINLXLLSDWYHESIYTQMVGLSSNPFRWIGEPQSLLINGRGQFNCSLAAAHTPGAKQCAAAGNRHCAPVILPVLPNKTYRLRVASTTSLASLNLAVGNHKLTVVEADGNYVEPFAVDDIDIYSGDSYSVLLTTDQDTSANYWVSVGVRGRQPRTAPALAVLNYRPNRASRLPAAAPPATPAWDDFARSKAFTYRILGRAGVTPPPPATSDRRIELLNTQNRMGGGHVKWSINNVSMVLPATPYLGSLKMGLRSALPSAARPSDTFGRGYDVMRPPANPNTTVGDNVYVLAHNATVDVVLQNANALARNVSEVHPWHLHGHDFWVLGYGDGAFRGDAGDAAALNLRNPPLRNTAVIFPYGWTAIRFVADNPGVWAFHCHIEPHLHMGMGVIFAEAVDRVSELPKAAVSCGATATALMAGAGGHV

SEQ ID NO: 66632 - protein, 262 aa, Oceanobacter sp. RED65
MSVTIKTPEEIEKMRVAGRLAAEVLEMIGEHVKPGVTTGELDRICHEYIVNQQDAIPAPLNYGNPPFPKSICTSVNHVICHGIPSEDKVLKKGDSVNIDVTVIKDGYHGDTSKMFFVGEPKPADKRLVEVTQECMYKGIALVKPGARLGDIGHVIQQHAESNYYSVVREYCGHGIGAGFHEEPQVMHYGKPGTGMELVEGMCFTIEPMINQGKAASKLLGDHWTVVTKDRKLSAQWEHTCLVTADGVEVLTRRKEEVFPWEA

SEQ ID NO: 66633 - protein, 208 aa, Brassica rapa
  misc_feature (161)..(161): Xaa can be any naturally occurring amino acid
MAFLSKVGKIFRQTSAHVTASNSMLQSIRCMSSSKIFVGGISYSTDEFGLREAFSKYGEVVDAKIIVDRETGRSRGFAFVTFTSTEEASNAMQLDGQDLHGRRIRVNYATERGSGFGGRGFGGPGGGNAGGYGAPSGGYGGGGGYGGGAGGYGAPGGGYGXWWWLRRRCWWLRCSSWWLWRRWLQCSRWWLRRWLILWWKCCWWRLWR

SEQ ID NO: 66634 - protein, 379 aa, Triticum aestivum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGAKMAGAARIIGVDLNPAKYEQAKKFGCTDFVNPKDHTKPVQEVLVEMTNGGVDRAVECTGHIDAMIAAFECVHDGWGVAVLVGVPHKEAVFKTSPMNLLNERTLKGTFFGNYKPRTDLPEVVEMYMRKELDVEKFITHSVPFSQINTAFDLMLKGEGLRCVMRMDE

SEQ ID NO: 66635 - protein, 400 aa, Magnetospirillum magnetotacticum MS-1
MKYPTPPTVIPLDNILPDEPLLMMGAGPVPIPPKVAMANSLIINHLGDTMNAVIEQVKTMGRYVFQTNSPHVMGVAGPASAAMEMAIANLVEPGTRVLSICNGLFSKRLAEMATRVGGDVTILNAPDKRAVAAEEVEKLLKTGKFQIVTVVQGETSNTVWNRDLIEICRLGKQYGCLNIVDAVCTLSTMPMEMDEWMVDAIITGGQKGLSSIPGVSLIAFSEEAFTRISARNSPMAHWCLDARLAHQFWHNHSYHYTAPVSGILALHEALRLIGDETLPGRFRRHAQCSTALQRGVLAMGLKLLIEEDSRLNSVVGIELPETISADQVRHIMSQVHKVEISGAFGLPIVRIGQMGEQSRAPNLFRTLHALGSAMRAAGGKVDMPGGMAELERSLASEVRG

SEQ ID NO: 66636 - protein, 777 aa, Debaryomyces hansenii CBS767
MDNNQSNDSNSNQQSAPLNSRTGQQLVRPQQGNARPQQQPLTTLQPPRGPQPQFSQADLNRIVLEYLNKKGYNKTESMLRLESSNTPTPSVPSVSPASSNIASPVEISRREKDLKDKASRHERELRELRDKQARIERELRDSRDREFRLAKEKELRDLRDYEEKQRRENDPEIYYRVYSMLRSWVETSLDLYKPELSRLLYPIFIHCFLELIAKNFSSQAKRFLDKFKGDHVMLHGLEINKLAGISLPEHLKENELAQAYRNNKYRIIVSKTSINLLLYFLHENEAVGGAILIRIINQYLNPIISTTKPDKVDQEGEANPDEGIPDYITKTNEIDKFNEQPVKLGKLPMEPEVQKEIEAELKVKDEKTDPVNEKSLVEEFQEITSVEDDSPARESLPLPLKDASDIKRQILAVEDSRSKIKLGAIQASAPSVCMYTFHNANNDMTCLDFNDDSNLMAAGFQDSFIKLWSLDGKPLKSVFKKDKYNNDNSRKLIGHSGPVYGVSFSPDNRYLISGSEDKTVRLWSLDSYSALVSYKGHNQPIWDVKFSPFGHYFATASHDQTARLWATDHIYPLRIFAGHINDVDCIEFHPNSNYVFTGSSDKTCRMWDVQTGNSVRIFMGHTGPVNCMAVSSDGRWLASAGEDGVVNIWDAGSGRRLKTMRGHGRSSIYSLAFSRDGGVLVSSGADNTVRVWDVKKNTNDAGPEPEAFSFDSNSNNANGTSRNASANSQNFKNDKSNRKEIIATSDHMTAYFAKKTPIYKVHFTRRNLCLAGGGFMG

SEQ ID NO: 66637 - protein, 1206 aa, Solanum tuberosum
MKAHKTVFYQHPLSLNKLFFVLLLIFFLPPASPASVNGLFKDSQQLLSFKAALPPTPTLLQNWLSSTDPCSFTGVSCKNSRVSSIDLSNTFLSVDFNLVTSYLLPLSNLESLVLKNANLSGSLTSAAKSQCGVSLDSIDLAENTISGPISDISSFGVCSNLKSLNLSKNFLDPPGKEILKGATFSLQVLDLSYNNISGFNLFPWVSSMGFGELEFFSLKGNKLAGSIPELDFKNLSHLDLSANNFSTVFPSFKDCSNLQHLDLSSNKFYGDIGSSLSSCGKLSFLNLTNNQFVGLVPKLQSESLQYLYLRGNDFQGVYPNQLADLCKTVVELDLSYNNFSGMVPESLGECSSLELVDISNNNFSGKLPVDTLLKLSNMKTMVLSFNKFVGVLPDSFSNLLKLETLDVSSNNLTGVIPSGICKDPMNNLKVLYLQNNLFEGPIPASLSNCSQLVSLDLSFNYLTGRIPSSLGSLSKLKDLILWLNQLSGEIPQELMYLQALENLILDFNDLTGPIPASLSNCTKLNWISLSNNQLSGEIPASLGRLSNLAILKLGNNSISRNIPAELGNCQSLIWLDLNTNFLNGSIPPPLFKQSGNIAVALLTGKRYVYIKNDGSKECHGAGNLLEFGGIRQEQLGRISTRHPCNFTRVYRGITQPTFNHNGSMIFLDLSYNKLEGSIPKELGTMYYLSILNLGHNDLSGMIPQDLGGLKNVAILDLSYNRFNGPIPNSLTSLTLLGEIDLSNNNLSGMIPESAPFDTFPDYRFANNSLCGYPLPLPCSSGPKSDANQHQKSHRRQASLAGSVAMGLLFSLFCIFGLIIVAIETKKRRKKKEAALEAYMDGHSHSATANSAWKFTSAREALSINLAAFEKPLRKLTFADLLEATNGFHNDSLVGSGGFGDVYKAQLKDGSVVAIKKLIHVSGQGDREFTAEMETIGKIKHRNLVPLLGYCKVGEERLLVYEYMKYGSLEDVLHDRKKIGIKLNWPARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGKQPTDSADFGDNNLVGWVKLHAKGKITDVFDRELLKEDPSIEIELLQHLKVACACLDDRHWKRPTMIQVMAMFKEIQAGSGMDSTSTIGADDVNFSAVEGGIEMGINESIKEGNELSKHL

SEQ ID NO: 66638 - protein, 251 aa, Zea mays
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGENDLPGLTDTEKPRMRGPKRASKIRKLFNLNKDDDVRKYVNTYRRTFTTKNGKKVSKAPKIQRLVTPLTLQRKRARIADKKKRITKKKSEAAEYQKLLAQRLKEQRDRRSESLAKRRSKLSAAVKASAATSA

SEQ ID NO: 66639 - protein, 233 aa, Zea mays
  misc_feature (155)..(155): Xaa can be any naturally occurring amino acid
  misc_feature (221)..(221): Xaa can be any naturally occurring amino acid
METMSALARTAPPLAGTIRRPSCALRPTASLSFAAASTTPRGRLGLGLSTAPAGSGRAARARAVPQRIVASSEVERSYIMIKPDGVQRGLVGEIISRFEKKGFLLKGLKLFQCPKDLAQEHYKDLKDKPFFPKLIDYITSGPVVCMLQSCYSILXKAWEGAGVVASARKLIGATNPLQAEPGTIRGDLAVQTGRNVVHGSDSPDNGKREIELWFKEGELCXKWESVQAPWLIE

SEQ ID NO: 66640 - protein, 176 aa, Triticum aestivum
MAPTVMSSAATAVAPFQGLKSTAGLPVSRRSSSAAGLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 66641 - protein, 426 aa, Anabaena variabilis ATCC 29413
MSFSHLGLSNEIIRAVTELGYTKPTPIQMQSIPAVLSGRDLLAGAQTGTGKTASFTLPLLHLLSQDSLKSASSPSSPIRALILTPTRELAAQVESSVRDYGKYLNLNSMVMFGGVSINPQKQRLKGRVDILVATPGRLLDHVQQGTVNLSQIEILVLDEADRMLDMGFIRDIRRILSLLPKQRQNLLFFATFSDKIKELAAGLLNRPQMIEVARRNVTADTVTQKVYKIERDRKRDLLAHLIRKDNWYQVLVFTRTKYGADRLVKQLGHERIQALAIHGNKSQSARTHALAKFKNGSLQVLVATDIAARGLDISELPYVVNFDLPYVPEDYVHRIGRTGRAGASGEAVSLVSADEYHLLADIEKLIEKRLPFELVAGIGANSQTKPEPSQDERKQKPKDSKHQPRSAAQAVPKKSGKKRLTNSGKR

SEQ ID NO: 66642 - protein, 273 aa, Candida albicans SC5314
MVAESSSIDNTPNDVEAQRPVYEPKYDDSVNVSPLKNHMIAFLGEFFGTFIFLWVAFVIAQIANQDPTIPDKGSDPMQLIMISFGFGFGVMMGVFMFFRVSGGNLNPAVTLTLVLAQAVPPIRGLFMMVAQMIAGMAAAGAASAMTPGPIAFTNGLGGGASKARGVFLEAFGTCILCLTVLMMAVEKSRATFMAPFVIGISLFLGHLICVYYTGAGLNPARSFGPCVAARSFPVYHWIYWVGPILGSVIAFAIWKIFKILKYETCNPGQDSDA

SEQ ID NO: 66643 - protein, 388 aa, Escherichia coli
MKITISGTGYVGLSNGVLIAQNHEVVALDIVQAKVDMLNQKISPIVDKEIQEYLAEKPLNFRATTDKHDAYRNADYVIIATPTDYDPKTNYFNTSTVEAVIRDVTEINPNAVMIIKSTIPVGFTRDIKERLGIDNVIFSPEFLREGRALYDNLHPSRIVIGERSARAERFADLLKEGAIKQDIPTLFTDSTEAEAIKLFANTYLALRVAYFNELDSYAESQGLNSKQIIEGVCLDPRIGNHYNNPSFGYGGYCLPKDTKQLLANYESVPNNIIAAIVDANRTRKDFISDSILARKPKVVGVYRLIMKSGSDNFRASSIQGIMKRIKAKGIPVIIYEPVMQEDEFFNSRVVRDLDAFKQEADVIISNRMAEELADVVDKVYTRDLFGND

SEQ ID NO: 66644 - protein, 120 aa, Medicago truncatula
MARKMCIVVLFLVQMLLLPLQNHAEIVVSTVEAPAPQPSKSSGTNQFPNHGITEGSLQPQECGPRCTNRCSNTQYKKPCLFFCNKCCAKCLCVPPGYYGNKQVCPCYNNWKTKRGGPKCP

SEQ ID NO: 66645 - protein, 469 aa, Propionibacterium acnes KPA171202
MKNYCMPDPGEGLTEGEVVSWQVSPGDTVKINDVLCEVETAKSIVELPSPFAGTVAKLCAEPGETVAVGTPLVTIDDGSEDEPEFLVGHVTAEPGRRRRRRRGAAVSTERAREEGADTHPEQSVSESRHDAEAKPEQRLTEPAPRQDPPRMDRTAHILAKPPARRLAADLGVDLSQVTGTGPQGAVTRSDVKAAAHHGAAAAGDGGACPGDAELASLSVMSRRLLGGAPTEPDGHTRKVPVRGVRKVTAKAVKDSLDTKALVTAFLTCDVTPTMELVNRLRADRRFKGLRVSPLTVWCKAVCLAMGRTPIINAAWDDAADQIVFRDHINLGIAAATPRGLMVPVVRDAQDMAMLELATEITRIVAIAKEDKLQPPDYADGTFSITNVGVFGLDAGTPVVNRTESAILVLGALARRPWVVGTGDDERVVPRWVTTMSLGFDHRLIDGEQGSTFLHDVAEILSDPASAMLY

SEQ ID NO: 66646 - protein, 233 aa, Triticum aestivum
  misc_feature (103)..(103): Xaa can be any naturally occurring amino acid
  misc_feature (110)..(110): Xaa can be any naturally occurring amino acid
  misc_feature (216)..(216): Xaa can be any naturally occurring amino acid
MTSPAPAPPAAAAAQSPPPRIGLAGLATMGQNLALNIAEKGFPISVYNRTAAKVDSTLSRAAAEGALPVLGHRDPRDFVLSLARPRTVVLLVQAGPAVDATIXALSPYLXDAGDAIVDGGNEWYQNTERRIEQAASRGILYLGMGVSGGEEGARNGPSLMPARGFQAYSNIKDILEKAAAQTEDGPCVTFVGPGGAGNFVKMVHNGIEYGDMQLIXAEAYDVLHRVGGLSNSE

SEQ ID NO: 66647 - protein, 517 aa, Oryza sativa Japonica Group
MGNLGWMVAAAVAAVVASWAFDAVVKLVWRPRAITRRLRAQGVGGPGYRFFSGNLGEIRRLRDEGAGVVLDVSSHDFVPIVQPHFRKWIPLYGKTFMYWFGARPTICLADVSMVRQVLSDRTGMYPKNVSNPYFARLLGKGLVLTDGDEWKRHRKVVHPAFNMDKLKMMTVTMSDCAQSMISEWESELGTKGDIVEIELSRRFEELTADVISHTAFGSSYKEGKQVFLAQRELQFLAFSTFLSIQIPGSSYLPTKKNLKTWSVDKKVRSMLTDIIKSRLNNKDVAGYGNDLLGLMLEACAPEHGESQPQLSMDEIIAECKTFFFAGHDTTSHLLTWTMFLLSTHPEWQEKLREEVATECDGKVPTGDMLNKLKLVNMFLLETLRLYGPVAFIQRRVNAELELGGITVPEGTVLSIPIATIHRDKEVWGEDADIFKPERFKNGVSKAGKYPNALLSFSSGPRACIGQNFAMIEAKAVIAMILQRFSFTLSPKYVHVPTDVITLRPKYGLPMILKSLKV

SEQ ID NO: 66648 - protein, 138 aa, Alkalilimnicola ehrlichei MLHE-1
MKVNAAMHRGVEWCAPDTPIMEIARLFREKDIGAIPIGENDRLVGMLTDRDIVCRGLAEGRDVASMTAGDVMTRDIIYCWEDDDIEDAVHLMEEHRVRRVPVLNSDKRMTGMLSMGDISHAANPELCREFLGAVAAHH

SEQ ID NO: 66649 - protein, 532 aa, Solibacter usitatus Ellin6076
MLTDREAYKKLAAHFEQVKNVHLRELFAADSRRGERLTAEAAGLYLDYSKNRVTDETLGLLLALAEECGLRGRIDAMFRGDKINTTEGRAVLHTALRAPRGKSPAAAQVPEAGEPVQAVLEQMSVFATSVREGRWAGFTGKPIRNVVNIGIGGSDLGPVMAFEALRYYSQRNLTFRFVSNVDGTDFREATRDLDPAETLFIVASKTFTTLETMANAQSARAWTLAALGDPAAVARHFVAVSTAAEKVAKFGIDTANMFGFWDWVGGRYSMESAIGLSTMIAIGPENFLEMLGGSYAMDEHFRTAPFAKNLPVLMGLLTVWYNNLFKAQTVAVLPYDQYLKRFPAYLQQLTMESCGKHVTLGGEPITTYETGPIFWGEPGTNGQHSFYQLIHQGTKLIPCDFIGFRQTLNPLPSPMGNHHDLLMANVFAQSKALAFGKAAPAGQPYREFDGNRPSNTILAERLTPAVLGALVTLYEHSVLTQATIWDINPFDQFGVELGKVLAAEILPSLAKDAPLPDDDSSTVALIKRYKKQ

SEQ ID NO: 66650 - protein, 533 aa, Solibacter usitatus Ellin6076
MRFGARILFEDVACSFLPGRRYALTGPNGAGKSTLMKILTGEIEPALGTVTRPKKLGVLRQDQFAFDQFRVIDTVIMGNAPLWKALEERDKLYAKPHDQLTDEDGMRLGELEGIVGEQDGYTAESDAAVLLDGLGVPDSLHERLMGELQGGQKVRVLLAQALFGTPPALLLDEPTNHLDLDSVHWLQDYLIHYQGALIVISHDRHFLNSVCTHVADIDYETVILYTGGYDDMVLAKTQIRSRIEAQNQQREKKIAQLNEFIARFSAGTRSSQVTSRKKEVERLQTSELARSNIQRPYIKFESKRPSGRHPLEFKAISKSYGDLKVIDNFTASLSRGEKIALMGRNGVGKTTLLKSLVRNATGFVEDSDRAFEIDGGAVTWGHEVSVGYFAQDHTDSIAKGMTTIEWLHQWDPAASQEELRGLLGQMLFSGDDALKPTSALSGGESARIIFCRLMLQKPNFLVLDEPTNHLDLESINALNIALQKYEGTVLLVTHDHDLIDEVATRIWHFEGGKIEDFKGPYSEYVAYAQEKAS

SEQ ID NO: 66651 - protein, 233 aa, Zea mays
QLPNGVPVAVKMLENSTGEGEDFINEVATIGQIHHANIVRLLGFCSEGTRRIARGMEYLHQGCNQRILHFDIKPHNILLDYSFNPKISDFGLAKLCARDQSIVTLTAARGTMGYIAPEIYSPNFGGVSYKSDVYSFGMLVLEMVSGRRNSDPGIENQNGVYLPEWVYERVVTGQDLTLSKKIADQEKETVRQLAIVALWCIQWNPKNRPSMTKVVNMLTGRLQNLPIPPKPYA

SEQ ID NO: 66652 - protein, 313 aa, Solibacter usitatus Ellin6076
MPDPRAFDAIVAGELYTDLILSGFDFWPRPGQEAFAKEYHREIGGGAVNTACALARLGSRAAVLGVVGHDGDWLLRQLENSAVDTSHISRDPAEPTAFTVAISTPEDRSFLTYPGANRSFPKAIAEAAAGKRLAQAAHVHLAFPPDLSTASDLLAAIRANGCTVSLDVGWHESWLQDERLREVLPLLDVFFPNEIEAHCITGEKDPETTLRWLSAAGLRCVALKLGARGAALLCDGEIWFDDPLPVTPIDTTGAGDCFNGGFLRSWLKGCSPETCLRSANICGALSTGSYGGVAGLPDSARLNELLRARECEK

SEQ ID NO: 66653 - protein, 372 aa, Campylobacter jejuni
MEISYYEILEITQNADKETIKKAYRKMALKYHPDRNQGDKEAEDKFKLVNEAYEVLSNDEKRAIYDRYGKMLKGGGFGSSSSGFGGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNESKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRMGNQIVQISIKFPTSLNDEQKELLEKLSESFGIKDGMHQEQKGLFEKITNWFKS

SEQ ID NO: 66654 - protein, 456 aa, Solibacter usitatus Ellin6076
MTQTESPHLVRGIGLLGAVSANMLEMIGVGPFITIPILLAKMNGPQAILGWLLGALVALCDGMVWAELGAAMPGTGGPYHYLSEAYGPQRMGRLMSFLFIWQTMALAPLSIGSGAVGFAQYARFLFKDITPLQEKLIAVSVCALITVLLYRDIRSVGRLSIIMWIVVVGTVLWITAAGVMHFDPRRVLDFPSGAFTPSRSFFFGLGGATLIAMYDYGGYNNVCFFAGEVRRPERVIPRSILLSIAAVATLYLTMNITIIGVVPWREAIRSTAIASDFIQRIYGAKAAAVVTVLILWTTFASVFAVLLGYSRVPYAAAVDGRFFRPFARLHSSKNFPYFSVLFIGVLSAAASLLTLDVLINGLIVIQVLIQFMAQIFAVTLIRRDRPDIVRPFKMPLYPLPSIIAFLGWLYILIASGLAYIVAGLVLMMLGVAAYVWHAHGAGEWPYASRWKAGADA

SEQ ID NO: 66655 - protein, 486 aa, Arabidopsis thaliana
MESVALSRIGLAGLAVMGQNLALNIADKGFPISVYNRTTPKVDETLDRASNEGKLPVAGQYSPRDFVLSIQRPRSVIILVKAGAPVDQTITALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNTNLASLVVDPDFAKEMVQRQAAWRRVVGLAISAGISTPGMCASLAYFDTYRRARLPANLQAQRDLFGAHTYERTDRPGAYHTEWTKLARKSQ

SEQ ID NO: 66656 - protein, 504 aa, Yarrowia lipolytica CLIB122
TIAANRRRHPPERALTSGSHSQQKNKSSAFPRLAIAAFFHRDNRETALAHPSTVSLSQSTTQHTSCLNHPTIPTMSTIYMGDLEPWMDEAAIKNMWAQVMGPDTNINVKLIRDKFTDSINYGFIDFASPELAAAALKFNGKPIPGTDRLFKLGEDNGDGAPVEFSIFVGDLAPESTEPELLQAFKSRYESCRAAKIMTDPVTGLSRGYGFVRFSSEEDQQKALQEMQGYMLGSRPLRVSTATPKNRHHHQPYMQFQPQQFQPPAHYQQLHSQHPFPHHPNGAPSHQVHQPFYGGPAHPLNQFTDANNTTVFVGGLSSSVSEDELRQYFQGFGDITYVKIPPGKGCGFVQYVQRQSAEMAITQMQGYPIGNGRVRLSWGRSQSQQQVHHHHQYRPAPQPLIYPQMGIPAQNYGPYQPVSPALAHRHAAPLQTPAIGDQEGMSTNATTLAYAAGLPPVTGAPAAPGEDPSEPIPVARLNELYLAARDGRLDRVESESSGYHGVYAQ

SEQ ID NO: 66657 - protein, 181 aa, Oryza sativa
MGMAFSRVFERLFGKQEMRILMVGLDAAGKTTILYKLKLGEVVTTIPTIGFNVETVEYKNISFTVWDVGGQDKIRPLWRHYYQNTQGLIFVVDSNDRDRVDAARDELHRMLNEDELRDSILLVFANKQDLPNAMSAAEMTDKLGLHGLRHRQWFIQACCATTGDGLYEGLDWLSATLQKRK

SEQ ID NO: 66658 - protein, 362 aa, Amycolatopsis orientalis
MNLRISGPTPLPPRVRAALSTDMISHRSTAFRDIVAEVLAGLTPVFGDPATILPFTCSGTGGLEAAVVNTVRPGQRVVVVSIGYFGTRMAEIARMAGLDIEVIEVPWGQAADPGELQAVLRRLRDVAAVLVTHNETSTGVLNPLPELCRVVRESSDALLIVDVVSSVGATPVRMRDWGIDVAVGVSQKALMSPPGLALLGVSSRALTAAAANPARRYYFDFTAMARAVEENTTTYTPAIPVFHALQTALRMISVEGWDRVLARHQRLSEQCRSGLADLGLAFAADQPYASPTVTSFFVPADMRASDVRERMAVEHKVQVASGRAKWKDSVLRIGHMGYVNENDVAHVLAALGAVLDRAGGSS

SEQ ID NO: 66659 - protein, 394 aa, Amycolatopsis orientalis
MNRVLSALAPHSSKRISEYAQRHPGTVDLTVGLPAFGPPRSFDERLAMLSSAPHVNARPEDQYAHSRGAIELRAAIAHVYKSEQGVDLDPDTQILVTNGAAGALWIAVLTLTEPGDEVLLADPGYMIYPPMIELLGRRVVRIPTSPADGFRLHLSDLRSRLTQRSRVVLVNSPGNPTGRVSSEDELADLCAFAVEHGLYVVHDEVLDRFAYGIEHRSVVALDHQGVGIAVNGLSKRFGMSGWRIGWLASSSAVIAEAAKAHTFFMLAVSHAVQLAAAAALSDPKADGEVSVYAAEIRRRGEVFLADLARIPGLGKTTVPDGGFYAFVDVGEFARLRGIRVAESTSAAVAEYLLHECGVAVVPGSVFGRAGEGFVRMSFAGSAEQLDRAVKRLAG

SEQ ID NO: 66660 - protein, 266 aa, Arabidopsis thaliana
MGGVKRKIAIEKIQNKNPRAVSFSKRRKGLYSKASELCLLSDAEIAIIATPVSSNSNAAFYSFGHSSVDNVVAAFLANQRPCDERFWWEDESLLKSENLEELREAMDSMSTMLRDLKELEKQRDHQTQTLIHQPCSARVCIQDYVTVNFDGFNTEEQTLAVSDNSNNNGLLGNLDECNEDFDDLDQIFDTVTNSEFLSVNLEMDDVTVNSEGNTEEQTLAVSDNSNNNGLLGNLDECNEDFDDLDQIIEYLTSSEALSMNLKMDDV

SEQ ID NO: 66661 - protein, 463 aa, Lactobacillus sakei subsp. sakei 23K
MSKHSLFAKKKIDASQFKNGLLERNLTAVGLTAMGVGAVVGAGIFITPGIIAAKYAGPGAMLSYLLAAVVCALAALCYSEFASTIPLAGSAYTYVYTVFGELVAWILGWALVSEYLFAVASVAVSWSAYFQNLMAGFGLHLPTALSAAWEPGKPAGVNLIAGIVVLIVGFLLSNGMRESTRINTIMVGVKIAVIVIFLGVAVFYVKPANFQPFLPYGASGVLSGAALAFYAYIGFDAVSTASEEVINPQRDMPIGIIASLLIASLLYAAVATVLVGVVHYTKLNVGDPVAFALQLMHQNWVAGIISLGAVAGMTTVLLVMTYGGTRLIFAMSRDGLLPAVFAKINPKTHVPVANTWIFAVVTSIVAALVPLDKIAELVNIGTLFAFATVSLGVIFLRRIPNYNELPQGFKVPLYPIVPILSCILCVLLMTQLQITTWIVFVIWLVIGLVIYFSYSYHHSQQRM

SEQ ID NO: 66662 - protein, 467 aa, Physcomitrella patens subsp. patens
MVDSVAQELVDFLNASPTPFHAVQESKNRLLKAGYQQLSERASWTLEAGGRYFFTRNYSTIVAFAVGKKQVLYVPGNGFLIIGAHTDSPCPKLKPTTKVIKSGFLEVGVSTYGGGLWHTWFDRDLTVAGRVVLKRKNGEKSSYSHELVRVEQPIMRIPTLAIHLDRGVNDGFKVNTQTHLAPPAGSNSTEEDTSPSKCNGNQSDDHHPLLLQLLANELACKPDEIVDFDIQVCDTQPSIIGGALKEFIFSGRLDNLCSSFCSLKALIDSSSDLAEEVGIRMVALFDHEEVGSQSAQGAGSPVLVDALRRITSHFGESSAEGLLERAIQKSFLVSADMAHCLHPNYPEKHEENHQPKMHRGLVIKDNANQRYATNAITSFIFREIAKLRNLPTQNFVVRNDVACGSTIGPILASGIGIRTVDVGAPQLSMHSIREMCGVDDVGYSYNHFKAFFEDFSALDAQLAVDEP

SEQ ID NO: 66663 - protein, 257 aa, Solibacter usitatus Ellin6076
MKLLVKLGGTLLDSAASRDSLCLQIAAARAAGHEVTVVHGGGKQMTRYLTDRGIESRFVGGLRVTSPDTIDAVLKVFAGSVNHELVANLNRAGALAVGLSGIDSFLVEAEQMDPELGAVGRVTGSNPALLHLLTANGYVPVVACVAGDRLGQIYNVNADQMAVACASAFGACRLIFLTDVDGVMDNSNRVRPVLTAAESRQLIDEGIATGGMQAKLNAALSALADGVQQVRIAPGAAPGALQRILAGEEIGTKMVTA

SEQ ID NO: 66664 - protein, 279 aa, Physcomitrella patens subsp. patens
MNEIAGDLTQSQHDTLIKFRDILSEQCLLRKRDDDYTLLRFLRARGFDIPKAKAMFEAMLEWRAEIGADTIRETFDFPERKAVRELYPHFHHKTDKLGRPVYIERLGQLNLDELLKITTMDRMLLYHVKEWEVLIDSKFPACSKEADTCVSQSLTILDLKGVHMSKQVRHFIQKITKLDQDYYPEYLGKMFIVNAPTAFKATWAMIKPWLDKRTQKKIELHGGHFSSKLLELVDSENLPEFLGGSCNCLGGCENSDAGPWNEARYCSDALYDEPCKAAV

SEQ ID NO: 66665 - protein, 481 aa, Polygala cruciata
  misc_feature (2)..(3): Xaa can be any naturally occurring amino acid
  misc_feature (10)..(11): Xaa can be any naturally occurring amino acid
GXXVSTLEEXXLGRIAQIIGPVLDVAFPPGKMPNIYNALVVQGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKFSIFETGIKVVDLLAPYRRGGKIGLFGGAGVGKTVLIMELINNIAKAHGGVSVFGGVGERTREGNDLYTEMKESGVINEKNIPESKVALVYGQMNEPPGARMRVGLTALTMAEYFRDVNEQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGDEHYETAQRVKQTLQRYKELQDIIAILGLDELSEEDRLTVARARKIERFLSQPFFVAEVFTSSPGKYVGLAETIRGFKLILSGELDSLPEQAFYLVGNIDEATAKATN

SEQ ID NO: 66666 - protein, 278 aa, Physcomitrella patens subsp. patens
MSAPRAAQLLQSLAGAAIAFGVGGSALNASLYTVDGGHRAVLFDRFRGVLDETAGEGTHFLIPVLQKPYIFDIRTRPRSITSVTGTKDLQMVNLTLRVLSRPDSGELPTIFKTLGTDYDDRILPSIGNEVLKAVVAQFNADQLLTERPFVSALVRDALLKRAKDFNLILDDVAITHLSYGAEFSRAVEQKQVAQQEAERSKFVVAKADQERRAAIVRAEGESEAAKLISDATSSAGGGLIELRKIEAAREIASTLAKSRNISYLPGGNNMLLGINPSM

SEQ ID NO: 66667 - protein, 525 aa, Escherichia coli O157:H7 EDL933
  misc_feature (83)..(83): Xaa can be any naturally occurring amino acid
  misc_feature (127)..(127): Xaa can be any naturally occurring amino acid
  misc_feature (154)..(154): Xaa can be any naturally occurring amino acid
MTENIHKHRILILDFGSQYTQLVARRVRELGVYCELWAWDVTEAQIRDFNPSGIILSGGPESTTEENSPRAPQYVFEAGVPVXGVCYGMQTMAMQLGGHVEASNEREFGYAQVEVVNDSALVRGIEXALTADGKPLLDVWMSHGDKVTAIPSDXVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVLDMFGDHFGLNIVHVPAEDRFLSALAGENDPEAKRKIIGRVFVEVFDEEALKLEBVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 66668 - protein, 486 aa, Magnaporthe grisea 70-15
MGKVKESKKATKAAPAVKSAGVTKPSQTSSAKSKKIAKDVAVKASKKDKKKKVEVSSESDSDSDASDSSSDSDSESEVEEKKPTKAATNGKAKKAAKAESSDSDSSSESEADSSDSSDSESDAKPAPKEKAATNVDKKAAAKKVEKSESSDSDSDSSDSDESDSDAKPAKAEKTDKAKKEETDSDSDSDSDSDSSGSDSSDDEEEKPAKTEAPSKKRKAEEEEEAPAKKTKTEESDKPSTLFVGNLSWNVDDAMLAEEFKFCGTVTSARVITDRESGRSKGFGYVDFATPEEAEKAHGEKQGAFIDGREIKVDFSTGKATNSNDAAGARAKKYGDTVSPESDTLFVGNLPFDADEDSVGAFFSEVAEVKSLRLPTEQESGRRKGFGYVTFNSVEDAKSAFEQLNGQSINGRNCRLDYSTPRPPREDGGFGGRGGGRGGFGGRGGGRGGGGFGGRGGGGRGGGRGGGRGGFGGSRGGGGFQGKKITF

SEQ ID NO: 66669 - protein, 561 aa, Pseudomonas putida
MTHLKITGMTCDSCAAHVKEALEKVPGVQSAIVSYAKGAAQLALDPGTAPDALTAAVAGLGYKAMLADAPPTDNRTGLFDKVRGWMGAADKGSGGERPLQVAVIGSGGAAMAAALKAVEQGAQVTLIERGTIGGTCVNVGCVPSKIMIRAAHIAHLRRESPFDGGMPPTPPTILRERLLAQQQARVEELRHAKYEGILDGNSAITVRHGEARFKDDRDLSVSLNEGGERVVMFDRCLVATGASPAMPPIPGLKESPYWTSTEALVSDTIPERLAVIGSSVVALELAQAFARLGSQVTILARSTLFFREDPAIGEAVTAAFRAEGIKVLEHTQASQVAHVDGEFVLTTGQGEVRADKLLVATGRTPNTRSLALEAAGVAVNAQGAIVIDKGMRTSSPNIYAAGDCTDQPQFVYVAAAAGTRAAINMTGGDATLDLDAMPAVVFTDPQVATVGYSEAEAQRIGLQTDSRTLTLDNVPRALANFDTRGFIKLVAEAGSGRILGVQAVTPEAGEIIQTAAIAIRARMTVQDLANQLFTYLTMVEGLKLVAQTFSKDVTQLSCCAG

SEQ ID NO: 66670 - protein, 138 aa, Cicer arietinum
ENGLTDEKNFFHRPGFGGGAGGVVDLVVVVEEGLGSGLGGGFGAGGGGGAGGGTGGGAGGGFGGGGGGGFGGGGGVGGGSGFGGGSGFGSGVGNGGGLGGGSGGGFGGGGGGGLGGGAGAGGGFGGGAGGGVGGGGFP

SEQ ID NO: 66671 - protein, 356 aa, Vitis vinifera
MELDLSPKLAKKLFGENGGSYFAWCPSELPMLREGNIGASKLALEKHGFALPRYSDSSKVAYVLQGSGVAGIVLPESEEKVIAIKKGDAIALPFGVVTWWYNKEDTELVVLFLGETSKAHKAGEFTDFFLTGTTGLMTGFTTEFVARAWDLEEKVAKLLVEKQSGVGIVKLADTFKMPEPKIEHRNGMALNCEEAPLDIDIKNGGRVVVLNTKNLPLVGEVGLGADLVRLDGGAMCSPGFSCDSALQVTYVVRGSGRVQVVGVDGKRVLETTLKAGNLFIVPRFFVVSKIADPDGMEWFSIISTPNPIFTNLAGKTGVWKALSPQVLEAAFNIPPDAEKQFRSKRNSDAVFFPPPN

SEQ ID NO: 66672 - protein, 509 aa, Staphylococcus epidermidis RP62A
MQNFKELGISDKTVQTLEAMGFKEPTPIQKDSIPYALEGDDILGQAQTGTGKTGAFGIPLIEKVVGQQGVQSLILAPTRELAMQVAEQLREFSKGQKVQVVTVFGGMPIERQIKALKRGPQIVVGTPGRVIDHLNRRTLKTQGIHTLILDEADEMMNMGFIDDMRFIMDKIPAEQRQTMLFSATMPKAIQELVQQFMKAPKIIKTMNNEMSDPQIDEYYTIVKELEKFDTFTNFLDVHQPELAIVFGRTKRRVDELTSALLSKGYKAEGLHGDITQAKRLEVLKKFKNDQIDILVATDVAARGLDISGVSHVYNFDIPQDTESYTHRIGRTGRAGKEGIAVTFVNPIEMDYIRQIEDVNNRRMKALRPPHRKEVLKAREDDIKDRVQNWMSRENEPRLQRISSELLKEYDSTELVASLLQELVEANDEVEVQLTFEKPLARKNRSSKGGSRRSNHKRGNGKFDNKNRRSKGSKGQSSKKKNQKKFDRRDKQQKSGNQSLKGRTFADHQK

SEQ ID NO: 66673 - protein, 455 aa, Desulfitobacterium hafniense Y51
MLLMDYELQKKYGLFTAIAMVIGIVIGSGVFFKAEKILLATGGDLPLGILAWVIGGMIMIVCAYVFATMATRYEKVNGVVDYAEATMGRGYAYILGWFMTTIYYPAITSVLAWVSARYTCVLLGWDIVGAEAMAIAGFYLVGSYALNALSPKLAGKFQVSTTIIKLIPLILMAILGTITGLSNGVLVKNFTSGVIADVSTANPLFTAVVATAFAYEGWIIATSINAELKDAKKNLPRALTFGTMFVALIYILYYTGLAGAVENSVIMEGGETGAKIAFSTVFSNLGGSVLFVFVVISCLGTLNGLMLGCTRGFYSLAARDLGPQPHIYKNIDANTNMPTNSAIMGLLFTAGWLLYFFGANLVPESWFGPFSFDSSELPIVTLYVMYIPIFIMMMIKEQSLGGFKRFIMPTLAIFACIFMVIAAIYAHRWAVLYYLILFIVVMAVGGIFYFTKKPH

SEQ ID NO: 66674 - protein, 264 aa, Thermoanaerobacter tengcongensis MB4
MKIGFIGAGNMGMALIKGILKSDFVEAEDLILYDPVREKVEGLEREFGTVTAKDNLELTEKSDVVIVAVKPNVYDEVLKEIREKVTEEKIIITIAPGITIDHVKKLLGRGKIVRTIPNTPALIGEGITAVTYSEEVKEEDKELVRKIFSTCGEIVEIEEKLIDVAMAVSSCSPAFVYMFIEALADGGVLLGLPRDVAYKLASKAVSGAGSMVFKTGFHPGQLKDMVTSPGGTTIEGIRVLEKSGMRSAVIEAVIAAYQKAKGLK

SEQ ID NO: 66675 - protein, 97 aa, Zea mays
YWTAIAELIPREVPNIEKRGKKDAEKKPSVFVVQGPKPGKPTDLSRMRHILVKLKHSPPPHMIPPPPAPAKDTKDGKDAKDGKDSKNVDKAASNGTA

SEQ ID NO: 66676 - protein, 292 aa, Zea mays
MGKDDVVQSGAGGGEFAAKDYTDPPPAPLVDAAELGSWSLYRAVIAEFIATLLFLYVTVATVIGYKHQTDASASGAGADAACGGVGVLGIAWAFGGMIFVLVYCTAGISGGHINPAVTFGLFLARKVSLVRALLYMVAQCLGAVCGVGLVKAFQSAYFDRYGGGANSLASGYSRGAGLGAEIVGTFVLVYTVFSATDPKRNARDSHVPVLAPLPIGFAVFMVHLATIPVTGTGINPARSLGAAVVYNKDKPWDDHWIFWVGPLLGAAIAAFYHQYILRAGAIKALGSFRSNA

SEQ ID NO: 66677 - protein, 332 aa, Synechococcus elongatus PCC 6301
MAGATILVTGGAGYIGSHTVRALQAQGYQPIVLDNLSNGQRAIAAEVLQVPLIVGDTRDRLLLDRLFAEHPIQAVIHFAASIEVGESVRDPGNFYANNVSGSLTLLQAMVAAGCQQLVFSSTCATYGLPQVIPIPEDHPQAPINPYGRSKWMVEQFLQDFQAAYGLRSVIFRYFNAAGADPKGDLGEAHDPETHLIPLVLQAAAGQRPSIQVYGTDYPTSDGTCIRDYIHVCDLADAHVRGLTYLADGGATTAFNLGNGNGFSVKEVIATAERVTQRSIPVQLSDRRPGDAIALVGSSDKARQILGWEPQFPSLETMIQHAWQWQQRCDRPS

SEQ ID NO: 66678 - protein, 566 aa, Arabidopsis thaliana
MDSLSSMGFQTASFFLILLFLFYHLPCVPSQQERSRLCKPFQCGDITVGFPFWGENRQSDCGHFSLKLNCNKPSNTTSLTISGHNYSVLHIDNKSNILSLSRQDFSGPFCSASFSSTPLRSDLFQNLQPYRNLTVFYMCDPRRHFFGNFTCPVKGLGSVVQNSTYRKLCDKSFSVTVPTSYVPEEEALNLTHLESVLRKGLEVKLKISEMSGQECVTTDGNSGFTRFCCTNVSGPEISCLTSITTMNNGTYSDNRPFLVTIGTEVVGRGGFGTVYRGRLRDGRKVAVKVLKDSKGNCEDFINEVASMSQTSHVNIVTLLGFCYEGSKRAIIYEFLENGSLDQSLNLDVSTLYGIALGVARGLEYLHYGCKTRIVHFDIKPQNVLLDENLRPKVADFGLAKLCEKQESILSLLDTRGTIGYIAPELFSRMYGSVSHKSDVYSYGMLVLEMIGARNKERVQNADPNNSSAYFPDWIYKDLENFDNTRLLGDGLTREEEKNAKKMILVGLWCIQFRPSDRPSMNKVVEMMEGSLDSLDPPPKPLLHMPMQNNNAESSQLSVESSIYSEV

SEQ ID NO: 66679 - protein, 556 aa, Vibrio vulnificus CMCP6
MFGDRFNDINLKGDLFGGVTTAIISLPLALAFGVASGAGAEAGLWGAILVGLFAALFGGSSTLISEPTGPMTVIMTAVLTSMVAKYPESGIAISFTIVMMAGAFQVLIGTLKLGKYITLMPYSVVSGFMSGIGVILIILQLSPLLGHAAPAGGVLGTLSALPETISNMKFSEFFLGLLTLGILFFFPKQYRKYVPAQLVALVAVTLLSVIIFDFDDVRRIGEIPTGLPSLVVPVINGEIFTAMVIDALVLGTLGCIDTLLTAVIGDSLTRKEHDSDKELRGQGLANMISGLFGALPGAGATMGTVTNIQVGARSPLSGVIRALILALVVLVASGLTEPIPMAVLAGIAVYVGFGILDWSFIQRAHRVSVQGMAIMYGVMLLTVFVDLIVAGGLGVFISNILIIERLSRVQAKQVKAISDADENDVPLTDSERGLLDRANGKVLFFYLSGPMIFSVSKAISRQHSSIADYEAMILDLTDVPMIDVTVGLALENAIKDAQEAQCDVYLLCPNERVREQLEKFHVLDLVPDENTFKFRYEALNAAVNKVEQDEHQGAFV

SEQ ID NO: 66680 - protein, 612 aa, Methanosarcina acetivorans C2A
MLDPILLLGLVVAVLAMSLVAQALSSYFRIPFIIFLLIEGIIAGPEVLNLLNPALYVDGLSTIVAISVSVIVFDGGLHIDLKHIRMVQESVLKLTTIGVFVTFLGTTVLTSLLIEIPLELAALFGALVTATGPTVITPIVRNIQISHKLGKILELEGVLNDAASVILAAMVFEWVAAELSGTDAVVFILYRLGIGIALGSLSGFALRWFFTRGKAISNRTARLVSLTAVFSCFVFSEYLGNESGILAVAIFGIILGTSDFPYKDTIKEFKSDIVIVMLSLIFILLAAMIKFEYILRIGASGVALVLLLIFVIRPFAVFVSMWNSQIGTNEKLFISFVGPRGVVPTAVATYFAIKLDSMGIPGGQTLVGLVFLTVIITVFMSGSLSKKVAEVLEVIPMEILIIGGGKVGRILAERFDKRGENVVVVDISEDNCKKCMELGIRTVQGDAGDVNVLKKAGIENAKYVVATTNQDNTNLLFCQLAKASFGFRGDQLVARVNEIENLQAFWNLGIRSMSPAMTTAVVLDNMIGRPHLFSMCEVGGEGEMMEVKVTNPRVIGKAIKDIQFPEKSLLVMVQRGSDSIIAHGNLVLEYEDIVTVIGEGDAAKQTAAILHK

SEQ ID NO: 66681 - protein, 240 aa, Candida albicans SC5314
MELYSPEGLRIDGRRWNELRRFECRINTHPNSSDGSSYVEQGNTKVMCTVQGPIEPALRSQQHSERANIEVNLNIASFSTFERKKRSRNERRLVELKTTLEKTFEESVMINLYPRTNIVINVQVLCQDGGMLAAVINSITLALIDAGISMYDYVSGVSCGLYDQTPLLDVNNLEEHDMSCLTVGVIGKSEKLALMLLEDKMPLDRLESVLSIGIAGSHKIRELMDQEVRKHGIIRASKMQ

SEQ ID NO: 66682 - protein, 352 aa, Aspergillus oryzae
MSGRVWPRSEVSDCHGELGEDDMRREGANKRGLSSAYDQITQQHVAVKKMMNPFANASIAKRTYREVKLLKQLRHENLIGLCDIFISPLEDIVLMPGFARYLVTELLGTDLGRLLRARPLDNKFAQYFMYQILRGLKYIHSAGVIHRDLKPSNLLVNENCDLKICDFGLARVQEPQMTGYVSTRYYRAPEIMLTWQRYGKMVDIWSAGCILAEMLRGKPLFPGKDHIHQFFLITEVLGNPPPEVVQKITSGNTQRVVNSLPNQEPRPLRAVFHEFDNDVISLLEQLLLFDPDKRLTAETALQHPYLAPYHDPDDEPAALEKFDWSFNDADLPIDTWKLMMCVAIGSAKCAPN

SEQ ID NO: 66683 - protein, 625 aa, Glycine max
  misc_feature (172)..(172): Xaa can be any naturally occurring amino acid
MLLQQTELKQVPSMSRLQKSTGQQQMFHSLHQILSPYMSSVVVSVLLWHVIAVLLVSNLAFASSLEETNGHPKHKGEVIYAHNGAVATDDRRCSRIGKDVLREGGHAVDAAVASSLCLGVVSPASSGLGGGAFLLLRLNNGVAKAFDMRETAPALASKDMYAGNTTLKAKGXLSVAVPGELAGLHEAWKQHGKLPWKRLVKPAEFLARRGFKVSPYLHMQMEASESDILEDKGLRSIFAPNGKLLKIGGICYNNKLAKTLRTISESGPKAFYEGLIGLNLVKDVQNAGGILSMKDLKSYTVKQKEPISNDVLGLKLLGMPPPSGGHPMMLLLNILDQYKLPSGLSGALGFHREIEALKHVFAVRMNLGDPDFVNITGVLSDMLSHSFAKVLKNDINDNKTFGPSHYGSRWNPINDHGTSHLSIIDPERNAISMTSTVNSYFGSKILSPSTGIVLNNEMDDFSIPRNVTKDVPPPAPANFIKPGKRPLSSMSPTIVLKDGKLKAVVGASGGGFIIGGTAEVLLNHFVKGLNPFSSVTAPRVYHQLLPNVVNYENWTTVFGDHFEVPADIRKALKSKGHVLKGLAGGTICQFIVLDTIVPSKQNKGIENETLVAVSDPRKGGFPAGF

SEQ ID NO: 66684 - protein, 328 aa, Corynebacterium diphtheriae
MKLLVTGGAGYVGSVCSTVLLEQGHEVTIVDNLTTGNRDAVPLGATFVEGDIKDVAENVLSSDSFDAVLHFAARSLVGESVEKPDEYWQHNMVTTLALLDAMKRNNVRNIVFSSTAATYGEPETVPITEDAPTHPTNPYGATKLSIDYAITSYAHAYGFAATSLRYFNVAGAYGLVGENREIETHLIPLVLQVALGHRDKIFMFGDDWPTEDGTPIRDYIHIRDLADAHILALQSNVEGSHRIFNLGSGEGYSVKQVIDTCREVTGHPIPAEVAPRRAGDPAVLIASSAKAQSELGWKPQRTDLHTIVSDAWAFTSQLGDKAHSASRG

SEQ ID NO: 66685 - protein, 339 aa, Glycine max
MASPPHFDDDFDFGGGFSGTQSGNKRPSPDYDEDEYENDPFGHKKAKSKAEEAASGVTTGMILSLRESLQNCKDMLATCQNELEAAKSEIQKWHSSFQNEPFISAGTTPAPKSVINYLQALKSSEESLREQLEKAKKKEAAFIVTFAKREQEIAELKSAVRDLKSQFNPASMQARRLLLDPAVHEEFTRLKNLVEEKDKKVKELQDNIAAVNFTPQSKMGKMLMAKCRTLQEENEEIGNQASEGKMHELAMKLSVQKYQNAELRCQFEGLQKHMDGLTNDVDRSNEMVLMLQDKLEEKDQEIQRLKDELQPKSLVVEDEKTDPASNRNYDETIPTEAAK

SEQ ID NO: 66686 - protein, 342 aa, Candida albicans SC5314
MTSIKHPKPSTVSASSHGIRTPPTVSTSPDLDVNRIPMVTPKPSTNNLPVTTPQPPPAITQSMRNKSGLPDSLPHVKCLARARIPTTQGPDIFLHLYENNIDNKEHLAIVFGEDIRSRSLFKHYPGETQQDRMTRGAYIGRLTPGRTIADSDGTNELKFDKDGNLIIDSLTYTDPTLVRIHSECYTGETAWSARCDCGEQFDEAGRIMGEAGHGCMVYLRQEGRGIGLGEKLKAYNLQDLGADTVEANLILRHPADGRNFSLATAILVDLGLVEIKLLTNNPDKIVAVEGKHQEVKVLERVPMVPLSWGKDGKNGIKSKEIEGYLSTKIERMGHLLEKPIKI

SEQ ID NO: 66687 - protein, 160 aa, Picea sitchensis
MAMAIPVAASTTALQALPSTTSSAQHSAASGSCSSLMRSSTMQVPAVCNLQRSGSIWKSRRSYSNSRNTTNGSRSVVVCAFGDVSSDGTTYLVAGAVAVALLGTAFPILFSRKDLCPECDGAGFTRKTDRTLRANAARKDEAQIVCPRCNGLGKLGQVDK

SEQ ID NO: 66688 - protein, 383 aa, Lactobacillus sakei subsp. sakei 23K
MAEKRDYYDVLGVGRDASDDEIKKAYRKLSKKYHPDINKAPDAEAKFKEVTEAYEALSDPQKRAAYDQYGHAGMNGGFGGGAGAGQGFGGFGGGAEGFGGFDDIFSSFFGGGARQQPNGPRQGSDLQYRMDLKFEEAVFGKETKISYSREAECHTCHGSGAKPGTSAETCHKCHGAGQIQVERQTPLGRMMSRETCDVCGGTGKEIKSKCDTCHGTGREEERHTVKVKVPAGVEDGQQMRLQGQGEAGSNGGPYGDLFIVFRVAPSDEFERDGAQIFVEVPISFVQAALGDEIEVNTVHGPVKLKIPAGTQTNTVFRLRGKGAPKLHGTGNGDQNVTVNVVTPKTLNSKQRDALKAFAVASGDSVNPQDSNLFDKILNKKYKK

SEQ ID NO: 66689 - protein, 193 aa, Prochlorococcus marinus str. MIT 9303
MVVALTMAAMMPGLRPLRHHSLDLRHLIQDIPDFPKPGILFRDISPLLRDPDGWGEVMRQLGDLCTEFKPDLIVGIESRGFIVGTALATNRKIGFVPVRKPGKLPGDVLGIDYSLEYGSDRLEIHADALQGHPRVLMVDDLLATGGTAKATVELIEQAGGDLVGCGFVIELAALGGRQQLPVEIPVKSLIIYS

SEQ ID NO: 66690 - protein, 500 aa, Xanthomonas oryzae pv. oryzae KACC10331
MGVWATLSAQCRSHDCSAERAFRSLQHLRCASASLSPDTCMTDTPRRDDAATLERFGYAQELKRQLTLKDLLIYGLVSMVPTAPFSIFGGVFDISAGMVPLTYLVGFVAMLFTALSYQQMSQAFPVAGSVYAYVGRGLNSGMGFLAGWAILLDYLLVPTLLYVVGANAMYNVVPAVPQPAWIGFFVVLNTVVNLRGIETTARANRFFLLGQLVVLAVFLVLATLAIQRGVNGAHWSWRPIYDPQAFSPHVIFSALSVAVVSFLGFDAISTLSEEARGGNRVVGRATLLALLIVAGVFVLQTWLAALLQPTLQRYPSAQASNDAFFEIGRLIAGPWLQIVIALTVAISAAIANSLVAQAATSRLLFAMARDRQLPAFLRYIHPRTAVPQRAILLVAGLSIVLGEVFVGQIALLSSLCNVGALTAFVLLHIAVLWHFRAQGRRVLHGLAPLIGIVILAYVLLNADTHAQLGGTAWMVVGLTVLAFLKLSGRSTEFRASDAVE

SEQ ID NO: 66691 - protein, 143 aa, Escherichia coli O157:H7 EDL933
MAIERTFSIIKPNAVAKNVIGNIFARFEAAGFKIVGTKMLHLTVEQARGFYAEHDGKPFFDGLVEFMTSGPIVVSVLEGENAVQRHRDLLGATNPANALAGTLRADYADSLTENGTHGSDSVESAAREIAYFFGEGEVCPRTR

SEQ ID NO: 66692 - protein, 357 aa, Oryza sativa Japonica Group
MAAPGACLASRSPPAFLAGGFLAARPAAVSPIPSRSGKSIAPSRRFIVSNKLAWVEDELVEITESQEPSSASSKKRPPLRRGKISPQLPVPEHIPRPSYVGSNRPQELSSVRQIHSAEGIAGMRAACKLAARALDFAGTLIKPSVTTNEIDREVHNMIIEAGAYPSQLGYGGFPKSICTSLNECVCHGVPDSTQLQTGDIMNVDVNVFLNGYHGGASRTFVCGEVDDSIRHFLKAAEECLEKGITVCRDGVNYKKIGKKISKLAYFYGYYVVDRFVGHGIGPIWHSEPLILHHANDNSGRMVEGQTFTIEPILTMEKAETVTWEDGWTTVTADGSWAAQFKHTVLVTRTGAEILTKL

SEQ ID NO: 66693 - protein, 449 aa, Moritella sp. PE36
MSFTDLGLSAPILKAVAEKGYDTPSAIQAQAIPAVLSGRDVMAAAQTGTGKTAGFTLPILEILSQGPRPRANQARTLILTPTRELAAQIAENIEVYSKHLRLTSTVVFGGVKINPQMTRLRRGVDILVATPGRLLDLYNQNAIRFHQLEILVLDEADRMLDMGFLRDIRKILAVLPQKRQNLLFSATFSDDIRQLARGLINDPVEISVTPRNAAAKSVEQWMHPVDKKKKALLLTHLIKENDWKQVLVFTKTKHGANKLTKHLEEQGINAAAIHGNKSQSARTKALANFKSGEVRALIATDIAARGIDIVQLPQVVNFDLPNVPEDYVHRIGRTGRAGSEGTAISLVCHDEMKELVAIEQLTQKHLERVVIDGFAPMDSFPTTPGIRPPKEKKPKKDHQDGQRSGENSRGHKPASKNRRHTGPRSEVNPSANKGNRRRPAGSANNSSNN

SEQ ID NO: 66694 - protein, 450 aa, Ralstonia solanacearum GMI1000
MTPSTTSVFHRDPRKTLPTAVGGESMMLIDAEGKRYLDASGGAAVSCLGHGHPRVVEAICKQVRALAYAHTSFFTTAVAEELAARLAAAAPGDLGHVYFVSGGSEAIEAALKLARQYFVEIGQPQRQYFIARRQSYHGNTLGALAIGGNAWRREPFLPLLVPAHHVSPCFAYRERRDGETDAQYVQRLADELDAKIVELGADRVAAFIAETVVGATAGAVPPVADYFRKIRAVCDRHGVLLILDEVMSGMGRTGHLFACEEDGVVPDLIAIAKGLGGGYQPIGAMIASDRIYDAITRGSGFFQHGHTYIGHATACAAALEVQKVIAEENLLANVLARGEQLRAALRERFAAHPHVGDVRGRGLFVGVELVADRGTKAPLPPARKTHARVRAEAMQRGLMVYPMGGTIDGQRGDHILLAPPFIATAQDIDAIVARLGDAVEAATANALEAA

SEQ ID NO: 66695 - protein, 467 aa, Xanthomonas axonopodis pv. citri str. 306
MSDVLPIILSGGSGTRLWPLSRESYPKQFLPLVGDKSMLQSTWLRAAPVAGHAPIVVANEEHRFMAAEQLQQLGVKPSAILLEPKGRNTAPAIAVAALEATRDGADPLLLVLPSDHVIQNEAAFQAAVTLAATAAEQGKLVTFGIKPTAPETGYGYIKASAGAGASAVERFVEKPDLATAQSYLASGEYYWNSGMFLFRASRYLEELRKFHPAIADACQKAWENGKRDADFTRLDKDAFAASPSDSIDYAVMEKTADAVVVPLDAGWNDVGSWSSLLDVSNQDAQGNAHHGDVIQLDCQNTYAYGSRLIAMVGLEDVVVVETPDAVLVGHRDRIQEVKDVVSQIKTAGRSEATWHRKVYRPWGAYDSIDMGQRHQVKRITVKPGAVLSLQMHHHRAEHWIVVSGTAEVTRGEEVLLLTENQSTYIPLGVTHRLRNPGKLPLELIEVQSGSYLGEDDIVRFEDTYGRA

SEQ ID NO: 66696 - protein, 398 aa, Medicago truncatula
METEKSVAAKIKKVRNDIPNDLVFSILSKLPVKSLNRFGCVRKSWSILFKNRYFMSMFRKNLLCKNHSYYKDTSLLQLETVTIDSELKFVLYSLSGERYQNKTKLDWPNLFEEADPEFDVVGSGSINGILCLVSKSQPNNRVVFWNPTTDEFKIVPISLRESVRHVDVEITRHGFGYVSIADEYKLIRQVMYNPKSDTDDSSLEDVSYDLFWEIYSLRSNSWRELHSDVPYDYREDGICLDGMCHWLGEDGYDIDRVDEVYLLSFDLSKEAFLITPIPSECDSRIFQMAWKDLVVLNGFIALISHYKQNDTFHISILGEIGVKESWTKLYIVCPLPCIERPITSGNKRYIISNVVDGTLVCIDLSTLMVEQLNFEGYRFWGKTIIYKQSSLPIGGINQ

SEQ ID NO: 66697 - protein, 291 aa, Xylella fastidiosa Ann-1
MSKALFTRWCQRTDSYLERTLSIPTQAPQRLHAAMRYTVLSGGKRIRPLLVYAAGHLFHVDEPLLDVPAAAVELIHAYSLVHDDLPAMDDDLLRRGRPTVHIAFDEATAILTGDALQTLAFECLADAPADTSLRIAWLQTLTHAAGVAGMCGGQALDIDATGQSQTLKALEVMHALKSGTLMRAAVRMGALAGDPSAEDLHSLDTFAATLGLAFQVRDDILDIESSSEQLGKTAGKDAIQQKSTFPALLSVEGAKCYLQELAERLYTQLHPYGERAAPLTALARLAVERAH

SEQ ID NO: 66698 - protein, 388 aa, Xanthomonas axonopodis pv. citri str. 306
MKIAVAGTGYVGLSNGVLLARHHEVVALDIVESKVKLLNEGRSPIVDKELEAALAQGGLNFKATLDANEAFAGAEFVIIATPTDYDPDTNYFNTGSIEVVIAKVLEINPQATMVIKSTIPVGYVAKVRAQFGTDNIIFSPEFLREGRALYDNLYPSRIIVGERSARAETFARLLQQGALKPDVPVLFTEPTEAEAIKLFANTYLAMRVSYFNELDTYALTHGLDSRQIIEGICLDPRIGSHYNNPSFGYGGYCLPKDTKQLLANYQSVPQTIIRAIVDSNTTRKDFIAADVLRRNPKVVGIYRLIMKAGSDNFRSSSIQGVMKRLKAKGVDVIVYEPTLKDPEFFRSRVVNDLQAFKREADVIISNRMAEALQDVQDKVYTRDLFGDN

SEQ ID NO: 66699 - protein, 416 aa, Oryza sativa Japonica Group
MYVPQPSRSDAAGRDAGDQPRVYQVWRGSNEFFLRGRFIFGPDVRSIFLTMFLIVAPVVAFCVFVARHLIDDFPGDWGISVMVVVVVFTVYDLTLLLLTSGRDPGIIPRNTHPPEPEGFDGSNDSGVQTPQQLRLPRTKDVIVNGISVRIKYCDTCMLYRPPRCSHCSICNNCVERFDHHCPWVGQCIGLRNYRFFYMFVFSTTLLCLYVFAFCWVYIIKIRNAESLSVWKAMLKTPASIVLIIYCFLCVWFVGGLSVFHCYLMSTNQTTYENFRYRYDRRANPYNRGVLNNFLEIFCSRIPPSKNNFRARVTVEQGLQQTRVASRGFMSPNMGKPVGDLEMGRKPVPWDEPRTAADIRDLEAGLGGFLDEKEGRLTHASPDLSRDDLPADLMKGRAGTHSRRSSWVNRTGTSESE

SEQ ID NO: 66700 - protein, 410 aa, Propionibacterium acnes KPA171202
MYTYTTFAAYFEDQFFSPDDPHKSIYIYAIFWATFIMRPFGSWFFGRWADRHGRRSALTMAVTIMAVGSLVISVLPTRGTIGVGAPILLLICRIVQGFATGGEYGTSATYMSEASTKGHRGFFSSFQYFTLVGGLVTAQAVLLLLSSLMSEATIHVWGWRIPFFIGGVAALIVFFMQKTMDESLSTEHLKSVRSGEDSSSGSLKELFENHLGNFLLAFTIASGGTLCFYVYTVNAPNIVHSTFSSTPMAATAVNLIALFILMLGQPLGGLIGDRIGRKPVLLFFAAGGVVYTWVLVTCLSHARKPVTAFLMLLMGYIFLTGYTSISAVVKSDLFPTDVRALGVGMAHGFANSLFGGTAPLIYVWAKQGDAIPAFIGYVTALSAVTFLTILFGLTTRTASHLDAPTKGGHD

SEQ ID NO: 66701 - protein, 557 aa, Vibrio vulnificus YJ016
MMFGDRFNDINLKGDLFGGVTTAIISLPLALAFGVASGAGAEAGLWGAILVGLFAALFGGSSTLISEPTGPMTVIMTAVLTSMVAKYPESGIAISFTIVMMAGAFQVLIGTLKLGKYITLMPYSVVSGFMSGIGVILIILQLSPLLGHAAPAGGVLGTLSALPETISNMKFSEFFLGLLTLGILFFFPKQYRKYVPAQLVALVAVTLLSVIIFDFDDVRRIGEIPTGLPSLVVPVINGEIFTAMVIDALVLGTLGCIDTLLTAVIGDSLTRKEHDSDKELRGQGFANMISGLFGALPGAGATMGTVTNIQVGARSPLSGVIRALILALVVLVASGLTEPIPMAVLAGIAVYVGFGILDWSFIQRAHRVSVQGMAIMYGVMLLTVFVDLIVAVGLGVFISNILIIERLSREQAKQVKAISDADENDVPLTDSERGLLDRANGKVLFFYLSGPMIFSVSKAISRQHSSISDYEAMILDLTDVPMIDVTVGLALENAIKDAQEAQCDVYLLCPNERVREQLEKFHVLDLVPDENTFKFRYEALNAAVNKVEQDEHQGAFV

SEQ ID NO: 66702 - protein, 395 aa, Thermoanaerobacter tengcongensis MB4
MNLSQNALQITPSMTLEITAKAKQLKAQGVDVIDFGVGEPDFDTPSYIKEAAIDAIKRGYTKYTPSSGIPELKKAICEKLLKDNGLSYTPEQIVVSNGAKHSIYNALSAILNPGDEVIIPVPYWLSYPEMVRLAYGKPVFVHTKEENDFKITAEELENAITPKTKAIILNSPNNPSGAVYTKEELEEIARVVEEANIFVISDEIYEKLIYEGEHVSIASFGEKIKELTIVVNGISKAYAMTGWRIGYTASSLEVAKVMSNIQSHTTSNPNSIAQYASVAALQGGEEEIEKMKEEFNRRRLYMVERVNKIKDLKCSTPKGAFYVMVNIEKYIGRELNGKTINGSLDFASALIDGANVAVVPALPFGMDNYIRMSYATSLENIKKGLDRIEDFLSKS

SEQ ID NO: 66703 - protein, 790 aa, Vibrio sp. Ex25
MQKNTLWFNGLSMDDVDKVGGKNASLGEMVSNLANAGVSVPNGFATTSYAFNQFLDHEGLDERIHQLLDELDVEDVEALRKTGATIRQWVLEAPFPADLEQEIRENYQELIEGNPELSVAVRSSATAEDLPDASFAGQQETFLNVKGIDAVLEATKHVYASLFNDRAISYRVHQGFDHRGISLSAGIQRMVRSDKASSGVMFTLDTESGFDQVVFITSSWGLGEMVVQGAVNPDEFYVHKPMLEAGEHPIVKKTFGSKLIKMIYSDNQEIGKQVDIVDTSDEERNTFSLNDEEIKELAKQAMIIEKHYQRPMDIEWAKDGIDGKLYIVQARPETVCSQTEQNVIERYELQNKADVLIEGRAIGQRIGKGAVRLVDSLDQMSLVQEGDVLVTDMTDPDWEPVMKKASAIVTNRGGRTCHAAIIARELGIPAIVGCGDATSKLTDGATVTVSCAEGETGYVYQGELEFDVKRSSVDELPLLPTKVMMNVGNPDRAFDFAQIPNEGVGLARLEFIINKMIGIHPKALLNFDAQSDELKAEIKQRIRGYKDPIDFYVSKLTEGIATIASAFWPKRVIVRMSDFKSNEYSNLVGGKAYEPHEENPMLGFRGASRYISPVFEDCFELETQAIKRVRNEMGLKNVEIMIPFVRTPSEAASVIDLLAKFDLRRGDQGLKVIMMCELPSNAVLADEFLKYFDGFSIGSNDMTQLTLGLDRDSGDVAHLFDERNAAVKIMLKMAIDAATKAGKYVGICGQGPSDHEDLAEWLMEQGISSVSLNPDTVIDTWLQLGKVSSK

SEQ ID NO: 66704 - protein, 154 aa, Chlamydomonas reinhardtii
MPPPGNAPTAPAVPGALPASTEQVLNGLAEAPLVVPPQLVQYYMRKSGQGPILYNMSADDREANEDMRLTQVVSLASQRFLATVLNDAMQYHKMKRGAGPKAMKEAGLDPKDKRRVLRTEDLAAALQQEYGVNIRNPPYYVDARDKDQAAAGRR

SEQ ID NO: 66705 - protein, 92 aa, Glycine max
ARELDLETTESVAQTWTAGSRRFIGEPIFVPKGYQEDDGYLLVVEYAVSMNRCYLVILDPKRIGADNALVARIEIPSHLNFPLGFHGFWAAN

SEQ ID NO: 66706 - protein, 475 aa, Vibrio vulnificus YJ016
MSKEIKAQVVVLGAGPAGYSAAFRCADLGLDTVLIERYNTLGGVCLNVGCIPSKALLHVAKVIEEAKALAEHGIVFGEPQTDIDKIRLWKEKVINQLTGGLGGMAKMRKVNVVNGFGKFTGPNTIEVEGEDGKTVVNFDNAIVAAGSRPIKLPFIPHEDPRIWDSTDALELKEVPGKLLIMGGGIIGLEMGTVYHSLGSQIDVVEMFDQVIPAADKDIVKVYTKRISKKFNLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKAEGINYEVATFPWAASGRAIASDCADGMTKLIFDKETHRVIGGAIVGTNGGELLGEIGLAIEMGCDAEDIALTIHAHPTLHESVGLAAEVFEGTITDLPNAKAKKKK

SEQ ID NO: 66707 - protein, 631 aa, Vibrio vulnificus YJ016
MAIEINVPDIGADEVEVTEILVSVGDKVEEEQSLITVEGDKASMEVPASQAGIVKEIKVVAGDKVTTGSLIMVFEAEGAAAAAPAPAVAPVAAPAAASELKEVCVPDIGGDEVEVTEILVAVGDSIAEEQSLLTVEGDKASMEVPAPFAGTLKEIKVAAGDKVSTGSLVMVFEVAGSGAAAPAPVAAAAPAAAPAAVSGVKEVNVPDIGGDEVEVTEIMVAVGDTVSEEQSLITVEGDKASMEVPAPFAGTVKEIKVAAGDKVSTGSLIMVFEVAGAAPVAAAAPAQAAAPAPAAAPAPAVAPVAKAEAQATTSDFKENDEYAHASPVVRRLAREFGVNLSKVKGSGRKSRILKEDVQAYVKDALKRLESGAVAAASGKGDGAALGLLPWPKVDFSKFGETEVQPLSRIKKISGANLHRNWVMIPHVTQWDNADITELENFRKEQNAIEAKKDSGMKITPLVFIMKAAAKALEAFPAFNSSLSEDGESLILKKYVNIGIAVDTPNGLVVPVFKDVNKKGIYELSEELMVVSKKARAGKLTAADMQGGCFTISSLGGIGGTAFTPIVNAPEVGILGVSKSEIKPVWNGKEFAPRLQLPLSLSYDHRVIDGAEGARFITYLNECLSDIRRLVL

SEQ ID NO: 66708 - protein, 183 aa, Arabidopsis thaliana
MSGNKEEEDPRIHGIKTKIRVVPDFPKKGIMFQDITTVLLDPKAFKDTIDLFVERYRDKNISVVAGIEARGFLFGPPIALAIGAKFVPLRKPKKLPGETIFEEYELEYGNDRLEMHIGAVEAGDRSLVVDDLIATGGTLCAAINLLERVGAEVVECACVIELPELKGRQRLKGKPLCMLVEYR

SEQ ID NO: 66709 - protein, 449 aa, Clostridium symbiosum
SKYVDRVIAEVEKKYADEPEFVQTVEEVLSSLGPVVDAHPEYEEVALLERMVIPERVIEFRVPWEDDNGKVHVNTGYRVQFNGAIGPYLGGLRFAPSVNLSIMKFLGFEQAFKDSLTTLPMGGAKGGSDFDPNGKSDREVMRFCQAFMTELYRHIGPDIDVPAGDLGVGARELGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVSGFEMSQNSERLSWTAEEVDSKLHQVMTDIHDGSAAAAERYGLGYNLVAGANIVGFQKIADAMMAQGIAW

SEQ ID NO: 66710 - protein, 138 aa, Triticum aestivum
  misc_feature (62)..(62): Xaa can be any naturally occurring amino acid
  misc_feature (88)..(88): Xaa can be any naturally occurring amino acid
  misc_feature (104)..(104): Xaa can be any naturally occurring amino acid
GDGSFQVTAQDVSTMLRCEQNSIIFLINNGGYTIEVEIHDGPYNVIKNWNYTGFVDAIHNGXGKCWTSKVKSEEELTAAIETALGEKXDCLCFIEVIAHKDDTXSKELLGMGSRVSAANPRPPNPQLNPRRLQASGCH

SEQ ID NO: 66711 - protein, 1214 aa, Nicotiana benthamiana
MKPHKSALYQHHCSLKKIFLLSFYLQPLFILLLIIFFLPPASPASVNGLLKDSQQLLSFKSSLPNTQAQLQNWLSSTDPCSFTGVSCKNSRVSSIDLTNTFLSVDFTLVSSYLLGLSNLESLVLKNANLSGSLTSAAKSQCGVSLNSIDLAENTISGSVSDISSFGPCSNLKSLNLSKNLMDPPSKEIKASTLSLQVLDLSFNNISGQNLFPWLSSMRFVELEYFSLKGNKLAGNIPELDYKNLSYLDLSANNFSTGFPSFKDCSNLEHLDLSSNKFYGDIGASLSSCGRLSFLNLTSNQFVGLVPKLPSESLQFMYLRGNNFQGVFPSQLADLCKTLVELDLSFNNFSGLVPENLGACSSLELLDISNNNFSGKLPVDTLLKLSNLKTMVLSFNNFIGGLPESFSNLLKLETLDVSSNNITGVIPSGICKDPMSSLKVLYLQNNWLTGPIPDSLSNCSQLVSLDLSFNYLTGKIPSSLGSLSKLKDLILWLNQLSGEIPQELMYLKSLENLILDFNDLTGSIPASLSNCTNLNWISMSNNLLSGEIPASLGGLPNLAILKLGNNSISGNIPAELGNCQSLIWLDLNTNLLNGSIPGPLFKQSGNIAVALLTGKRYVYIKNDGSKECHGAGNLLEFGGIRQEQLDRISTRHPCNFTRVYRGITQPTFNHNGSMIFLDLSYNKLEGSIPKELGSMYYLSILNLGHNDLSGVIPQELGGLKNVAILDLSYNRLNGSIPNSLTSLTLLGELDLSNNNLTGPIPESAPFDTFPDYRFANTSLCGYPLQPCGSVGNSNSSQHQKSHRKQASLAGSVAMGLLFSLFCIFGLIIVAIETKKRRKKKEAALEAYMDGHSNSATANSAWKFTSAREALSINLAAFEKPLRKLTFADLLEATNGFHNDSLIGSGGFGDVYKAQLKDGSVVAIKKLIHVSGQGDREFTAEMETIGKIKHRNLVPLLGYCKVGEERLLVYEYMKYGSLEDVLHDRKKNGIKLNWHARRKIAIGAARGLAFLHHNCIPHIIHRDMKSSNVLLDENLEARVSDFGMARLMSAMDTHLSVSTLAGTPGYVPPEYYQSFRCSTKGDVYSYGVVLLELLTGRTPTDSADFGDNNIVGWVRQHAKLKISDVFDRELLKEDPSIEIELLQHLKVACACLDDRHWKRPTMIQVMAMFKEIQAGSGIDSSSTIAADDVNFSAVEGGIEMGISESIKEGNELSKHL

SEQ ID NO: 66712 - protein, 421 aa, Synechococcus elongatus PCC 6301
MLTLNSPFGEEAPMLFAAIAVPIQAPLPAMALLLMTALFLPPLFRALKLPELLGLILAGVLLGPSLFNILEPKADTVVLLAGIGKLYLMFLAGLEIDLSQFQAARDRSLRFGFATFAIPLLVGLLIGLGFGFGWNSAFLIGSLLASHTLLTLPIVEHYGLLRQRAVAATLGATIFTDIGALLVLAVCLAVQSGDGGLIAIVRDLLIFSVFITLVLYGVKPLSRWFFRLAHNNERNQFLFIFLVLLLVSLGAQAIQLDMIIGAFLAGLAVNETLQDEPVREKVDFFGKVMFLPCFFIDIGLLLNPAAFWETLTTAGSLTFAIVGGLFGSKFLAAIAVKQWEGYSWPEVRLMWSLSLPQVAATLAAAQAGLQAQLLSPAVFDSIIALVLITVLVGPLLTDRFAQQICSVPKREGRSAPVPSLD

SEQ ID NO: 66713 - protein, 416 aa, Chlamydomonas reinhardtii
MGACCSQPSEKYEVQGQSSKPKPATGSGAKAAAKQPATPDFGLQTTHEVIKLLGRGGEGETWLCRDKETNAEVAIKLIKRPIPKPAIQVIKREIKIQADLGQGHLNIVSADEVILSKTYLGLIMEYVPGGNMVSYVTKKRETKSERAGLCIDEDEARYFFIQLVSAVEYCHRNNVAHRDLKLDNTLLDNHVPSWLKLCDFGFAKHWQANSNMDTMRIGTPEYMGPELISSRTGYDGKKVDVWAAGVLLYVMLVGMFPFETQDDNFNNTAGLYDIWLQQIKTSWREVPNNTSAASRLTPELKDLLDKMFDVKQESRASIETIKNHPWFKKPLPEPYESSLKELQEEQRSIDEQVSKGAFQSAERDKALEALLDRAVTPSLPSEEVTRLSLSKIKRAYSILKGKGNAGAGMAAVVEED

SEQ ID NO: 66714 - protein, 362 aa, Synechococcus elongatus PCC 6301
MTAGSPRRSLPPALRKVVIGGLFFLATQAIAILGYWLSGWSLLDAIYMVVITIFGVGYGEVRPINTPALRIFTIFVILAGTSSAVYLIGGLAQLVTEGEIRRALGVRRMTREIRTLQRHVIVCGFGRIGQTLARKVTEASLPVIVIDTDETRIRQAEEQGFLALRGSATDEAILIDAGVERAATIATALPDDAANVFITLTARGLNPNLTIIARGELPATEKKLLQAGADRVVLPATIGALRMAHLITHPAALNLLESSDSHQTLNELLGELDIQMDELAIAPQSPLIGHRLGAIEVSGKGAFIIVALRRATGEMILRPGSDLFLHAGDTLIVIGHSGDLPRFAKHYALQRQVQYRGVRQRS

SEQ ID NO: 66715 - protein, 436 aa, Corynebacterium glutamicum
MSETYVSEKSPGVMASGAELIRAADIQTAQARISSVIAPTPLQYCPRLSEETGAEIYLKREDLQDVRSYKIRGALNSGAQSPQEQRDAGIVAASAGNHAQGVAYVCKSLGVQGRIYVPVQTPKQKRDRIMVHGGEFVSLVVTGNNFDEASAAAHEDAERTGATLIEPFDARNTVIGQGTVAAEILSQLTSMGKSADHVMVPVGGGGLLAGVVSYMADMAPRTAIVGIEPAGAASMQAALHNGGPITLETVDPFVDGAEVKRVGDLNYTIVEKNQGRVHMMSATEGAVCTEMLDLYQNEGIIAEPAGALSIAGLKEMSFAPGSVVVCIISGGNNDVLRYAEIAERSLVHRGLKHYFLVNFPQKPGQLRHFLEDILGPDDDITLFEYLKRNNRETGTALVGIHLSEASGLDSLLERMEESAIDSRRLEPGTPEYEYLT

SEQ ID NO: 66716 - protein, 173 aa, Blastopirellula marina DSM 3645
MKPIQLEDYIRDITDFPKPGILFKDITPLLADPTAFEAAIDKMAAHYQGKKIDVIVAAEARGFIFAAPLPLKLGVGFVPVRKPGKLPFSTHSFQYELEYGTDTLEIHIDGVSEGQNVLLVDDLLATGGTIKACANLVERIGATVAGCCFLIELKFLDGAAKVAPHECFSLIEY

SEQ ID NO: 66717 - protein, 315 aa, Corynebacterium glutamicum
MSDAPTVVAYLGPAGTFTEEALYKFADAGVFGDGEIEQLPAKSPQEAVDAVRHGTAQFAVVAIENFVDGPVTPTFDALDQGSNVQIIAEEELDIAFSISVRPGTSLADVKTLATHPVGYQQVKNWMATTIPDAMYLSASSNGAGAQMVAEGTADAAAAPSRAAELFGLERLVDDVADVRGARTRFVAVQAQAAVSEPTGHDRTSVIFSLPNVPGSLVRALNEFGIRGVDLTRIESRPTRKVFGTYRFHLDISGHIRDIPVAEALRALHLQAEELVFVGSWPSNRAEDSTPQTDQLAKLHKADEWVRAASEGRKLN

SEQ ID NO: 66718 - protein, 60 aa, Oryza sativa Japonica Group
MIDVTFLFYLQDNLVEDLLSDFEYELQPPYLLYRNAAQEVNGIWFYNQHDCEAVASLFGR

SEQ ID NO: 66719 - protein, 181 aa, Zea mays
MVVTVAATGSDTAEPLHSTTFASRYVRDQLPRYRMPEGSIPKEAAYQIISDELMLDGNPRLNLASFVTTWMEPECGKLMMDSVNKNYVDMDEYPVTTELQNRCVNMIAHLFNAPIGEDETAIGVSTVGSSEAIMLAGLAFKRKWANKMKEQGKPCDKPNIVTGANVQVCWEKFARYFEVEL

SEQ ID NO: 66720 - protein, 517 aa, Streptococcus thermophilus LMG 18311
MLIRRKSDNKYKGVLYIMNKRVKIVATLGPAVEIRGGKKFGEDGYWSEKLDPDASAKNIAQLIEEGANVFRFNFSHGNHAEQGERMDVVRMAESIAGQKVGFLLDTKGPEIRTELFEGDAKEYAYKTGEQIRIATKQGLKSTRDVIALNVAGALDIFDDVEVGKQVLVDDGKLGLRVVDKDAEKREFIVEVENDGIIAKQKGVNIPYTKIPFPALAERDNADIRFGLEQGINFIAISFVRTAKDVQEVRAICEETGNGHVKLLAKIENQQGIDNIDEIIEAADGIMIARGDMGIEVPFEMVPVYQKMIITKVNAAGKIVVTATNMLETMTEKPRATRSEVSDVFNAVIDGTDATMLSGESANGKYPVESVRTMATINKNAQTLLKEYGRLNSSTFDRSSKTEVVASAVKDATNSMNIKLIVALTESGNTARLISKYRPEADILAITFDELTQKSLMLNWGVIPVVTETPSSTDDMFEVAERVALESGLVESGDNIVIVAGVPVGSGNTNTMRIRTVK

SEQ ID NO: 66721 - protein, 610 aa, Oryza sativa Japonica Group
MDKGALVVQVMDDSSNGGVGAAAAGGSFSSLRAYGRALAQTPRRLARRACAATSPGEEMSRVRARSGARMARRLRWHDLVGLGLGGMVGAGVFVTTGRATRLYAGPGVVVSYAIAGLCALLSAFCYTEFAVDMPVAGGAFSYLRVTFGELAAFLTGANLIMEYVFSNAAVARSFTAYLGTAVGVDAPSKWRIAVPGLPKGFNEVDLIAVGVILLISVCICYSTKESSVVNMVLTAVHVAFILFIIVMGFWRGDTRNLTRPVDLAHNPGGFFPHGAAGVFNGAAMVYLSYIGYDAVSTMAEEVERPSRDIPVGVSGSVVLVTLLYCLMAASMSMLLPYDAIDTEAPFSGAFKGSSGWGWVSNVIGAGASLGILTSLMVAMLGQARYLCVIGRSGVMPAWLAKVHPCTATPVNASAFLGVFTAALALFTELDVLLNLVSIGTLFVFYMVANAVVYRRYVAADDDDADHRRAWPTLVFLAAFSLVALCFTLLWQFAPAGRARTGLLAACGAAAVATVGAFRALVAEARRPELWGVPAMPWVPAASVFLNVFLLGSLDRPSYVRFGFFTAAAVLVYVLYSVHASYDAEEGGGAGAGAAALDGAKVQDEAADFKV

SEQ ID NO: 66722 - protein, 128 aa, Escherichia coli O157:H7 EDL933
MAYSEKVIDHYENPRNVGSFDNNDENVGSGMVGAPACGDVMKLQIKVNDEGIIEDARFKTYGCGSAIASSSLVTEWVKGKSLDEAQAIKNTDIAEELELPPVKIHCSILAEDAIKAAIADYKSKREAK

SEQ ID NO: 66723 - protein, 370 aa, Glycine max
MSNDKDTFNVADLTSALNEDNRADLVNALKSKIQSLAGQHSDILESLSPNVRKRVEVLREIQGQHDELEAKFFEERAALEAKYQKLYQPLYTKRYEIVNGATEVEEGAVKETTPDGEEDQEKGVPAFWLTAMKNNEVLAEEISERDEGALKYLKDIKWSRIENPKGFKLEFFFDTNPYFINSVLTKTYHMIDEDEPILEKAIGTEIQWHPGKCLTQKILKKKPKKGSKNAKPITKTENCESFFNFFNPPQVPEDDEDIDEDAAEELQNQMEQDYDIGSTIRDKIIPHAVSWFTGEAIQGDEFGDLEDDEDDEDIEEDDDEEEEEDEDDDDDEDDEEESKTKKKSSAPKKSGRAQLGDGQQGERPPECKQQ

SEQ ID NO: 66724 - protein, 275 aa, Xylella fastidiosa Ann-1
MQKPAVNIMVKAARSAGNVLLRHINKLETLHVIQKSRMDYASDVDEMAEKVIVKELKRAYPDYGILGEEGGLQGNHRIMWVIDPLDGTSNYLRGFPHYCVSIALVENGEPTDAVIFDPLRNELFTASRGVGAVLNERKIRVANRKDLNGTILNTGFSPRERSRAHAQLKCVDALLMQAEDIRRSGSAALDLAYVACGRADAYFEAGIKVWDVAAGMLLVREAGGYVCDFKGADTPRMDDKGPESCQLVAGNIKVARALQQVIVSSGYGREFDSKR

SEQ ID NO: 66725 - protein, 273 aa, Propionibacterium acnes KPA171202
MSVPSITLNDGVAIPQLGFGTWKVPANEAEKAVSAALEAGFRHIDTAAIYGNEEGVGRALADSGLDRKDLFVTTKLWNSSHHADDARKAIETSLTKLGLDHVDLYLIHWPAPVKYGDAYIEAWNALQDFKSEGLTRSIGVSNFKTEHLDAIEGATPSVDQIEMHPSFNQATFRAELAERGINPEAWSPLGQSKDLDNPVLTDISKATGKTPAQVVIRWHLQIGNVVFPKSVTPSRIAENFDVFDFELSDEQIAAIDGLDHGNRLGGDPSTADF

SEQ ID NO: 66726 - protein, 263 aa, Zea mays
MAPGGSGERWSLAGATALVTGGSKGIGQAVVEELARLGARVHTCARSAADLEECRRRWAEKGLRVTVSVCDVAVRADRERLVLDTVSGAFDGKLDILVNNAALLLLKPAAEWAAEDYARIMATNLESCLHISQLAHPLLLNASVAGGASIVNVSSIASVLGFPQEVMYSVTKGGLNQMTRSLAVEWACDRIRVNCVAPGVIMTDMGKELPAALVEQERSRIPLRRTGEPEEVASLVSFLCMPAASYVTGQVIFVDGGRTISGA

SEQ ID NO: 66727 - protein, 178 aa, Thermoanaerobacter tengcongensis MB4
MNLANKLTMSRLFLIPVFMVFMLVKIPYGDFIAASIFAIGALTDKLDGYIARKYKQITNFGKFMDPLVDKIMVTSALIALVQMGRIESWIVIVIIAREFLITGIRTVAADKGIVIAASNYGKYKTTSQMIAVIALMLNNYPFSLVNFPFDKIMVYIALILTIYSGVDYIVKSKDLFKD

SEQ ID NO: 66728 - protein, 560 aa, Propionibacterium acnes KPA171202
MPTLIDATSTPAWGTLSGLKSRFADGPHKLRRLFDADPHRAERYTLDVADLHVDLSKNLLTDEIRDALLELAAQMRVTERRDAMYAGEHINVTEDRAVLHTALRRSRTDELHVDGQDAVADVHEVLDKIYAFADKVRSGEWKGVTGKPIRTVINVGIGGSDLGPVMAYEALKPYVKDGLECRFISNIDPTDAAVKTADLDPETTLVIIASKTFTTLETLTNARCVRAWLLDGLVAAGAISDTEQARRDAVAKHFVAVSTALDKVEEFGIDPVNAFGFWSWVGGRYSVDSAVGTSLAVAIGPKGFEDFLAGFHAVDEHFATAEPERNVPLFMGLLNIWYTNFWDAHSHAVLPYSQYLHRFPAYLQQLTMESNGKSVRWDGSAVTTDTGEIFWGEPGTNGQHAFYQLIHQGTRVIPADFIAVANPVHPTKDGGTDVHELFLSNFFAQTAALAFGKTADEVRAEGTDEAIVPARVFAGDRPTTSIMADELSPKVLGELIALYEHITFVQGVVWGIDSFDQWGVELGKKLALQIAPAVSGNDEALATQDPSTQGLVTWYREHRR

SEQ ID NO: 66729 - protein, 274 aa, Zea mays
MAERGGERGGERGGFGRGFGRGGRGDRGGRRGGRRGPRQEEEKWVPVTKLGRLVKENKITKIEEIYLHSLPVKEHQIVETLVPGLKDEVMKITPVQKQTRAGQRTRFKAFVVVGDCDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWSQTKFSMAPFQQYTDLLAKPTKGLVLEAPTETVEA

SEQ ID NO: 66730 - protein, 356 aa, Clostridium acetobutylicum ATCC 824
MHKKLFIPGPVEVAEDVLQKMAEPMIGHRSKEASSLQRGISDKLRIVFQTKEEILLSTSSGSGLMEGAIRCCTAKRAAVFSIGAFGKRWYEMAIDNRVPADLYEVEWGEAIKPEFVDEVLGTGKYDLIALTHNETSTGIMNPVGEIAKVIKKYPEVVWCLDTVSSMGGTNIPVDELGVDVCITSSQKALGLPPGLAACSFSKKAIERARNVEHRGYYLDLLKLYEFIQKKDYQYPSTPSLSHMFALDYALNKMLEEGMDNRYKRHIEMAEYVRAWARKNFEIFGDEDNLSNTVTTIKNTRGISVADLNKELGKRGFAISNGYGKLKEKTFRIAHMAEFTLDDIKELIENINDILKL

SEQ ID NO: 66731 - protein, 398 aa, Thermoanaerobacter tengcongensis MB4
MKILVQKFGGTSVSSEEKREKAVSKVIEAVKNGYNVVVVVSAMGRNGDPYATDTLINMAKSIYSDIPKRELDLIMNCGEIISSVLFAATLSNKGYKAKALTGGQAGIITDDNFGNAEVINVDPSRILEVLREGIIPVVAGFQGITQKGELTTLGRGGSDTTAALLGVALKAEAVEIYTDVDGIMTADPRIVSTAHIIDKISYNEVFQFAEQGAKVVHPRAVEIAMRGNIPLIIKNTMSDSGGTIITNYSDAYDSIYEVDKLVTGIANMNNRVQITIESTENVQDIFEKIGEEKISIDLISIFPDKQVFTISEADFEKLRRLFEKYGVKYSYRTNCAKVSIIGNRIRGVPGVMARVIKALSKRNIEIYQTADSHNTISCLVSQDKVEEAIRVLHDEFSL

SEQ ID NO: 66732 - protein, 485 aa, Gossypium hirsutum
MPDSEPIFLLLPSILSLILFFILIKRKQRRYNLPPGNMGWPFLGETIGYLRPYSATSVGEFMHQHISRYGNIYKSNLFGEKTIVSADAGLNKFILQNEGRLFECSYPRSIGGILGKWSMLVLVGDMHRDMRIISLNFLSNARLRTHLLREVEKHTLLVLNTWKEKCIFSAQDEAKKFTFNLVAKNIMSMDPGHPETEQLKKEYVTFMKGVVSAPLNLPGTAYRKALQSRSTILKFIEKKMEVRIRKMKEGKENSEEDDLLEWVLKHSNLSTEQILDLILSLLFAGHETSSVAITLAIYFLPGCPLAIQQLREEHLEVARAKNQSGETELNWDDYKKMEFTQCVINETLRLGNVVRFLHRKALKDIRYKGYDIPCGWKVLPVIAAVHLDPCLFDHPQLFNPWRWQQNNGSRGAGTATSSASSSNYFMPFGGGPRLCAGTELAKLEMAVFIHHLVLNYQWELADTDEAFAFPFVDFPKGLPIRVFKS

SEQ ID NO: 66733 - protein, 304 aa, Brassica napus
  misc_feature (277)..(277): Xaa can be any naturally occurring amino acid
MAGLLAWAADVVGKNERNGGDEEEDQIPLVVTEEQQRYVDELGRKATTLSRSIQDLRLRLPPPDISQRLPHLLAHSLASNAALALQLDSHSATREQAQVREQTLLEENSAYENAISICEARIEEKTHEADSLLRKLKELEDVEESLKAEQEDAQASLDERYYKSSSESRVPPADDTEAVKSVMLEKLESKKNDLSSMEEKVQELERSWAAIQERALKQPSPAQREKTLDKQLHTLIEQLAAKQAQAEGIVGEIHSDEMELERLNSLCRRYESFNTEXLALRNGVKNTEYKEYDDCQMRFLELLQ

SEQ ID NO: 66734 - protein, 640 aa, Arabidopsis thaliana
MTMMMSDLPNDLVEEILSRVPITSLGAVRSTCKRWNGLSKDRIVCKGDANQQFTGFTRYVNESTVCSMRLDLNEIQNEDVELVELSINKINKFIELELFQVYYSDGLLLLVTDEVDSKIVVWNPYLGQTRLIQCRDTEHFKYRYALGYDNNRNHKILMYNRKNCEIYDFKSDSWKVLDIIPDLHTNIYVRDMSIKGNTYFFYRGEKIGEGLAGCLLSFDFTRERFVSCLPLPFQIAKFDDNVALSSVREEHLVVLFNNWEESEMEIWVTTKIEPNAVSWSNFLTFTHFRIKFLVTSFFIDQEKKLAVVFGRSLSKQMRCNIAYVIGDNGYLRILDFGVTFIPSNLPVSYAPSLVKITQGQELSVIEEKKRSRLLASLVYTSNNLLGLMSWVSFSMQFHMDCGRDSARDHDRERSKNPDFHLKTTMMISDLPEDMVEEILSRVSIISLGALRWNDLSKARVICKAEARQQFAGFMIKGSKEVSNTRLVVWNPYLGKIWSIQHRSAYHSENRYTLGYDNNRKPQNLEEQLAVLLHNWGAFAMEIWVTTNIEPNAKKHAVIFDSSLSCGSVACIIGETGNLRTVDLGVAAVPYRQLPVCSYAPSLEQINQGQELPLIGLTQIFMEQHKYWVSTFLDNLITKYG

SEQ ID NO: 66735 - protein, 585 aa, Bacillus licheniformis ATCC 14580 [sequence omitted]

SEQ ID NO: 66736 - protein, 480 aa, Physcomitrella patens subsp. patens
MVKICCIGAGYVGGPTMAMIALKCPDIEVVVVDISKPRIAAWNSDDLPIYEPGLDEVVKQCRDKNLFFSTEVEKHVAEADIVFVSVNTPTKTRGLGAGKAADLTYWESAARMIADVSKSDKIVVEKSTVPVKTAEAIEKILTHNKKGINFQILSNPEFLAEGTAMEDLDKPDRVLIGGRETPGGQKAVAALKAVYAHWVPEDRIITTNLWSAELSKLAANAFLAQRISSINAMSALCESTGADVNEVAYAIGKDSRIGPKFLNASVGFGGSCFQKDILNLVYICECNGLLEVAHYWKQVVSINDYQKTRFVKRVVSSMFNTVSGKKIAVLGFAFKKDTGDTRETPAIDVCHGLLGDKALLSIYDPQVTEEQIKRDLAMNKFDWDHPQHLQPQSPTAFKQVSVVWDVYEACKDAHGICVITEWDEFKKLDYQKIYDNMQKPAFLFDGRNVLNVEEMRKIGFVVYSIGKPLDPWIKDLQVSI

SEQ ID NO: 66737 - protein, 114 aa, Brassica napus
MGGVTSSIAAKFAFFPPTPPSYAFITDVSSSSSVDRLYITDVPRRDDVDVLKLRTRRGNEIVAIYVKHPKANGTLLYSHGNAADLGQMFELFVELSSRLRLNLMGYDYSGYGQS

SEQ ID NO: 66738 - protein, 580 aa, Aspergillus oryzae
MRAPSPLLRSLSSKTSLSLPYSRRFLTPRFPITVTSKTSLRTVASYTHPHHASAISVLPTAVDTSSPDFKENAEQMKELVDRMSNLHSTISQGGPQKAKEKHIARGKMLPRDRVTALIDPGTSFLELSPLAGHEVYPGEDVPAGGIITGIGTVEGVTCMIVANDSTVKGGTYYPITVKKHLRAQAIAQENKLPCLYLVDSGGANLPHQADVFPDKEHFGRIFFNQARMSSMGIPQISVVMGPCTAGGAYVPAMSDETIIVEKQGTIFLAGPPLVKAATGEEVSAEDLGGGQLHSTISGVTDYLAVDDAHALILARRSVANLNYPKTSVPLKLDDSTIKEPLYDPAELNGIVGTNLRRQIPVHEVIARIVDGSEFAEFKRDYGTTLVTGFARIYGHQVGIVANNGILFSESSLKGAHFIELCAQRNIPLIFLQNISGFMVGADAEKGGIAKNGAKLVTAVACADVPKFTVVFGSSAGAGNYGMCGRAYSPRLMFMWPNAKIGVMGSEQLSSVMEAVGRTADPALKARIDHESEAIFSSARLWDDGVIPPAQTRRVLGLSLAASLGGRVDKDVQTRFGVFRM

SEQ ID NO: 66739 - protein, 496 aa, Oryza sativa Japonica Group
MARKMLKDEEVEVAVTDGGSYDYDLFVIGAGSGGVRGSRTSASFGAKVAICELPFHPISSDWQGGHGGTCVIRGCVPKKILVYGSSFRGEFEDAKNFGWEINGDINFNWKRLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKGEEIIADVVLFATGRTPNSQRLNLEAAGVEVDNIGAIKVDDYSRTSVPNIWAVGDVTNRINLTPVALMEATCFSKTVFGGQPTKPDYRDVPCAVFSIPPLSVVGLSEQQALEEAKSDVLVYTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 66740 - protein, 519 aa, Desulfococcus oleovorans Hxd3
MRPELAEMRERHGFLLDENRPDAVARRQQKNQQTARANVTALCDTDSFIEYGGLAVAAQRGRRSAEDLIAKTPADGLIAGIGTVNNDLIGEEKSRCMVMAYDYTVLAGTQGYFNHKKMDRMLKLAHEQRLPLVLFAEGGGGRPGDVDAIGVMTAGLDLSTFAAFAGLSGRVPLVGVVSGPCFAGNAALLGCCDVIIATKNSNIGMGGPVMIEGGGLGVFKPEEIGPIDVQTKNGVVDIEVADDAAAVNTARQYLSYFQGRAPQWEADDQDLLRDLIPENKKQPYDVRAVIQAMADRNSFLELRPKFGPGMVTGFVRVEGRPFGVIANNCMHMAGAIEAEGADKAARMMQLCQAHGLPVLSLCDTPGFMVGPEMEKRAQVRHVCRMFVVGSHLTVPYFTVVLRRGYGLGVMAMAKGGFHESFFTAAWPTGEFGAMGIEGAIKAGFKKELAAIEDPGARDQFYNQMVNELYQRGKAINIASYLELDAVIDPADTRQWIMRGIKSAPPSKPDTPGHAFVDPW

SEQ ID NO: 66741 - protein, 147 aa, Solibacter usitatus Ellin6076
MKCKQAMTPDPVCCIPTDTVSNVAKRMKTEDVGSLPVCESRTSRKLVGIITDRDLAIKVVADSRDPNKVTTGDVMTWNPMTCHPDDDLDIAVHSMQSEQVRRIPIVNDAGVLVGIISQADIALRGSRPERTGEMVEDISRHSHAGVF

SEQ ID NO: 66742 - protein, 137 aa, Picea sitchensis
MTNSEQYYRNIEYREKNIHTYTMLLDADYDMEINHFKDDLNDDEALTLDATRYGNVSRFVNHRCGDPNLLLRPVQIDTRDTHYYHVAFFTARDIAKKEELTWDYNINFDDKHEVKGFRCLCGSSLCRDKKNKFQKKG

SEQ ID NO: 66743 - protein, 820 aa, Physcomitrella patens subsp. patens
MATPAASHPGESSDPLRSRTFKPVAKKDFSTAILERKKAPNRLVVDEAVNDDNSVVALNMETMEKLQLFRGDTVLIKGKKRKDTVCIVLADDTCDEPKIRMNKVVRANLRVRLGDVVSVHQCADVKYGKQIHVLPFDDSIEGVTGNLFDAYLKPYFLEAYRPVRKGDLFLVRGGMRSVEFKVVETDPVEYCIVAPDTEIFCEGEPLRREDEERLDEVGYDDVGGVRKQMAQIRELVELPLRHPQLFKSIGVKPPKGILLFGPPGSGKTLIARAVANETGAFFFLINGPEIMSKLAGESESNLRKAFEEAEKNAPSIIFIDEIDSIAPKREKTQGEVERRIVSQLLTLMDGLKSRAHVIVMGATNRPNSIDPALRRFGRFDREIDIGVPDEVGRLEVVRIHTKNMKLADNANLESIAHDTHGFVGADLAALCTEAALQCIREKMDVIDLEDDTIDAEVLNSMAVTNEHFQTALGISNPSALRETVVEVPNTTWADIGGLENVKRELQETVQYPVEHPEKFEKFGMSPSKGVLFYGPPGCGKTLLAKAIANECQANFISVKGPELLTMWFGESEANVRDVFDKARQSAPCVLFFDELDSIANQRGSSQGDAGGAADRVLNQLLTEMDGMNAKKTVFIIGATNRPDIIDSALLRPGRLDQLIYIPLPDEASRLRIFQATLRKSPVAKEVDLQALAKFTQGFSGADITEICQRASKYAIREDIEKDIEREKRRAENPEAMEEDVVEEPAQIKARHFEESMKFARRSVSDADIRKYQSFAQTLQQSRGFGSEFRFADRPAAAAGAPHAAETTTFGASADDDDLYN

SEQ ID NO: 66744 - protein, 404 aa, Triticum aestivum
  misc_feature (11)..(11): Xaa can be any naturally occurring amino acid
  misc_feature (65)..(65): Xaa can be any naturally occurring amino acid
  misc_feature (81)..(81): Xaa can be any naturally occurring amino acid
  misc_feature (351)..(351): Xaa can be any naturally occurring amino acid
MATKRSVGTLXGEADLKGKKVFVRADLNVPLDDAQKITDDTRIRASIPTIKYLLEKGAKVILGQXHWGRPKGVTPKFSLKXPLVPRLSELLGLEVVMAPDCIGEEVEKLAAALPDGGVLLLENVRFYKEEEKNDPEFAKKLASVADLYVNDAFGTAHRAHASTEGVTKFLRPSVAGFLMQKELDYLVGAVANPKKPFAAIVGGSKVSSKIGVIESLLAKVDILILGGGMIFTFYKAQGLPVGKSLVEEDKLELATSLIETAKSKGVKLLLPTDVVVADKFAADAESKIVPATAIPDGWMGLDVGPDSIKTFAEALDTTKTVIWNGPMGVFEFEKFAAGTDAIAKQLAELTXKGVTTIIGGGDSVAAVEKAGLADKMSHISTGGGASLELLEGKPLPGVLALDEA

SEQ ID NO: 66745 - protein, 557 aa, Yarrowia lipolytica CLIB122
MSIIDGIETRRDSGASSASAASSSSKNSISKSPIFTTESTPLVRGIVEGRNTHDPEADGKSESVSPLGRHVGPLTVVALNFSQMIGTGIFVAPGTILNSVGSIGASLVLWMFGIVVSFCGFSLYTEFASLYPSRSGGEVVYLEKAYPRPKFMVPVTFAICTVLLSYSASNAIVFAQYFMVSLNIKHTDGMEQFVAVATSVAVCIIAIVDTKWSMRLQSVIAYIKVGILIFVATTGLAVISGVTKIEKPLDNFKNPFSGTSTSPNVWAAALVKVIFSFAGWNNANNVLNEIPNPVKTVKIYGSIALALVSVLYMVCAVGYFAAIPKQEIKDSKLLTAALFFTKVYGDESTTRILPSLIAISSFGNLLSVTIGHSRVVREVGRQGVLPYPAFWTNTWAFGTPAGPLLVKLLLTIIVIMVPPPGDAFNFVIDLQSYPSNVFLVLLVIGLFLIRKRRRTQGLPSAPFEAWDCVLYLYLGVSLFLLVAPWIPPPGGKYGGDVSFFYATYCIVGIAILAVCGLYYFWWAVIWPKLGNFKHVEVLERLPDGSVFTRIVRQKNSF

SEQ ID NO: 66746 - protein, 446 aa, Oryza sativa Indica Group
MAKQAWSSLFGCFTSHHDGGGKRKKGGGGGKKAKKKVAAAASQKQRKLQSRLSFSDLSFGGMVSPEDLSLSLAGSNLHVFTIAELRAVTRDFSMTNFIGEGGFGPVYKGYVDDKLKPGLRAQPVAVKLLDLEGTQGHNEWLLKFQNGNRAKGLEFKSCQLTEVIFLGQLRHPHLVKLIGYCYEDEHRLLVYEFMTRGSLEKHLFKKYAASLPWSTRLKIAIGAAKGLAFLHEAEKPVIYRDFKTSNILLDSDFKAKLSDFGLAKDGPEDDETHVSTRVMGTQGYAAPEYIMTGHLTAKSDVYGFGVVLLELLTGRKSVDKSRPAREQNLVEWARPYLTDARRLGRVMDRNLAGQYPAKAAQKAAALAHRCVSLNPKSRPHMSAVVEALEPLLALDDDCLVGTFVYVAPPDDVAANGDGSSKRRAGRRRSDGAAAAAAAAADGVQRE

SEQ ID NO: 66747 - protein, 180 aa, Kluyveromyces lactis NRRL Y-1140
MFRGQMFAVQRMGSALMHGGGGGTRIIGVAAARATAPTVGSSPSMASARFYHPKVIDHYTNPRNVGSLDKNLPNVGTGLVGAPACGDVMKLQIQVNDETGVIENVKFKTFGCGSAIASSSYMTELVRGKTLEDAAKIKNTEIARELSLPPVKLHCSMLAEDAIKAAIKDYQAKRPTTQLK

SEQ ID NO: 66748 - protein, 317 aa, Solibacter usitatus Ellin6076
MANALPVPHLARTQAEPLLATVGNTPLLRLERIPREFPGIEILAKAEYFNPGGSVKDRAAVNMVLDGERSGKLNHTRTILDSTSGNTGIAYAMIGANRGYHVKLVLPGNASEERKRILKAYGAETIFSDPGEGSDGAILLCRQIYREDPDRYFYPDQYNNPANWKAHFDGTGPEIIKQTNGTITHFVSAMGTSGTFTGTTRRLRRDLPEVKCYSAQPSSGFHGLEGLKHMPTAIRPGFYDDTLADGNLWIETEDAYRMVRRLAREEGLLVGISSGCNVHAATLLARDIAARGETATIVTVLCDSAEKYLSEHFWDEE

SEQ ID NO: 66749 - protein, 352 aa, Arabidopsis thaliana
KTQFRPVQCQIHHTYKITISLTSSSSSSYHYSLISPSLLLQKSTASSFNQKETPVSVSAMEFFQKAKAIRMRNSHNKYLTADDDEETVTQNRNGSTKNARWTVEPVRDSFHVIRLKSCYGKYLTASNERFLLGATGKKVIQLKLSRVDSSVEWEPLREGSKIKLRTRSGNYLRGNGGLPPWRNSVTHDVPHLSATQDSISWDVDVVEILTDSEFKTESAKAPPPKTTSPPPHRRPTSSPLSAESPRTSSSLSDRSDSDSVESPPKSDGRTIYYHVADEEGHVEDETTVGYAFTFKGNSVAELTQTLREETCMEDAVVCTRSPLNGKLFPLRLQLPPNNGTLHVILLPSSASL

SEQ ID NO: 66750 - protein, 538 aa, Glycine max
MFLILHILLRNHIATFHLPPPSLRQPPFSLSLAQMSALSNSSSSHGNSFLKMPAIKFTKLFINGDFVDSISGRTFETIDPRKEEVIARVSEGDKEDIDIAVKAARQAFDSGPWPRLPGSERAKIMMKWADLVDENIEELAALDTIDAGKLYYINKVAEIPSATNALRYYAGAADKIHGDVLKMNGDFHAYTLLEPIGVVGHIIPWNAPSLSFFIKVSPSLAAGCTMVLKPAEQTPLSALFYAHLAKLAGIPDGVLNIVPVFGPTAGAAISSHMDIDAVSFTGSIEVGREVLQAAAWSNLKPVSLELGGKSPLIIFNDADIDKASELALFGIMSNKGEICVAGSRVFVQEEIYDEFEKKLVEKAKSWVVGDPFDPKSLQGPQADRNQLEKILSYIEHGKREGATLLTGGNTVGNKGYYIEPTIFSNVKEDMLIARDEIFGPVLALMKFKTMEEAIKSANNTKYGLAAGIVTKNLDTANTMSRSIRAGIVWINCYFTVGSDVPFGGYKMSGFGRDLGLQALHKYLQVKSVVTPIHNSPWL

SEQ ID NO: 66751 - protein, 456 aa, Xanthomonas axonopodis pv. citri str. 306
MAIHSSVLELIGNTPIVKAQRLDTGVCELFLKLEANNPGGSIKDRIGLSMIEAAERRGDLKPGATLVEGTAGNTGLGLALVAQQKGYQLILVVPDKMSREKIFNLKAMGANVVLTRSDVAKGHPEYYQDLAARIAAETPGAYFINQFGNPDNPAAHEFGTGPEILAQMDGQLDAIVFGCGSSGTMTGLSRAFASASPHTELVLADPVGSILTQYIEEGTVSEKSGSWLVEGIGEDFLPDISDFSRVKKAYSISDAESFHTARELLAKEGILGGSSTGTLLAAALKYCREQTTPKRVLVFVCDTGNKYLSKMYNDYWMLDNGFLERPQHGDLRDLILRPYNKRDTVVVGSKDLLTTAYQRMKLYDVSQLPVIDDGELVGIVDESDVLLHVYGDEARFRDPISTAMVSKLDRLDVASPIEALLPVFDRGQVAIVMDGTQFLGLITRIDLLNYLRRRVQ

SEQ ID NO: 66752 - protein, 420 aa, Thermoanaerobacter tengcongensis MB4
MKLYQQKMIAGVKVASCKIPYAHSVYVGIWIKAGSMYETKNINGISHFIEHLVFKGSNLRSARQIAEEMDSIGGQLNGFTEKEDTCFYIKVLNSHIKKGIDILFDMVFNPAFCEEDIYKEKQVVFEEILTELDSPEDVAYNLLAKTAWRGHSLSLPVLGTFTTIKNLSKNHILEYYERHYTKDNIVVSIAGNFDDEIFEVLEGYLSKIKPTTSNFSLIPPLWHKDVSLYEKDFEQVNLCIGLPGIPYDLKKVYALAIANNAFGGGMSSRLFQKIREDKGLVYSIYSYPATYPTGGMFTIFASMTPSNFRKVYDLIIKEIEEISKKGLTKEEFDKFKEQLKINILMDQDSISTRMSSIGKSLLLFDKVHLIEDVLKIVEEISFEEVNQLAKEIIRPEEMTVSVVGKLNKKDKRWLENVNSA

SEQ ID NO: 66753 - protein, 191 aa, Arabidopsis thaliana
MGGTKRKIEMKRIEDKNVRAVAFTKRKSGLFHKASELCLLSPGTQIAILATPLSSHSHASFYSFGHSSVDHVVSSLLHNQHPSLPTNQDNRSGLGFWWEDQAFDRLENVDELKEAVDAVSRMLNNVRLRLDDAVKSNQRDGSLVIHQEDEEVLQLGYKDTNQITKLEGETSASASLLKNVVDNLHIDDRYY

SEQ ID NO: 66754 - protein, 479 aa, Desulfitobacterium hafniense Y51
MKKEIRESLFIDGEWQEAINKEVKGVINPATGKVFCEIGYGEVDDALSAVDAADRAFGAWSKTSVRERADILNRTADLLRQRADHIGLILAAESGKPLPQAVGEVKFSAEYFQWFAEEIRRPYGQSIPSDAANKRHHVYTQPAGVALCLSPWNFPVSIQARKLAPALAAGCTVVARGSEVAPLSLIELFQCLQDAGIPKGVANLIQGPAAVTTAAMMKHPAVRVVSFTGSTPVGRSLMRQAADGVIRLALELGGNAPFIVFADADIEKAVEGAMIAKFRNNGQSCIGANRFYVHERIYDKFTALFAEKILRMKIGNPTEEVDLDLGPMVNLKDKARIESLIYEAEALGAKPLVPKAEVPAEGYYVPPVILENVPESAALAREELFAPVAPLFKFADENEVIEKANSSDMGLAAYVYTNDLSRSIRVTESLKFGIIGLNNALPSVAYAPMGGVKQSGIGREGARIGLEEFMDVKYVATEI

SEQ ID NO: 66755 - protein, 365 aa, Brassica rapa
MAENQNSTRMTRAAAKRKASVTDENPVSKKRVVLGELPNNSNVPAPLIPLQERETQKPKSTLFAAKKQTKTPPIPQTVDFESGSSDPQMCGPFVADICAYLREMEGKLKQRPLHDYIEKVQSDLTPSMRGVLMDWLVEVAEEYKLVSDTLYLTVSYVDRFLSAKPINRQRLQLVGVSAMLIASRKYEEISPPKVEDFVYITDNTFTRQDVVSMEADILLALQFELGCPTIKTFLRRFTRVAQEDFNESLLQIECLCCYLSELSLLDYSCVKFLPSMLAASAVFLARFIIRPKQRPWNQMLEEYTKYKASDLQQPVGIIHDLYLSRRGNSLEAVRNKYKQHKFKCVATMPVSPELPQAFFEDVTIR

SEQ ID NO: 66756 - protein, 638 aa, Yarrowia lipolytica CLIB122
MNLEELDKKAKYVFDTKDRVAEKFFESLPPKTRGLMKFLFSPDHDYDSAIEHFDDTSSTDDIQLTHAEIVRRVWSKKQLIFGWICMLIMSLVSTIQASAFPSYIVYASSEFSQMGALASVQIVQACIFLVSRALSGKLADNFGRFEAMIISVICLTIGNGLYMGSHNIVTYFAALAFYSIGDIGTQMLYEIFAADTCDLKDRTFFQTITLFANLFTPWVAGPLVASVLKTSTWQWGMGMWAIITPCCAIPFLSTLLYFRIKAYRMGLRIRRGDPNRTWFQNTITGIIRMDLPGLVFLCAGLILFFVPISFCVGTDDWKMPQNIAMITCGTFFLYVAFPLWEFFGTKHPFLKFSLMKKRLVTVPGLIILLYYMAYATYHPYFQVWLLLAKGLPQARATNLNMAMFVALTGTTLVFSPLMRWRAKLKSVIVWGTILYFIGMGLTYEFRKPEKPLNTMILAQIFEGVGAGLLVIPIMVYIQVVCKQSDTAAAITIYYFFNSCGTILGNVISAAVYRNHFPNVLRKTGLFAEPEVKAIFGSIYVGLSYKVGTPQRAAIGATLNSVIRSLLIGPLIFCAIMFCLAITNADINLNTAQRMKEESEHVKGDDSQSSDQGVVIETAYEEKSPIYDEKKVTEVVNKA

SEQ ID NO: 66757 - protein, 820 aa, Podospora anserina
MSILQKTYDESYLTCSTAVYYESQGNEDEAMRCWRQALEQLYDPHANRILPNFNPRSETEKALVESLRQLELQCKERIDLLEALRLSRLSAPQHDSLSSSSRPSKSSSDSHDGGISGQQDGGWIGNGTIPAVNYTDLSRPNTLRRLSSQNRTSSSEQAVASSRGPQHGSMPPPLPARKPLPSTASIPSPERKPSRTSSPERHTMRTTLRTGTRDKTPKATLRRQPPKSSEVPVPSKAATLAWGTLGHRGSLDQPSGSSPISRPAPNTPTVPEQSRRSLELSKRLWDSNSRRLVTPRTRSPNKDTDSAPATDPRRSGEYPFPRASSISISAASTALNALALKESSDHRSPEREHITRLRTAPPETPRSRAQRDILNNDSNMSEGLPDKPLTRKTSLDSATVSRRSAGASLSAARIKSTPTRSGNKRKTPQLGNNSDRARPRRSSSPVLSESSSSSFETPARRPSGQHKRSTVERQREASLIVDSIIQPSESSEDDEPTKEVKSWKKRKAELLKKLPPGVDEHAAKQILNEIVIQGDEVHWSDIAGLEIAKNALRETVVYPFLRPDLFMGLREPARGMLLFGPPGTGKTMLARAVATESKSTFFSISASSLTSKYLGESEKLVRALFSLAKVLAPSIIFVDEIDSLLSQRSGSGEHEATRRIKTEFLIQWSDLQRAAAGREVGERDKERGDANRVLVLAATNLPWAIDEAARRRFVRRQYIPLPEAETRAVQLKTLLKQQTHTLSDEDINTLVAMTDALAKDAAMGPLRSLGDALLHMTENDIRPIGLSDFIASLATIRPSVSKAGLKEYEDWAREFGERGG

SEQ ID NO: 66758 - protein, 293 aa, Burkholderia xenovorans LB400
MTFEQWMRSVLERVETALDHYLPGEATEPATLHEAMRYAVLGGGKRVRPLLCHAAGELTGARAECLDAAAAALEMIHVYSLVHDDMPCMDDDALRRGKPTVHVKYDEATALLVGDALQSQAFVALTSDVLAPAQQAALVRELALASGSVGMCGGQAIDLASVGHTLTRTQLETMHRMKTGALLRAAVRMGALAGETPDAAAMRSLDAYSAAVGLAFQVVDDILDVTTDSATLGKTAGKDAKDGKPTYVSIIGLDASRALAAQLRSDAHAALAPFGARAQRLAELADLVVNRVS

SEQ ID NO: 66759 - protein, 358 aa, Aspergillus oryzae
MGAPPKTAQNLSFVLEGIHKVKFEDRPIPQLRDAHDVLVDVRFTGICGSDVHYWEHGSIGQFVVKDPMVLGHESSGVISKVGSAVTTLKVGDHVAMEPGIPCRRCEPCKEGKYNLCEKMAFAATPPYDGTLAKYYVLPEDFCYKLPENINLQEAAVMEPLSVAVHIVKQANVAPGQSVVVFGAGPVGLLCCAVARAFGSPKVIAVDIQKGRLEFAKKYAATAIFEPSKVSALENAERIVNENDLGRGADIVIDASGAEPSVHTGIHVLRPGGTYVQGGMGRNEITFPIMAACTKELNVRGSFRYGSGDYKLAVNLVASGKVSVKELITGVVSFEDAEQAFHEVKAGKGIKTLIAGVDV

SEQ ID NO: 66760 - protein, 541 aa, Rhizobium leguminosarum bv. viciae 3841
MNAIVEQLKSTADATKATDIRAAFAADSQRFSRFSVSLDDLLMDFSKTAVNDDILKLLVKLAEEGGVEKKREEMFSGKAINFTEDRAVLHTALRNRSNAPVLVDGKDVMPDVNAVLAAMGKFADDVRSGTLKGATGKAITDVVNIGIGGSDLGPVMATLALAPFHDGPRAHFVSNIDGAHIADILKLVQPETTLFIVASKTFTTVETMTNAQTARNFIAKALGEAAVQHHFAAVSTALDKVAAFGIDSARVFGFWDWVGGRYSIWSAIGLPLMIAVGPENFGKFLDGAHAVDNHFRKAPITENLPILLGLIGFYHRNVLGYPTRAILPYDQRLSRFPAYLQQLDMESNGKGVTIDGTPVEGNSGPVVWGEPGTNGQHAFYQLIHQGTSIIPAEFMIAANAFEPELRHQHQLLISNVLAQSEALMKGRTFAEAKKQLTDKGMDDKKADFIAPHRVFTGNRPSITFVYDKLTPYALGRLIALYEHRVFVEGVLFRINSFDQWGVELGKELATGLLPVVEGKESAASHDSSTQGLVAALAKLAK

SEQ ID NO: 66761 - protein, 434 aa, Bacillus cereus G9241
MNRLLMNENQKWNTFIETPFYTKVGKVHSVQEQFFVAKGPKAKIGDVCLVGEHNVLCEVIAIEKENNMLLPFEQTEKVCYGDSVTLIAEDVVIPRGNHLLGKVLSANGEVLNENAENIPLQKIKLDAPPIHAFEREEITDVFETGIKSIDSMLTIGIGQKIGIFAGSGVGKSTLLGMIAKNAKADINVISLVGERGREVKDFIRKELGEEGMKKSIVVVATSDESHLMQLRAAKLATSIAEYFRDQGNNVLLMMDSVTRFADARRSVDIAVKELPIGGKTLLMESYMKKLLERSGKTKKGSITGIYTVLVDGDDLNGPVPDLARGILDGHIVLKRELATLSHYPAISVLDSVSRIMEEIVSPTHWQLANEMRKILSIYKENELYFKLGTIQENEENAYIFECKNKVEGINTFLKQGRSDSFQFTDIVEAMHHIV

SEQ ID NO: 66762 - protein, 360 aa, Pseudomonas putida KT2440
MSKQILILPGDGIGPEIMAEAVKVLELANDKFQLGFSLAHDVIGGAAIDKHGVPLADETLERARKADAVLLGAVGGPKWDKIERDIRPERGLLKIRSQLGLFANLRPAILYPQLADASSLKPEIVSGLDILIVRELTGGIYFGAPRGQRELEGGERQAYDTLPYSESEVRRIARVGFDMARVRGKKLCSVDKANVLASSQLWREVVEDVAKDYPDVELSHMYVDNAAMQLVRAPKQFDVMVTDNMFGDILSDEASMLTGSIGMLPSASLDADNKGMYEPCHGSAPDIAGLGIANPLATILSVSMMLRYSFNQSAAAEAIEKAVSLVLDQGLRTGDIFSEGCRKVGTQEMGDAVVAALRNL

SEQ ID NO: 66763 - protein, 474 aa, Oryza sativa Japonica Group
MIVITVELHDKHSIISRRLSKAIPSISVIGQNGVMLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRTVQERPDSDSAQVKGSLPDHPRSSNIEGCANPVQSGNTASLKQKNKVDDGFTKVSSESVPTRVASRGKSSKVAVDQDKATTTSTPIEPAPVRSNDIQLVVRIPDGPSLQIKLTKDDNLRKVKNFVDENRANGAGSYDLAMLYPRKVFTEQDMEATLHELGIETRQALTIVPHHKTIRAAKRQSSSSPHEGDNNMDADSSGGSGYFGYLRTALSFVNPLSYLRANAAPSNPDQLANQGSPQYRPSTGPWNRPGEDTASESRIPDSARQQAARDTSSGSTLRRRPRQFGGNVHSLRSDDQGPSDDRNVYWNGNSTEFGGEDKK

SEQ ID NO: 66764 - protein, 440 aa, Oryza sativa Japonica Group
MLWCHEGYISSKDLKENIEKAWATLHLQGTAAAFLTASLASRMTEPVNTTPTTLPTQGGSSAAENPSTSSNQSTGTSGASGFANPTDSVAQPPRSTSRDETPSISEKESSNLDSSPGNRTVQERPDSDSAQVKGSLPDHPRSSNIEGCANPVQSGNTASLKQKNKVDDGFTKVSSESVPTRVASRGKSSKVAVDQDKATTTSTPIEPAPVRSNDIQLVVRIPDGPSLQIKLTKDDNLRKVKNFVDENRANGAGSYDLAMLYPRKVFTEQDMEATLHELGIETRQALTIVPHHKTIRAAKRQSSSSPHEGDNNMDADSSGGSGYFGYLRTALSFVNPLSYLRANAAPSNPDQLANQGSPQYRPSTGPWNRPGEDTASESRIPDSARQQAARDTSSGSTLRRRPRQFGGNVHSLRSDDQGPSDDRNVYWNGNSTEFGGEDKK

SEQ ID NO: 66765 - protein, 450 aa, Arabidopsis thaliana
  misc_feature (59)..(59): Xaa can be any naturally occurring amino acid
  misc_feature (81)..(81): Xaa can be any naturally occurring amino acid
  misc_feature (117)..(117): Xaa can be any naturally occurring amino acid
  misc_feature (141)..(141): Xaa can be any naturally occurring amino acid
  misc_feature (164)..(164): Xaa can be any naturally occurring amino acid
  misc_feature (184)..(184): Xaa can be any naturally occurring amino acid
  misc_feature (215)..(215): Xaa can be any naturally occurring amino acid
MATITVVKARQIFDSRGNPTVEVDIHTSNGIKVTAAVPSGASTGIYEALELRDGGSDYXLGKGVSKAVGNVNNIIGPSHLXKGPNSARLAIDNFMVHELDGTQNEWGWCKQKLGANXAILAVSLAVCKAGAVVSGIPLYKXIANLAGNPKIVLPVPAFNVINGXGSHAGNKLAMQEFMILPVGXAASFKEAMKMGVEVYHHLKSVIKKKYGQDAXTNVGDEGGFAPNIQENKEGLELLKTAIEKAGYTGKVVIGMDVAASEFYSEDKTYDLNFKEENNNGSQKISGDALKDLYKSFVAEYPIVSIEDPFDQDDWEHYAKMTTECGTEVQIVGDDLLVTNPKRVAKAIAEKSCNALLLKVNQIGSVTESIEAVKMSKKAGWGVMTSHRSGETEDTFIADLAVGLSTGQIKTGAPCRSERLAKYNQLLRIEEELGSEAIYAGVNFRKPVEPY

SEQ ID NO: 66766 - protein, 564 aa, Blastopirellula marina DSM 3645
MLRLTALPLSLFMLFNAACVAWGGNAPTRVRTAMVVSQSEIASQVGADVMQAGGNAIDAAVATAFAMAVTHPSAGNIGGGGFLVFRPADGEPTAFDFREQAPAAAHPLMWLNEKGEYDYERHHESHQAVGVPGTVAGLHMAWKTAGTLPWKSLVEPAVRLAADGFVVGDGLERSLKEQIPRFEQYPASLAQFTKAGEPYLAGEILKQPELAKTLERIRDQGPAGFYEGETARLLVHAMEANGGLITLADMKAYQAKRRTPLIGSYRGYEVIGMPPPSSGGVGVIEMLNILEGFDLRAAGFGSAANLHRMSEAMRRSFADRAHYLGDPDFNPEMPVASLISKEHAAELRKTIDATQASISTPESFVWPYESVETTHFSVVDADRNAVSLTYTLEYAYGSAIVVPGGGFLLNNEMGDFNAAPGMTTAGGLIGTKPNLALPQKRMLSSMSPTILAKDGELFMVTGSPGGRTIINTVLQTVLNVVDHQMNAQEAVDAGRIHHQWLPSRIQYEGQEFSPDTLAILRKMGHALYPISKQGAAEVIIVNAKTGQLEGGVDRRRPDGGAVGY

SEQ ID NO: 66767 - protein, 508 aa, Triticum aestivum
  misc_feature (71)..(71): Xaa can be any naturally occurring amino acid
TFPARYRPNQGSAYANGETKPLSSSSSTSSFPPSPPFPSHRIPQIDARFLPNRTGIPRRIGPAHGVIEGPXALAMEAQWLAEYPHQAADNRPRKRPRLAWDAAPQLFPPPKAIPMLYCGQELINGNFTTAFLPPPPIYYAGPPRNLSPPWRPDDKDGHYVFTLGENLTPRYRILSKMGEGTFGQVLECWDLENQESVAIKIVRSLQKYREAAMIEIDVLQRLGKHDFTGSRCVQIRNWFDYRNHICIVFEKLGPSLYDFLRKNSYRSFPIDLVREFARQILESVTFMHDLRLIHTDLKPENILLVSPDTIRVHDYKIPIRPPKDGSVFKNLPKSSAIKLIDFGSTTFDHQDHNYVVSTRHYRAPEVILGLGWNYPCDLWSVGCILVELCSGEALFQTHENLEHLAMMEKVLGPLPKHMIARADRRAEKYFRRGLRLDWPEGAASRESMKAVWKLPRLQNLVMQHVDHSAGDLIDLLQGLLRYDPDERLKARQALQHPFFTRCHRRCGY

SEQ ID NO: 66768 - protein, 392 aa, Prochlorococcus marinus str. MIT 9303
MPLPPHLSDRVVALQPSLTLAISARAKALQQEGRDICSMSAGEPDFNTPEFIIDATVKALRDGITRYGPAAGDPELREAIATKLSKENTVPTNAEQVLVTNGGKQAIFNLFQVILNPGDEVLIPAPYWLSYPEMARLAGAKVTTLPSTPENGFCLDLNNLEASIGSKTRLLILNSPGNPTGRVMARKELEALADLLRNYPQILVMSDEIYEFILEDGQQHHSFSAIAPDLSDRTFIVNGFAKGWAMTGWRLGYLAGPAHAVKAATALQSQSTSNVCSFAQRGALAALQGSRECVKKMVNSYNTRRELLASGLLGLEGISLISPKGAFYAFPKLPEGSLDSVSFCQQALENYGLAMVPGAAFGDDSCIRLTCAVSHKTICDGLERLRKALKQS

SEQ ID NO: 66769 - protein, 291 aa, Chlamydophila pneumoniae CWL029
MKRNDPCWCGSGRKWKQCHYPQPPKMSPEALKQHYASQYNILLKTPEQKAKIYNACQITARILDELCKASQKGVTTNELDELSQELHKKYDAIAAPFHYGSPPFPKTICTSLNEVICHGIPNDIPLKDGDIMNIDVSCIVDGYYGDCSRMVMIGEVPEIKKKICQAALECLNDSIAILKPGIPLCEIGEAIEARADTYGFSVVDQFVGHGVGIEFHENPYVPHYRNRSMIPLAPGMIFTIEPMINVGKKEGVVDPKNQWEARTCDNQPSAQWEHTIAITETGYEILTLLND

SEQ ID NO: 66770 - protein, 413 aa, Desulfococcus oleovorans Hxd3
MANTQKITRNPDGSLNVPDMPVIPFIEGDGTGPDIWKAAKMVLDAAVDAAYGGSRKIAWQEVLAGEKAYEKTGQWLPEETLDTIREYVVAIKGPLTTPVGKGIRSLNVSIRQLLDLYACVRPVRYIDPIPSPMKQPEKVNMVVFRENTEDVYAGIEWEAGSAEAEKLIAFMKNELGASVAAGSGIGIKPMSEINTRRLVARAIAYAIAKGLSSVTLMHKGNIMKFTEGAFCTWGYKAARELFADRTITEAEVYEKHDGKPPGGRVMIKDRIADMLFQQILLRPDEYQVIACPNLNGDYISDALAAQAGGLGMAPGANIGDECAVFEATHGTAPKYAGLDKVNPGSLILSGAMMLEHMGWDEAGAMIWKALQQAIADGEVTYDLARQIEGAREVKCSVFAERVCEKLRALGQQA

SEQ ID NO: 66771 - protein, 423 aa, Xylella fastidiosa Ann-1
MVWGAVRWADVWWMLRSMGRYSDAHSVDFAFFYVLTRDKSFMQVTSKLPQVGTTIFSVMSQLEDVYGAVNLGQGFPDFPVPLRLQEALEGAVREGHNQYPPMIGVAVLRQGIAVKVLRCYGAQVDADVEITVTSGATEAIFNAIHAVVGAGDEVIVLDPAYDCYEPGIVLAGARAVHVPLDAVSFKVDWERVGAAITSRTRLLIVNSPHNPSGALFSADDMRALATLLDGTDILLISDEVYEHIVFDGCGHESVLRWPQLRARAFVISSFGKTYHCTGWKIGYAIAPPALSAEFRKVHQYNTFTSFGPAQYAFAAMLHEEPGYVDQVGLFYQARRDCFREQLLTTKLVPLPVSGGYFQLVDYGAVSDLSDVEFSRWLAVEKGVASIPLSPFYETAPAGQRLVRLCFAKNDMTLGAAIERLQRL

SEQ ID NO: 66772 - protein, 655 aa, Corynebacterium glutamicum ATCC 13032 [sequence omitted]

SEQ ID NO: 66773 - protein, 460 aa, Xanthomonas axonopodis pv. citri str. 306
MSFESLGLAPFLLRALAEQGYETPTPIQQQAIPLVLAGHDLLAGAQTGTGKTAAFGLPLLQHLGTAPQTVNGPRKPRALILTPTRELATQVHDSLRGYSKYLRIPSAVIYGGVGMGNQLDALRRGVDLLIACPGRLIDHIERRSVDLSGIEVLILDEADRMLDMGFLPSIKRILTKLPRQDRQTLLFSATFEENIKQLALEFMRNPVQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGDRAPRKSHARRPHGDAPRQAHAHAGPKKPGGQRSNGPRQANTGAGAGRRDGGRGGQRPSGTR

SEQ ID NO: 66774 - protein, 507 aa, Aspergillus nidulans FGSC A4
MSSVAPFALKQASRAYARRLTAAQHALPWRALATPSYRTFVSETKAGNAQVSVDTAIKQEQKDFLKQTGVQPQNAELPASGITGDTAMSPAAGILKQATIMDQGTRPIYLDAQATTPTDPRVLDAMLPYLTGIYGNPHSRTHAYGWESEKAVEQARGYVANLIGADAKEIIFTSGATESNNMSIKGVARFFGRSGKKKHIITSQTEHKCVLDSCRHLQDEGFDVTYLPVQSNGLIKLEDLEAAMRPDTALVSIMAVNNEIGVVQPLEEIGKLCRSKKIFFHTDAAQAVGKIPIDVNKMNIDLLSVSSHKIYGPKGIGACYVRRRPRVRLEPIISGGGQERGLRSGTLAPHLVVGFGEACRVAAQDMEYDSKYISRLSKRLTDGLLAMEHTSLNGDPERRYPGCVNVSFAYVEGESLLMALKDIALSSGSACTSASLEPSYVLRALGSSDESAHSSIRFGIGRFTTEAEIDYVLKAVQERVHFLRELSPLWELVQEGIDLNTIEWSGH

SEQ ID NO: 66775 - protein, 424 aa, Propionibacterium acnes KPA171202
MTRVVQKFGGSSVADAASIKRVARRIAATKQAGNDIVVVISAMGDTTDDLMDLALEVSPQPAPRELDMLLTTGERQSAALLAMALSDVGIPARSYTGSQAGVITTAAHGNARIIDITPGRIEKSLEAGDLVIVAGFQGVSQTTKDVTTLGRGASDTTAVALASSLGADFCEIYSDVDGVFTADPRIVKGARRIPEISYEEMLEMAACGAKILHLRCVEYARREDVPVHVRSSFSDKPGTWVKDPTDITKGSDMEEAIISGVAHDRSEAKITIAGLPDAVGRAAQIFEIIAHADINIDMIVQNASRVMNGRTDLSFTLPMNDGPTAVRALTAVKDELGYEQILYNDQIGKVSVVGVGMRTHPGVTSTFFRALADCGINLQMISTSEIRISVVVDADQVDEAVRVAHTAFGLDAEGEAVVYAGTGR

SEQ ID NO: 66776 - protein, 414 aa, Glycine max
MDTLSQLSLLCLCLSFFPLFASPALLFQGFNWESSKKGGWYNSLKNTIPDLANAGITHVWLPPPSQSVSPEGYLPGRLYDLDASKYGTKDQLKSLIAAFHDKGIKCLADIVINHRTAERKDGRGIYCIFEGGTPDARLDWGPSFICKDDNTYSDGTGNLDSGEPYDPAPDIDHLNPQVQRELSEWMNWLKTEIGFDGWRFDYVKGYAPSITKIYMEQTRPDFAVGEKWDSLSIDNYDGHRGALVNWVESAGGAITAFDFTTKGILQAAVQGQLWRLKDSNGKPSGMIGVKPENAVTFIDNHDTGSTQRIWPFPSDKVMQGYAYILTHPGTPSIFYDHFFDWGLKEQIAKLSSIRVKHGINEKSSVNILAAEADLYVAKIDNKIFLKIGPKMDLGNLIPPNFHVATSGQDYAVWE

SEQ ID NO: 66777 - protein, 336 aa, Desulfitobacterium hafniense Y51
MSVRVAINGFGRIGRLTLRAILKQSLPVEVVAINDLGNPDLLAHLFKYDSLHGILPNSVEIDGNTMLVDGKSIAILSERNPLDLPWRKLGVDIVIESTGRFTKRAAASQHLTAGAKKVVISAPAKNEDITIVMGVNDDQYQPQEHHIISNASCTTNCLAPVAKVLLDAFGIEQGMMTTTHSVTNDQRILDLEHSDWRRSRAAYQSIIPTTTGAAQAVTLVIPELAGKMNGLAVRVPTPNVSLVDFVANLTKSTTKEEVNAALRESAEGKLKGYLEYTELPLVSRDFNGNSASSIVDGLSTMMIGERMVKVLAWYDNEWGYSNRIVDLVKLIVMKGL

SEQ ID NO: 66778 - protein, 635 aa, Burkholderia xenovorans LB400
MYDLLKTIDDPAALRRLDRRQLQPLADELRAFVLDSVSQTGGHLSSNLGTVELTIALHYVFDTPHDRIVWDVGHQTYPHKILTGRRDQMHTLRQLGGISGFPKRDESEYDTFGTAHSSTSISAALGMAVASKLKGDNRMGIAVIGDGAMTAGMAFEAMNNAGVEDDVPLLVILNDNDMSISPPVGALNRHLARLMSGRFYAAARAGVERVLRVAPPMLDLARKLEEHAKGMIVPATLFEEFGFNYIGPIDGHDLDSLIPTLQNIKELRGPQFLHVVTKKGQGYKLAEADPVLYHGPGKFNPAEGIKPAATPSKKTYTQVFGEWLCDAAELDARVIGITPAMREGSGMVEFEKRFPDRYFDVGIAEQHAVTFAGGLAAEGMKPVVAIYSTFLQRAYDQLIHDVALQNLPVVFAIDRAGLVGADGATHAGAYDLAFLRCIPNMTVMAASDENECRQMLYTALQQPNPTAVRYPRGAGTGVATIKQMTALPLGKGEIRRETSQPAGKRIAILAFGTMVAPSLAAAEQLDATVANMRFVKPLDADLVRQLAETHDAIVTVEEGCVMGGAGSACVEALLASGVTRPVLQLGLPDRFIDHGDPAKLLAACGLDAVGITKSIRERFLLSGAVGGQSSVKRVA

SEQ ID NO: 66779 - protein, 311 aa, Solibacter usitatus Ellin6076
MLTNSSQIVLITGGTGGIGQAIAVRMAKLGATTIVVGRDQARGEAAKAEIRTQSGNRSVELMLADLSSQGDIRRLAGEFMARYGRLDVLVNNVGGLYGKRWETVDGIECTLALNHLCPFLLTHLLLPVLRAGAPSRIVNINSEGHRAAKSVNFGDFDAARWKRGFLIYSQSKLANLLFTFEMARRLSPSEITVNAVHPGIVDTQLFRRFIEERFTLIGGVLSKAAAFVARKVAYRISHFDTVETAAECPVYLASSSEVAGITGKYFGLNKKIVETSAASLDADLSREVWRMSAEMVGLSGNEASQVQRRFA

SEQ ID NO: 66780 - protein, 367 aa, Zea mays
  misc_feature (82)..(82): Xaa can be any naturally occurring amino acid
PNGGKVTPNLAMDAEATRLLNLTVLQRLDPAVEDILITAAHVTLYDFNIDLNQWSRKDVEGSLFVVKRNSQPRFQFIVMNRXNTDNLVEDLLSDFEYELQPPYLLYRNASQEVNGIWFYNQQDCEAVASLFGRILNAYAKVPPKPKVPSTKSEFEELEAVPTSAAIDGPLEPPPASAAVVLDTPDESLISYFSGAASIGSVSNAQPSGRVHPSTESIPSSHVPLIVPSAASTHQLPPSVASTASPLPVHGTNAHTSRPTNLVTPDFFAPPPSSSAPLAPPGASVVPTAPPLHPTSAASIQRSQYGTPLLQPFPPPTPPPSLNPSHSDRLTVTRDRVKDALQRLVQSTIGMVGSICGVPWFQISVLAV

SEQ ID NO: 66781 - protein, 745 aa, Oryza sativa Japonica Group
MAAAAPATTSSAAARPSSSSSSSRQSDAPLRAATVSFPYSPRPAALAAGARASRVSPVVVAAGGGHQRLMGSLTNTQGLRFGVVVARFNEIVTNLLLQGALETFERYSVKKENITIMTTIVTVMHAYKIVLLPLFPMLRVNICFMPIHLFLSYFIVQKYCSEVVSVPGSFEIPVAAQKLGKSGKFDAILCIGAVIRGDTTHYDAVANSAASGVLSAGLSAEIPCIFGVLTCDDMDQLLAVLAHSGGGVVVCETLSNAGCEGAFSTDAADASNAGKGGIPTGDELVVLSTDTRGASPEASTAATGDVAGANKAVVSTRAEATFPSCAVAVHNAVVSTRAEAIFSSSCGDADHKAVSSTVLATGSETVSSSSSSDATATAAGSGTETISFSSSGSNEFHDELLLAVDVHAGPALAKFLRAVLPERGAGGEGCRQGCDASVMIEGSGTERTDPANLSLGGFNVIDAAKRLLEAVCPVTVSCSDILVLAARDAVTFVSMMALCDFSFLVATIHSKTGGPLVPVSLGRLDGLVSLASNVRANIIDTGFSVDAMARSFSAKGLTLDDLVTLSGTHTHALECWRINCDFHFSPGLTVSTRLSIAGVAHWRAGGHTIGSAHCTTFGERFRVDANGSTVPADAAMNADYAGGLIRACSAVNNTVSSTAAVDCDEGSASRFDNAYFANLLAGRGLLRTDAVLVQNATTRATVEAFARSEGSFFASWAASFARLTSLGVRTGADGEVRRTCSRVNG

SEQ ID NO: 66782 - protein, 435 aa, Oryza sativa Japonica Group
MAAAATAAVPLDEAKAKEVLRQVEFYFSDSNLPRDNFLRKTVEESEDGLVSLALICSFSRMKKHLGLDLDVKQETMPEETVLAVAEVLRRSSALRVTEDGKKVGRSIELSKLDEIMEQVDSRTIAASPFPYNVKLEDVQSFFAQYGKVNSVRLPRHIADKRHFCGTALVEFSEEEEANAVLKNTLVFAEADLEIKPKKEFDTEREAKKEAYEKSQPTKNGHDEGYPKGLIVAFKLKIIQIDGGMAENGGDQEGETDDANKSRTGHDEKIPENSDIKEDLSDDVEKSKEAAAQSVKKGESPSENADDPISREDFKEEFGKFGTVRYVDFSIGEDSGYIRFEDSKAAEKARALAAISDEGGLIMKGHLVTLEPVSGQAEKDYWSAIKGGQGKYRDNRSNRGRDWKNNRGGRHFGGKRGRHSDGHERANKARKVDAAA

SEQ ID NO: 66783 - protein, 494 aa, Zea mays
  misc_feature (36)..(36): Xaa can be any naturally occurring amino acid
MPSGGVFSGSVNLKHVKLGYQYLVNHFLTLLLVPVXAATALELARLGPGELLSLWRSLELDLVHILCSAFLVVFVGTVYVMSRPRPVYLVDYACYKPPASCRVPFATFMEHTRLISDDDKSVRFQTRILERSGLGEDTCLPPANHYIPPNPSMEASRAEAQLVIFSAIDDLVRRTGLKPKDIDILVVNCSLFSPTPSLSAMIINKYKLRSNIRSFNLSGMGCSAGLISIDLARDMLQVHPNSNALVVSTEIITPNFYQGSRRDMLLPNCLFRMGAAAILLSNRRREARRAKYRLVHVVRTHKGSDDRAYRCVYEEEDEQGFSGISLSKELMAIAGDALKSNITTIGPLVLPMSEQLLFFFRLVGRKLVNKGWRPYIPDFKLAFEHFCIHAGGRAVIDELQKNLQLSPRHVEASRMTLHRFGNTSSSSLWYELAYIEAKGRMRRGDRVWQIGFGSGFKCNSAVWKCLRSIKTPTNGPWDDCIHRYPVDVPEVVKL

SEQ ID NO: 66784 - protein, 345 aa, Thermus thermophilus
MKVAVLPGDGIGPEVTEAALKVLRALDEAEGLGLAYEVFPFGGAAIDAFGEPFPEPTRKGVEEAEAVLLGSVGGPKWDGLPRKIRPETGLLSLRKSQDLFANLRPAKVFPGLERLSPLKEEIARGVDVLIVRELTGGIYFGEPRGMSEAEAWNTERYSKPEVERVARVAFELARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 66785 - protein, 426 aa, Arabidopsis thaliana
MTTIRSSPSSSRCSNSSSSSSYSLASTSLSNRLETIFKKASELCTLCDIEACVIYYGPDGELKTWPKEREKVRDIALRFNQLNEALRHKKSVNLHGFLNKKKKNKGLKNPNKKKKTSLKNVNVLKYPLADHYSPDQVSQLTQSLELNVSKFQERLRFLESQKQNETKPDHQSLTSISSLNQSLNPSQFSLFMYNHGYNTLSQIPVSASNFNQDYISALLEQSELKSQIMKQEVCGYEQNMCMSNHGDATLSQIPFSASNFNQDFSANNNFQHSFVSNTQDYYSVQKSVNNNYGLKNQLMKHDLCGYEHNMCMSNHGDATFSQIPLSASNFNQDFSVSIQEESGLMQQELCGYDQNQNMSMGDITNNNFQVTCASVLESVNNFGLNQLMHKEFYGCHQNMSMGNINNNSFQHPWVSNADHTRRYKNL

SEQ ID NO: 66786 - protein, 507 aa, Zea mays
MDVYIYQALLLSVLAVALLQLVKMALKPRPRLPPGPWKLPVIGSMHHLVNVLPHRALRDLADVHGPLMMLQLGQTPLVVASSKETARAVLKTHDTNFATRPKLLAGEIVGYEWVDILFAPSGDYWRKLRQLCAAEILSPKRVLSFRHIREEEVMLRVEEIRAAGPSTPVNLSVMFHSITNSVVSRAAFGKKRKNAAEFLAATKAVVGLSSGFNIPDLFPAWTTVLAKLTGMTRSLKEIHKTVDTILEEIIEERKRIRDEKIMGGAAAEDVDENLVDVLIGLQEKGGFGFQLTNSIIKAIILDMFAGGTGTSGSAMEWGMSELMRNPPVMKKMQALIREAFRGKTVVTEGDLQASNLQYMKLVIKEALRLHPPAPLLVPRESIEECELDGYTIPAKSRVIINAWAIGRDPKYWNDADEFKPERFEDGSRDFTGSSYEFLPFGSGRRMCPDFNYGLASMELAFVGLLYHFDSSLPDGVKEVNMGEVPGLGVCRRTPLMLCATPFVPVPA

SEQ ID NO: 66787 - protein, 355 aa, Nectria haematococca mpVI
MSRSNPPNPTGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRAIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEEALKHPYLEPYHDPEDEPTAPPIPEEFFDFDKHKDNLSKEQLKQLIYQEIMR

SEQ ID NO: 66788 - protein, 465 aa, Kluyveromyces lactis NRRL Y-1140
MASMFRPPESRRTNSKPPKLSLPPQLVSNSKPITDIRDEKLRQPPSKSVPSSATPTSSASASSARTLKNRPVPPPTASSVTPLSSTNSGSAMGSLSNKLHGLKINTDHLPTSGSQQSTQSADSMTSNLISMYDSEPTTSSSTSLVNHGKESEIIEHDRDDSTDELESDIWQTYKIHEQIDTLGILGEGTGGSVTKCKLRNGSKIFALKTIATIENDGSEKQIFRELQFNKSCKSDFIVRYYGMFACEETSTIFIAMEYMGGRSLDSVYKHLLSKGGRIGEKVLGKIAESVLRGLFYLHERKIIHRDIKPQNILFNEIGQIKLCDFGVSGEAVNSLATTFTGTSYYMAPERIQGQPYSVTSDVWSLGLTLLEVAQGHSPFDTDKLAANMPPIELLMLILTFTPELKDEPEQGIVWSKSFKSFLDYSLKKDSKDRPSPRQMLQHPWMVGQTKKHVNMKKFIQTCWAD

SEQ ID NO: 66789 - protein, 909 aa, Kluyveromyces lactis NRRL Y-1140
MSTEAHRHTYYGGPTTNTESSHHIHTSHAHNCSNGSSRRHSSSHNGRRRQVTFGPYIIGPTLGEGEFGKVKLGWSKSNSDESKNVAIKLIRRDTIPKNSEKEVKIYREINALKHLAHPNIVTLEEVLQNSKYIGIVLHYASGGEFYKYIQKKRRLKEPAACRLFAQLISGVHYMHHKGLAHRDLKLENLLLDEHENLIITDFGFVNEFSSRNDLMKTSCGSPCYAAPELVVTTKAYEARKADVWSCGVILYAMLAGYLPWDDDPDNPDGDDIAKLYNYITKTSLKFPEYINPIPRDILRRILVSDPSKRITVELILKHQWLQPHALFLSLKPEDWDIKAKAEISNIFRPPPSQSSQSAYSRPHSNSSVSSSEKRNSLIIDSTLHLQPVPPHESQSHAIAKPSSPSSDLRSSPIKRVNHSRSNSAASIALQAVVDAEREFFQSSQSILQISGVQSIEQSPNTRVQTYTATRSLAHNNSSSLMNRNSIIVEVSPNKEVISSSSSSAIPGMSYSASRESYISTSPVRNAAQSPKFVPGSFTSNTSHHNNKFGSSQQSRPRPTSYHPISSSYLEMQPSNSQNNFITTTNEFSYIPRTVNANNYIDSTRAISPELNGRTVDGTSPPLNSRNFQSGIIRRGSFSASKPSPSVDLNNVEGDLIKTDAEDHKKLKQQRRKSQRYSTVILDNSIATVQEETEEPITAYDANIKKPVENSNNLTKEFGKIVINEPRKEDAHIPISKPESEHLQKPPQQHQSQASIARADSHSKKEKRFSLLSFYSYYNNSKTSVSSDSSGGRRVSANSQKTNERISSVKSNGIPSRNVSGSINQFETSKPRVSSNPSNRTNYRHSMLPPKSSQVIDASAKRMNRSSVMVSSAKDITSSDGTASKEHKEQREPSTAKRVFDFFKRRSMRV

SEQ ID NO: 66790 - protein, 159 aa, Oryza sativa
  misc_feature (33)..(33): Xaa can be any naturally occurring amino acid
  misc_feature (138)..(138): Xaa can be any naturally occurring amino acid
ALPFQSQSPPEPSSDSSISLCDRGNHLPDSVSXMGSSNREPVPARGFGSLVQIPDKIQNSLKVVHFGRFLKKNGFGGGSEAEMLPMQMQGTCTTVAPEVRLDKQLQAWKNNPIWSDEPPEIKVTVPQGSLCNLNLKFXAGLPPDAVYNIIIDPENKRVF

SEQ ID NO: 66791 - protein, 565 aa, Chlamydophila pneumoniae CWL029
MKVPWAFKNFIPKLYTSIKEGYSFNTFKKDFQAGITVGILAFPFAIAIAIGVGVSPIQGLLASIIGGLLASAMGGSNVLISGPSSAFISILYCLSAKYGAEALFTVTLLAGVFLIAFGLTGLGTFIKYMPYPVVTGLTTGLAIIIFSSQIKDFLGLQMGANIPADFLPKWIAYWDHLWTWDSKSFAVGLFTLLIMIYFRNYKPRYPGVMIAIVTATTLVWLLKIDIPTIGSRYGTLPTAIPLPKIPQLSITKILQLMPDALTIAVLSGLETLLSAVVADGMTGWRHQSNCQLVAQGVANIGTSLFSGIPVTGSLSRTAASIKSEATTPIAGIVHSIFICFILLLLAPLTVKIPLTCLAAVLILIAWNMSEIHHFIHLFTAPKKDIVVLLTVFILTVMTTITAAVQVGMMLAAFLFMKQMSDLSDVISTAKYFDKDSDFLSKAEVPQNTEIYEINGPFFFGIADRLKNLLNDIEKPPKIFILCMTRVPTIDASAMHALEEFFLECDRQGTLLLLAGVKKTPLADLKRYHLDELIGVDHIFSNIKSALLFAQALTNLESKTSTRHLV

SEQ ID NO: 66792 - protein, 513 aa, Coccidioides immitis RS
MPNEDGAAGLPRSMEPAATVVDQPSNKAADLILQRRQAPEISLAKSDQGLLAQLSSNPFFTAGFGLAGLGAGLTLAQRGIRYGAALLRRRMLVDVEISIKDDSYPWFLHWMTLYQRSQLANVSQKAGFFESFLRKITPGMRHLSIQTEKVELANGALQTHFSLIPGPGRHVLRYKNAFIFVNRVREAKSRDLQTGRPWETVTLTTLYSQRHIFEDLFREAHEYAAKSHEGKTVIYNSWGTEWRPFGQPRRKRPLDSVILEAGVKERIVADVKDFIGSASWYHDRGIPYRRGYLLHGPPGTGKSSFIQALAGELDYDIAILNLSERGLTDDRLNHLLSIIPSRTLVLLEDVDAAFSTRRVQADADGYRGANVTFSGLLNALDGVASAEERIIFLTTNHVERLDEALVRPGRVDMTVRLGEATRYQAAQLWDRFYGEFEHSEAYKQQFLEKLEKLGILEDENGRKPDLFRATSTAALQGLFLYNKGDMAGAIAMAEGLVGDEAADQVSVTGSVHS

SEQ ID NO: 66793 - protein, 445 aa, Moritella sp. PE36
MTELLSRLQQLKTDALASKPTVAGKLTRVVGLTLEAVGCRAAIGSLCSVETDNGLMDAEVVGFDGDKLFLMPSEQVIGIIPGAKVTPLNETQGIPVGMELLGRVLDGVGKPIDGKGEIITGQTTSFTAKRINPLARKKISKPLDVGVKAINAMLTVGQGQRMGLFAGSGVGKSVLLGMMTRGSTADVVVVGLIGERGREVKEFIEEILGEEGLARSVVVAAPADSSPLMRLKGCETSLAIAEYFRDQGLNVLLLMDSLTRFAQAQREIALAVGEPPATKGYPPSVFAKLPQLVERAGNGSDEQGSITAFFTVLTEGDDLQDPIADAARAILDGHIVLSRELTDAGHYPAIDIEKSISRVMPMVTTDFHQAAARGFKQAYSLYQQNKDLVAIGAYSKGSDAKIDRAIRLKPAMDQFLQQGMKEVIPFSQCEEMLAAIAPHLGVETS

SEQ ID NO: 66794 - protein, 309 aa, Zea mays
YTISFWIGSGNKDAKSAASPTGAVSGSPILASPHPPLPRRRADSRSRGSDPEDRDEAIAAGLEADGSGLDSPGSDKRQSGDCPQRKGFPGNGGGPSLSSGSSVWSSSRSVSDAEEDTGGPEDESEVFDDWEMAADALYVDDSSCNQSSGPTPTLPQAPTTAEPSHAAKPEPIQSKTRAWAPDDIFRPQSLPSISKQTSFPASIGNRWQDMGMSAAQQGILSLPLSCPICCDDLDLTDSSFCPCPCGFHMCLFCHNRILVEDGRCPGCRKQYNTVSAAEGGGGGGSRATVGTGREMEKRLSRSCSMGPSY

SEQ ID NO: 66795 - protein, 172 aa, Lactobacillus sakei subsp. sakei 23K
MSINFKDYVASVPDFPEAGVTFRDISPLMSDGEAYAAATDKIVEYAKNKGVEMIVGPEARGFIVGCPVAYKLGVGFAPARKKGKLPRETVSASYGLEYGKSTLYMHKDAVKPGQKVLVTDDLLATGGTIAATIKMVEELGGIVVGTAFFIELKDLNGREKIKDYDIFKLMEY

SEQ ID NO: 66796 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLIALPIDKIDPTHSYVKDIGDLSKHTLDKIKHFFETYKDLEPNKWVKVKGFEN

SEQ ID NO: 66797 - protein, 330 aa, Lactobacillus sakei subsp. sakei 23K
MSILVLGGAGYIGSHTVDQLIQRGYDVAVVDSLVTGHQGAINQKARFYQGDIRDKDFMRTVFQQEDVTGVIHFAAFSIVPESMQAPLKYFDNNTYGMTALLEVMNEFDVKRIVFSSTAATYGEPKSIPIKESDPQLPTNPYGESKLMMETMMKWADKAYGIKFVALRYFNVVGAKPDGSIGEDHHPETHLLPIVLQVAAGKRDQLSIFGDDYDTPDGTNVRDYVHVLDLADAHILAFEYLADGHDSNAFNLGSSTGFSNMEIVEAARKVTGKAIPLEMAPRRAGDPSTLIAASDKARETLGWAPKYDNMEAIIETAWNWHLNHPNGYADR

SEQ ID NO: 66798 - protein, 122 aa, Triticum aestivum
MAARLAQLRTKAAQAAEFASKHGGAYYKEAMEKNKQYVVQPPSVEKCQELSKQLFYTRLASLPGRYEALWKEVDGVKQLWKNRKELRVEDLGIATLFGVELYAWFCIGEIAGRGFTLTGYKV

SEQ ID NO: 66799 - protein, 352 aa, Desulfitobacterium hafniense Y51
MIFLIIDEKSYDLDKDNFRLASPSYALRREDSMTVDKTNLGIATFAGGCFWCMESVYSPLPGVLEVLSGYTGGHVENPTYNEVCSHTTGHREAIQIKFNPNIVSYKELLALFWRQIDPTDPGGQFHDRGESYQTAIFYHSEEQRRLAEESKQALISSSHFDKPIVTEILPAAPFYPAEDYHQGYHQKNAFRYALYRQGSGRDAFINKHWAKEKEQLKKRLTPLQFHVTQEKGTEPPFQNEFWNNKQEGIYVDVVSGEPLFSSRDKFDSGCGWPSFTRPVLKSNILEKIDLSHNMTRTEVISRNSESHLGHVFDDGPGPDGLRYCINSAALRFIPKEDLEREGYGDLLRLFRD

SEQ ID NO: 66800 - protein, 250 aa, Oryza sativa Indica Group
MARIKPKQLLIQSKTKKAPTRISYSTIVTWNLIVILVALSLYATYRHWHHSFTCFLTSFTDEIPHRPMLETEMDLPRAEHVGRSEDSTKTSRPSYAVIDTAKGSITIEIYKDASADVVDRFVSLCKSNHFKGMPFRHVIKNFVIQGGDFDFNGAAQEWILKAKASGENALSPKHEAFMIGTTKNPNNKGFDLFITTAPIPDLNDKLVVFGQVINGQDIVQEIEEVDTDEHYQPKTPIGILNITLKQQALS

SEQ ID NO: 66801 - protein, 252 aa, Desulfitobacterium hafniense Y51
MRLMNKVAIVTGAASGMGKSIALLYAKEGAKVVVSDLNLEGAHKVAEEITSAGGTALAIKTNVAVEEDIQALVDTAVSTYGTVDILVNNAGIMDNFEPAADIEDKNWERIFAVNTTSVMRATRKVLPIFLEKSSGVIVNIASAGGLNGARAGATYTASKHAVIGFTKNTGFMYAQQGIRCNAIAPGAVETNIGSTITAPHKFGSARAYAGMATNPRMGKPEEIAQVALFLAAEESSFVNGAVIVADGGWSAY

SEQ ID NO: 66802 - protein, 353 aa, Podospora anserina
MSNAQARGGARKISFNVSEQYDIQDVVGEGAYGVVCSAIHKPSGQKVAIKKITPFDHSMFCLRTLREMKLLRYFNHENIISILDIQKPRSYESFNEVYLIQELMETDMHRVIRTQELSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPNTSDMALDLLEKLLAFNPVKRITVEEALKHPYLEPYHDPEDEPTAPPIPEEFFDFDKHKDNLSKEQLKQLIYQEIMR

SEQ ID NO: 66803 - protein, 275 aa, Magnetospirillum magnetotacticum MS-1
MVVGSANVDLVVDVPRHPGGGETILGGELRRNPGGKGANQAVGAARAGGAGTTFVGALGHDDAADLLLASLDRGGVRTDLVERVDAATGTALITVSPDGENAIVVAPGANSHVTVGAAQAERIAAADVVLAQLEIPLDVVRAAAAARRPGALLVLNAAPSRDLPGDVWAAVDVLVVNEHEAADLAGASGDADPSALAGLLLERVPAVVVTLGGEGSLVAERRPAGPLLTTVPAIAVEAVDTTGAGDTFCGVLAAALARGADLPDAARLAAAAGAL

SEQ ID NO: 66804 - protein, 359 aa, Glehnia littoralis
MAGMKSSPSQDEEACVLAIQLATSTVLPMILKSAIELDILNTISKAGPGNYLSPSDLASKLLMSNPHAPIMLERILRVLATYKVLGCKRSELSNGEVEWLYCWTPVCKFLSNNEDGASIAPLLLVHQDKVPMKSWYHLTDAVLDGGTAFNKAYGMNIFDYASQDPQFNKVFNRSMAGHSTITMKKIVETYNGFEGLKSIVDVGGGSGATLNMIISKYPTIKGINFDLPHVVGDSPIHPGVEHVGGDMFASVPKGDAIFLKWIFHSWSDEDCLRILKNCYEALADNKKVIVAEFIIPEVPGGSDDATKSVVHLDAIMLAYVPGGKERTEKEFESLATRAGFKSFRKVCCAFNTWIMEFSK

SEQ ID NO: 66805 - protein, 843 aa, Arabidopsis thaliana
MGNHRAYKIPSSAPLRSHSSSSSSSPIDLSRNKFPNFLLRALLKTKKDFSTAILERKKSPNRLVVDEAINDDNSVVSLHPTTMEKLQLFRGDTILIKGKKRKDTVCIALADETCEEPKIRMNKVVRSNLRVRLGDVISVHQCPDVKYGKRVHILPVDDTVEGVTGNLFDAYLKPYFLEAYRPVRKGDLFLVRGGMRSVEFKVIETDPAEYCVVAPDTEIFCEGEPVKREDEERLDEVGYDDVGGVRKQMAQIRELVELPLRHPQLFKSIGVKPPKGILLYGPPGSGKTLIARAVANETGAFFFCINGPEIMSKLAGESESNLRKAFEEAEKNAPSIIFIDEIDSIAPKREKTNGEVERRIVSQLLTLMDGLKSRAHVIVMGATNRPNSIDPALRRFGRFDREIDIGVPDEIGRLEVLRIHTKNMKLAEDVDLERISKDTHGYVGADLAALCTEAALQCIREKMDVIDLEDDSIDAEILNSMAVSNEHFHTALGNSNPSALRETVVEVPNVSWEDIGGLENVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGNSAGDAGGAADRVLNQLLTEMDGMNAKKTVFIIGATNRPDIIDSALLRPGRLDQLIYIPLPDEDSRLNIFKACLRKSPVAKDVDVTALAKYTQGFSGADITEICQRACKYAIRENIEKDIENERRRSQNPEAMEEDMVDDEVSEIRAAHFEESMKYARRSVSDADIRKYQAFAQTLQQSRGFGSEFRFDSTAGVGRTTGVAAADPFATSAAAADDDDLYS

SEQ ID NO: 66806 - protein, 336 aa, Streptococcus dysgalactiae
MVVKVGINGFGRIGRLAFRRIQNVEGVEVTRINDLTDPNMLAHLLKYDTTQGRFDGTVEVKEGGFEVNGNFIKVSAERDPENIDWATDGVEIVLEATGFFAKKEAAEKHLHANGAKKVVITAPGGNDVKTVVFNTNHDILDGTETVISGASCTTNCLAPMAKALHDAFGIQKGLMTTIHAYTGDQMILDGPHRGGDLRRARAGAANIVPNSTGAAKAIGLVIPELNGKLDGAAQRVPVPTGSVTELVVTLDKNVSVDEINAAMKAASNDSFGYTEDPIVSSDIVGVSYGSLFDATQTKVMEVDGSQLVKVVSWYDNEMSYTAQLVRTLEYFAKIAK

SEQ ID NO: 66807 - protein, 575 aa, Podospora anserina
MAIDIRTQGLKKPVPVAQYLFARLYEIGIRSVHGLPGDFNLVALDYIPKAKLKWVGSVNELNAAYAADGYARALGISALVTTFGVGELSAMNGVAGAYSEHVPVVHIVGCPSTISQRNGMLLHHTLGNGDFNVFANMGSQIACNTARLNNPAEIAEQIDFALRECWIHSRPVYIMLPTDMVEKQIEGARLDTPIDLSDPPNEPEREDYVVDVVLRYLHAAKNPIILVDACAIRHRCLEEVRNLVDKAKLPVFVTPMGKGAVNESSPTYGGVYAGTGSQPAVQELVESADLVLSIGALKSDFNTTGFSYRTSQLNTIDFHSDHCKVRYSEYPGVAMKGVLRKLIERVDTTKLSSEKLAPKVVNEVSENRDSTETITQAWFWPRVGEYFKEKDLVVTETGTSNFGIWESKFPPDVVGITQILWGSIGWSVGAAQGVAQAVKDMGEDRRTILFVGDGSFQLTVQEVSTMIKHKLRVTIFLIYNEGFTIERCIHGMEAEYNDIRRWNYTEIPTVFGATDKEVRKHIIKTKSELEKLLADKDFNDAKGLQLVELWMPKHDAPRALKLTAEQSAKNNARME

SEQ ID NO: 66808 - protein, 265 aa, Haemophilus somnus 2336
MSIEVWSLIRAEAAKLAENEPMLASFFHATILKHNNLGSALSYILANKLANPIMPAIALREIIEEAHQNQPQIIESAACDIRAVRHRDPAVEQYSTPLLYLKGFHALQSYRITHYLWQQGRKALAIYLQNQISVAFDVDIHPAARIGCGIMFDHATGIVIGETSVIENDVSILQGVTLGGTGKESGDRHPKIREGVMIGSGAKVLGNIEIGRYAKIGANSVVLQFVSEYTTVAGVPSQIVGKNKGAKPAFDMDQYFIDDAINLNI

SEQ ID NO: 66809 - protein, 158 aa, Vibrio vulnificus YJ016
MIRIGHGFDVHKFGGEGPVIIGGVAVPYEQGLIAHSDGDVALHALSDALLGAIAAGDIGRHFPDTDDKWKGADSRELLKDVYRRVKEQGYKLGNADVTIIAQAPKMAPYIDAMREAIAHDLETDIRNINVKATTTERLGFTGRKEGIATEAVVLLIKQ

SEQ ID NO: 66810 - protein, 422 aa, Aspergillus oryzae
MPLWGSKSSQESDNAALESDPKNDPVASASQAAGTEWLAGHLNHLTEDQEKKLREFKKLSEENGYYKSAGDSGEASHDDATMLRFLRARKFDVNGAWGQFKDTEDWRKENAIESLYENIDVESYDAARRMYPQWTGRRDRRGIPVYVFEIRHLNSKNMAAYNSTMTDPSATAETHKSSTVPQRLLRLFALYENLLRFVMPLCSQLSRPHPDTPIVSSNNIVDVSGVGLKQFWNLKGHMQDASVLATAHYPETLDRIFIIGAPSFFPTVWGWIKRWFDPVTTSKIFILSSAEVLPTLSSFMDPTTIPKQYGGQLDWQWGDMPNLDDEARKLVGGLETPPAEGETKPNFIKGPVLFKGDHVEILGKVNGESRKRSVPVPASPAAESTTPAPEQQKSDDALAAEVNEKLDLNGATEKTGNGDVAA

SEQ ID NO: 66811 - protein, 466 aa, Myxococcus xanthus DK 1622
MRKAKIICTLGPASDTPEVIEGLIRAGMNMARLNFSHGTHEEHRRRVETIRKVAKRLGTPVAILQDIQGPKIRLGRFDGGQLLVKQGQSVTVTTRNVLGQDGVIPTPIKSLVKDVAKGHEILLDDGRVRLRVLRVHGQDVQCRVEVGGVLKNHKGLNLPGSPMSVPTITRKDAVDLAFGQEVGVDYVALSFVRTPEDIKKARAHVAKLKTPLIAKIEKPQAVERVEEIAAVADGIMVARGDLGVEMPLERLPAIQKHMVSAVNRMGGLVIVATEMLESMVANARPTRAEVSDVANAILDGADAVMLSGETAAGKYPVEAASTMACIVEETERGVVKHQHHSPFERSEDLGTGVAAAAVAAATQLGIGTIVAYTESGHTARLISEFRPHARIIALTPSETAVNRMALYWGVTGMQVARVSTTDAMLTQVRQLCRKEKLCAPGTPVVVVAGVPLNVPGNTNLMSIHRI

SEQ ID NO: 66812 - protein, 532 aa, Synechococcus sp. CC9605
MSFPDFSASDAHIQWQRFCDLSWYHDDLGVWLDISRMHVNASDLQQLQPRMDKAFAAMQELEAGAIANPDEQRQVGHYWLRTPELAPSSELQQHISREIDLIAAFGRDVVNGTIKAPNGEAFTDVLWIGIGGSGLGPALMIKALQNPGEGLPFHFFDNVDPNGMSNVLAGLEGRLDRTLVVTVSKSGGTPEPHLGMEQARHRLEAAGGQWAGQAVAVTMLDSKLDQQAQKEGWLKRFDMFDWVGGRTSITSAVGLLPGALIGCDIRDFLSGASQMDAATRMADLRRNPAALMAASWHVAGGGRGQRDMVVLPYRDRLEVFSRYLQQLVMESLGKRLDRNGDVVHQGIAVYGNKGSTDQHAYVQQLRDGVDNFFATFIEVLEDVSDIPTISGECPGDFLDGFLQGTRSALTESGRQSMTISMRCFDARRLGALIALFERAVGLYGELVNINAYHQPGVEAGKKAAAAILNLQGRVEAILADGVARSADEIRLALGDGTDESIFWILRHLTGNQRGFSAQGDWSQPASMRFSKG

SEQ ID NO: 66813 - protein, 179 aa, Oryza sativa
  misc_feature (18)..(18): Xaa can be any naturally occurring amino acid
  misc_feature (70)..(70): Xaa can be any naturally occurring amino acid
  misc_feature (81)..(81): Xaa can be any naturally occurring amino acid
  misc_feature (87)..(87): Xaa can be any naturally occurring amino acid
  misc_feature (90)..(90): Xaa can be any naturally occurring amino acid
  misc_feature (106)..(106): Xaa can be any naturally occurring amino acid
  misc_feature (113)..(113): Xaa can be any naturally occurring amino acid
  misc_feature (135)..(135): Xaa can be any naturally occurring amino acid
MAPSVMASSATTVAPFQXGLKSTAGMPVARRSGNSSFGNVSNGGRIRCMQVWPIEGIKKYETLSYLPPLXTVDDLLKQIEXLLRSKXGPXLEFTKVRFAYRENHRXPGYYDGXRYWTMWKLPMFGCTDATQVLKXELEEAKKAYPDAFVRIIGFDNVRQVQLISFIAYKPPGCEESGGN

SEQ ID NO: 66814 - protein, 539 aa, Paxillus involutus
MSLSKHVNAESLIRESKDKKHPHHHRSTTTSISTISYGARYGTQSIPKFHLPSKGTSAENAYQLIHDELALDGSPSLNLASFVHTWMPEPANKLMVENMSKNLIDQDEYPMTQLIHTRCVSILADLWHAPSTKQAIGTATTGSSEAIQLGGLAMKRIWQEHRKAAGKSIHEPGPNIVMGANAQVALEKFARYFEVECRLVPVSAESKYRLDPKKAMEYIDENTIGVFVILGSTYTGHYEPVKEMADLLDEYEKQTGHSVPIHVDGASGAFIAPFAQPKLLWDFKIPRVVSINTSGHKFGLAYVGVGWVVWRSKEYLPKDLIFELHYLGSVEYSFSLNFSRPAAPIIAQYFNFLHLGFEGYRAVALDDLKNARLLSRVLEGTGWYTVLSDIHRQKSNSLLTKGMQATIGIDEEHLENYMEGLPVVSFRFSDKFQEQYPEIQQKWIQTLLRAKGWIVPNYELPPNLEKVQILRVVVRENCTEVLIDRLVTDIVEITQNLVDRDSSTHALDMLGNGQHCKTVIGQMEEGSGSRSSGTYAKQC

SEQ ID NO: 66815 - protein, 526 aa, Chlamydophila pneumoniae CWL029
MERKRFIDCDSTKILQELALNPLDLTAPGVLSAERIKKFSLLGGGFTFSFATERLDDAILAALISLAEERGLHESMLAMQQGQVVNYIEGFPSEMRPALHTATRAWVTDSSFTGEAEDIAVRSRVEAQRLKDFLTKVRSQFTTIVQIGIGGSELGPKALYRALRAYCPTDKHVHFISNIDPDNGAEVLDTIDCAKALVVVVSKSGTTIETAVNEAFFADYFAKKGLSFKDHFIAVTCEGSPMDDTGKYLEVFHLWESIGGRFSSTSMVGGVVLGFAYGFEVFLQLLQGASAMDQIALQPNARENLPMLSALISIWNRNFLGYPTEAVIPYSSGLEFFPAHLQQCCMESNGKSIAQDGRRVGFSTSPVIWGEPGTNGQHSFFQCLHQGTDIIPVEFIGFEKSQKGEDISFQGTTSSQKLFANMIAQAIALACGSENTNPNKNFDGNRPSSVLVSSQLNPYSLGELLSYYENKIVFQGLCWGINSFDQEGVSLGKALANRVLELLEGADASNFPEAASLLTLFNIKFR

SEQ ID NO: 66816 - protein, 591 aa, Neisseria meningitidis
MAKTYLLTALIMSMTISGCQVIHANQGKVNTHSAVITGADAHTPEHATGLIEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAVGQILGILNEFSPNQVGYDAEGLRLLGDASRLAFADRDVYLGDPDFVPVPIRQLISKDYLKHRSQLLEQSDKALPSVSAGDFIHEWVSSQAIELPSTSHISIVDKAGNVLSMTTSIENAFGSTLMANGYLLNNELTDFSFEPIKQGKQVANRVEPSKRPRSSMAPTIVFKAGKPYMAIGSPGGSRIIGYVAKTIVAHSDWNMDIQDAISAPNLLNRFGSYELETGTTALQWQQALNDLGYKTDVRELNSGVQAIIIEPSRLVGGADPRREGRVMGD

SEQ ID NO: 66817 - protein, 124 aa, Prochlorococcus marinus str. MIT 9303
MSHAWKKWQCIQNCGACCRLDPTERGEAIAVLNERQQEIYLGMVNPDGWCKHYDTGGRRCRIYNSRPDFCRVGLLASLFNLPQDKSESFAIQCCRQQIRSVYGGRSRELRNFERSLRLPFQKDG

SEQ ID NO: 66818 - protein, 217 aa, Zea mays
  misc_feature (216)..(216): Xaa can be any naturally occurring amino acid
MAAVPASAPAAAEAAELVPTLSSLEPVYGAGAQLDESRLRFARLGDRFHAVYGARPALFARSPGRVNLIGEHIDYEGYSVLPMAIRQDMIVAIRRANGAQEIDVKNHKWGHYFMCGYKGVYEYCRSKGIDLGKPVALDVVVDGTVPQGSGLSSSAAFVCSATIAIMGILDKNFPKKEVAQFTCLSERHIGTQSGGMDQAISIMAKPGFAELIDFNXI

SEQ ID NO: 66819 - protein, 172 aa, Triticum aestivum
  misc_feature (156)..(156): Xaa can be any naturally occurring amino acid
  misc_feature (166)..(166): Xaa can be any naturally occurring amino acid
MENGSSKGDVPEDANAHCPGTQSDEAGKADSCAGCPNQQICATAPKGPDPDLVAIAERMATVKHKILVLSGKGGVGKSTFSAQLSFALAEMDHQVGLLDIDICGPSIPKMLGLEGQDIHQSNLGWSPIYVESNLGVMSIGFMLPNPNDAVLWRGPXKNRLIQQFLXKDVDWG

SEQ ID NO: 66820 - protein, 593 aa, Xanthomonas axonopodis pv. citri str. 306
MSFDPPFSHGSTASGLSRRRFVQGLALGGIAASGLWRNDARAAAQANTPVLRGSSQSLQIGRLPVNFTGRPRSAITVNQSLPAPTLRWREGDTVSVRVRNALTDQPTSVHWHGLLLPANMDGVPGMSFDGIAPGQEYHYRFALRQSGTYWYHSHSMFQEQSGLYGAIVIDPLVPPPYRHDREHVVLLSDWTDLDPAALFRRLKQMPSHDNYAQRTVGDFLRDARDDGLRATLADRGMWGRMRMTPTDLSDVNANTYTYLLNGVAPAGNWTGLFKPGEKVLLRFINGSSMTYFDIRIPGLRMTVVAADGQYVHPVSVDELRIAAAETFDVIVEPLGQDAFTLFAQDMGRTGFACGTLAVQHGLQAPIPALDPRAILTMQDMGHGDGMDHALPAMHGAPGMLAAHGMHTMHSHDDAKAHDKAPHHSASETGNPLIDMRSNATAPRLDDPGVGLRDNGRRVLCYADLHSVFDDPDGREPGRDIELHLTGHMEKFAWSFDGIAFASAQPLQLQYGERLRIVLVNDTMMQHPIHLHGMWSDLEDAHGNFQVRKHTIDMPPGTRRTYRVRADALGRWAYHCHLLYHMEAGMMREVRVEA

SEQ ID NO: 66821 - protein, 132 aa, Helicobacter pylori
SNIKYELDKESGALMVDRVLYGAQNYPANYGFVPNTLGSDGDPVDVLVLSDVAFQAGSVVKARLVGVLNMEDESGMDEKLLALPIDKIDPTHSYVKDINDLSKHTLDKIKHFFETYKDLEPNKWVKVKGFEN

SEQ ID NO: 66822 - protein, 430 aa, Synechococcus sp. RS9917
MFDSLDLVIDTIVAREVLDSRGNPTVEAEVLLEGGASGRAIVPSGASTGAHEAHELRDGGSRYMGKGVTQAVDHIEERIAPALCGLSALDQASVDAAMQELDGSANKSALGANAILAVSLATARAAANGVGLPLYRYLGGPMASLLPVPLMNVINGGAHAANSLDFQEFMLVPHGAPSFREALRMGTEVFHTLKGLLQERGLSTSVGDEGGFAPDLGNHEAGDILVQAIEKAGYKPGEQIALALDVASTEFYADGRYAFGGGSFSSAEMVDQLEALVNRFPIVSIEDGLAEDDWDGWKLLTERLGSRVQLVGDDLFVTNSQRLQQGIDHNTANSILIKVNQIGSLTETLQAIDLAGRSGYTSVISHRSGETEDTTIADLAVATRAGQIKTGSLSRSERVAKYNQLLRIEDELGSQAVYAGAVGQGPRGRG

SEQ ID NO: 66823 - protein, 544 aa, Emericella nidulans
MGIASLERDTKGGTRFTGCTSIREFEFLGKLGEGTFGEVYKARAKRDGSIVALKKILMHNERDGFPITALREIKLLKMLSHTNIMQLREMAVERSKGEGRKKPSMYMVFPYMEHDLSGLLENPEVHFSEAQIKCYMIQLLEGLKYLHGNCILHRDMKAANLLISNQGILQIADFGLARPFDEAPPQPGKGAGEAKRDYTTLVVTRWYRPPELLLQLRRYTSAIDMWGVGCVFGEMFKGKPILAGNSDLNQAQLIFSLVGTPTEENMPGWSSLPGCEGVKHFGNRPGNLAEVFKDQGPMAISLLTELLKLDWRKRVNAIDALKHPYFSTPPLPARPGDLPSFEDSHELDRRRFRGQRAAMPPAPAGGSVGMSRNGGWSTNSGSRTGAETRNPRISSAARSQGNQLRDAWSNEPQQAWQRRGNEELKDPNHSFSSRHRDGGLPPKPPAPIQHSWASGHSDKTGRDRGYGARYGGPEGSVDSYVPNYGGSDRNRDRDQGTAISDRRGSYYDKSHQTSKLDYSREIPSRRRSRSPNYRERVDRGPYRR

SEQ ID NO: 66824 - protein, 174 aa, Triticum aestivum
  misc_feature (104)..(104): Xaa can be any naturally occurring amino acid
  misc_feature (135)..(135): Xaa can be any naturally occurring amino acid
  misc_feature (143)..(143): Xaa can be any naturally occurring amino acid
  misc_feature (154)..(154): Xaa can be any naturally occurring amino acid
  misc_feature (161)..(161): Xaa can be any naturally occurring amino acid
  misc_feature (169)..(169): Xaa can be any naturally occurring amino acid
MAPAVMASSATTVAPFQGLKSTAGLPVSRRSGSAGLSSVSNGGRIRCMQVWPIEGIKKFETLSYLPPLSTEALLKQVDYLIRSKWVPCLEFSKLGFVFREHNSXPGYYDGRYWDNVGTAYFGCTDATQVLNKWRXVKKDYLTXYVRVIGFHNIXQVQCVSXNASRHKFXESGKA

SEQ ID NO: 66825 - protein, 522 aa, Xylella fastidiosa Ann-1
MTPNIHHDKILILDFGAQYTQLIARRIREIGVYCEVWPWDHSPEEILSFGAKGIILSGGPESTTSPGAPAAPQHVFDSDLPIFGICYGMQTMAVHLGGATEAADKREFGHASLQVIYPDTLFSGLSDHPSEFRLDVWMSHGDHVSRVPPGFTITAATDRIPIAAMSREDKRWYGVQFHPEVTHTLQGQALLRRFVVDICGCQTLWTSANIIEDQIARVRERVGCDEVILGLSGGVDSSVVAALLHKAIGSQLTCVFVDTGLLRWGEGDQVMAMFSEHMGVNVVRINAASRYFDALQGVYDPEAKRKIIGNLFIQIFEEEASKRKQAKWLAQGTIYPDVIESAGSKTGKAHVIKSHHNVGGLPEQMTLGMVEPLRELFKDEVRRLGVAMGLPHAMVYRHPFPGPGLGVRILGEVKPEYAELLAKADSIFIDELHQADLYDKVSQAFAVFLPVKSVGVVGDARAYEWVIALRAVETVDFMTAHWAPLPYDFLSTVSNRIINELRGVSRVVYDISGKPPATIEWE

SEQ ID NO: 66826 - protein, 254 aa, Zea mays
  misc_feature (121)..(121): Xaa can be any naturally occurring amino acid
TRSTPRPPILSYGGDGGASYEWSPADLPMLAVASIGAAKLSLAAGGLSLPSYSDSAKVAYVLQGAGTCGLVLPEATKEKVVAVKEGDALALPFGAVTWWHNGPAAQADLTVLFLGDTSKGXGGRVVVLNTANLPLVREVGLGADLVRIDAHSMCSPGFSCDSAYQVTYIVRGSGRVQVVGPDGRRVLETRIEGGSLFIVPRFHVVSKIADASGMEWFSIITTPDPVFSHLAGKTSVWKAISPECCRRPSHHSGD

SEQ ID NO: 66827 - protein, 490 aa, Podospora anserina
MLSQRLLLGRTAVRSALKPSGCAEEKDLVIIGGGVAGYVAAIKAGQEGMKVACIEKRGTLGGTCLNVGCIPSKSLLNNSHLYHQILHDTKHRGIEVGDVKLNLQQLMKAKETSVTGLTKGVEFLLKKNGVEYIKGTGSFQDEHTVKVELNDGGETSVTGKNILIATGSEVTPFPGLTIDEQTVISSTGAIALEKVPEKLVVIGGGIIGLEMASVWSRLGSKVTVVEYLDQIGGPGMDTEVAKGIQKILKKQGITFKTGTKVLSGEKTGDEVKVQTEAAKGGKEETLDADVVLVAIGRRPYTGGLGLENIGLELDERGRVIIDAEYRTKIPHIRCVGDATFGPMLAHKAEEEAVAVVEYIKKGYGHVNYGCIPSVMYTFPEVAWVGQSEQDLKKADIPYRVGTFPFSANSRAKTNLDTEGFVKILADPETDRLLGIHIIGPNAGEMIAEGTLALEYGASSEDIARTCHAHPTLSEAFKEAAMATHAKAIHF

SEQ ID NO: 66828 - protein, 305 aa, Oryza sativa Japonica Group
MDHEADAYRTDLMTITRFLAPEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQAGGQSFTGKERALDLVPTKIHERSPIFLGSFEDVEEIKGLYAAQANVIVLRPGTAS

SEQ ID NO: 66829 - protein, 182 aa, Yarrowia lipolytica CLIB122
MSLQTLQTELKAKLRQYQDFPSKGIVFEDILPIFQDPKSFQQLIDAFKLHIKDTFGDKKIDVIVGLDARGFLFGPTLALAIGAAFVPVRKQGKLPGKTVHAEFQKEYGKDVFEIQEDAIKPGQTVIVVDDIIATGGSAACAGDLVTKLKGEVLEFIFILELLFLKGRDKLCAPAYTLLSGQE

SEQ ID NO: 66830 - protein, 354 aa, Coprinopsis cinerea okayama7#130
MAANLVNGNTATGSPNPSGSTTPVTPVPDSVFDDSVVSHRFAGHIGFLTKAQTEAFEAFKELLVQEGLYRPSVLSEDGKSVVEPASHDDPTVLRFLRARSFQPPEALAQFKRAEEWRKEQDVDNLFATGFTAEELETARRFYPRSNNSIPISRPIQQGLPLYVYRIAALESMQKELDAVPSKRRYQRIVILYEMMVRFMFGLCSHLPHPTSPHPISCTTNIIDLGDASFTSMFRLRGHFQEASRLATPYYPETLGTIIVVNAPSYFPTIWSWIKGWFDEGTRRKIHVLGKDAAPTLTELIHAKDLPKIYGGELEWTFFDQPNLDEDAKAVLPDGFPEGVASFKDGNVIRPGESQ

SEQ ID NO: 66831 - protein, 323 aa, Oryza sativa Japonica Group
MAGPADGAQCTVQPFAAGSQPWLLTGSTILTGSRFNATLMLEMLRGKRMMFVGDSLNRGQYVSLVCLLHRSIPESSKSMETFDSLTVFRAKNYNATIEFYWAPFLAESNSDDAVVHRIADRIVRGTALEKHARFWKGADILVFNSYLWWMTGQKMKILQGSFEDKSKDIVEMETEEAYGMVLNAVVRWVENNMNPRNSRVFFVTMSPTHTRSKDWGDDSDGNCYNQTTPIRDLSYWGPGTSKGLMRVIGEVFSTSKVPVGIVNITQLSEYRKDAHTQIYKKQWNPLTPEQIANPKSYADCTHWCLPGLQDTWNELLYSKLFFP

SEQ ID NO: 66832 - protein, 413 aa, Arabidopsis thaliana
  misc_feature (166)..(166): Xaa can be any naturally occurring amino acid
MARKKHRKLFPTLASETNKTLDCSNGVCDPICPYNCYPEPDYYTISPQLPPWSSSPQPSPCPSPSISAVYLPSQDSSSSLDAISIITITGAVLAILLTGFFLVAKFFSDSVNRVNQGTYQSDNEDNDTVMEEEFQDREQVDHPIWLIRTTGLQQSIINSITICNYXRGDGLIERTDCPVCLNEFEEDESLRLLPKCNHAFHISCIDTWLSSHTNCPLCRAGIAMISVTTPRYSGPVEVTPGGSGSHLENDGVDEEDHGEIENRVDSDFKESDDSDIRIEIYRFDSDGDGSETETKERVRVLKECMDPNGGDSVNSLSHTKTHVESVDFPGKSCENQSEEFTRHNGEDEASCSEENGGGSNQLRRSCDSGELNGETTGDEGKSQSDISSSTLKTNGSSSSVSCFNKNKSSVFPL

SEQ ID NO: 66833 - protein, 472 aa, Salmonella typhimurium LT2
MSQNVYQFIDLQRVDPPKKPLKIRKIEFVEIYEPFSEGQAKAQADRCLSCGNPYCEWKCPVHNYIPNWLKLANEGRIFEAAELSHQTNTLPEVCGRVCPQDRLCEGSCTLHDEFGAVTIGNIERYINDKAFEMGWRPDITGVRQTDKRVAIIGAGPAGLACADVLTRNGVKAVVFDRHPEIGGLLTFGIPAFKLEKEVMTRRREIFTGMGIEFKLNTEVGRDVQLEDLLKDYDAVFLGVGTYQSMRGGLENEDADGVFDALPFLIANTKQIMGFGETSDEPYVSMEGKRVVVLGGGDTAMDCVRTSIRQGATHVTCAYRRDEENMPGSRREVKNAREEGVEFQFNVQPLGIEVNANGKVSGVKMVRTEMGEPDAKGRRRAEIVAGSEHVVPADAVVMAFGFRPHSMEWLAKHSVELDSQGRIIAPERSDNAFQTSNPKIFAGGDIVRGSDLVVTAIAEGRKAADGIMNYLEV

SEQ ID NO: 66834 - protein, 809 aa, Yarrowia lipolytica CLIB122
MELPKKPRSFKKGRDDRVGLTALGADPEKARQDQLDLLHQVTNAKDVEGYRYLRNLDLNVGSSGFATWYMISSSFPLIAAAIGPLANMCAIAALTEPWLYYPSHSYPKDNGGTKYDTIGDKPWVTALNAVSLLMGVMSNLSLLMNFAGRINYTFSQVFSIGGFFSAGVILMALTMICKYVLLNDELGLTSSYWHAVLTAACYFAASLLLFINEIGHLKGYYGATFNLSKAQRSLMLQNIALVVWIASGAGLFQYLMDLSYPDALYLCQVSLLTIGLGDLHPLRVVSRALMIPFALIGTLMLGLIIASIRSMILTSSSETLTWNYAERSRKKEMRNLKDSSSTYNERDGFDKMREFHQKAESYRTWLHLFFAGVIFAGFLTLGALCFYLVEEDWTYFDGIYFCCLCLLTIGYGDPAPNSTVGRSFFIVWSMAAVPMMTILISSMGDTIIRKVMEMSDRLGDWALEFHGFGLPRVSTRSQEAMNDATSATAVAGDGDSESPPGFHHRAMSLFKYTRRNTNGGNGNGNGNDNDNNGNNNGDNDKENPGSTSSDADSICDKVPEPVDNFPTGDYLQDLSSTIVELTLALQRTFNKEVNEPHYKYSFDEWKRMLKLCSRLLYLRNPEAFRKKKMSPDERADKVMQGDTEGDSEIEEEICSITSILQDDQNEQAKETMEKEGLPIPPNMQNSSAPGMNSVNSVGDIINASRNNLRNPDGREPEIKFQEPQKQAKDSDQHHTKNNPLPTADPEKLHEAREHVDKHVSEILPHYWLSDLSPLRFPVREVRIFNKKYLNTLEAVALLMKKALEDAERG

SEQ ID NO: 66835 - protein, 202 aa, Brassica napus
MESPFKPDVLKGKVALITGGGSGIGFEISTQFGKHGASIAIMGRRKQVLDAAVSDLRSLGIPAIGLEGDVRKPEDARRVVESTYQHFGRIDILINAAAGNFLSAAEDLSTNGFRTVLDIDAVGTFNMCHEALKYLKKGGPGRDPSSGGGSIINISATLHYTASWYQIHVSAAKAAVDATTRNLALEWGTDYEIRVNGIAPGP

SEQ ID NO: 66836 - protein, 489 aa, Glycine max
MALNLIHRPATKPPSSSSSFVTPRPLRTTQSIPVRNSRRSIAVRAAATEAPVATITAARECRVKSVKARQIVDSRGNPTVEVDLVTDGLFRAAVPSGASTGIYEALELRDGDKSVYGGKGVLNAVRNINEVLAPILVGVDVRNQADVDAIMLEIDGTPNKSKLGANAILGVSLSVCRAGAGAKGVPLYRHIQEISGTKELVMPVPAFNVINGGSHAGNNLAMQEFMILPVGATSFAEAFRMGSEVYHVLKGIIKAKYGQDACNVGDEGGFAPNVQDNREGLVLLMDAIDKAGYTGKIKIGMDVAASEFYTKDGKYDLNFKKQPNDGAHVHSAQSLGQLYKDFVKEFPIVSIEDPFDQDDWGSWASLLASVDIQLVGDDLLVTNPKRIAEAIKKKACNGLLLKVNQIGTVTESIQAALDSKAAGWGVMVSHRSGETEDNFIADLSVGLASGQIKTGAPCRSERLAKYNQLLRIEEELGSVRYAGETFRSP

SEQ ID NO: 66837 - protein, 399 aa, Pseudomonas syringae pv. syringae B728a
MSGNRGVVYLGAGKVEVQSIPFPKMEDPRGKRIEHGVILRVVSTNICGSDQHMVRGRTTAQTGLVLGHEITGEVLEAGRDVEHLKVGDLVSVPFNVACGRCRSCKEQNTGVCLTVNPARPGGAYGYVDMGDWVGGQAEYVLVPYADFNLLKLPDRDAAMEKIRDLTCLSDILPTGYHGAVTAGVGPGSTVYVAGAGPVGLAAAASARLLGAAVVIVGDVNPTRLVHAKAQGFEIADLSQDTPLHEQIAALLGEPEVDCAIDAVGFEARGHGHAGAQAEAPATVLNSLMGVVRVAGKIGIPGLYVTEDPGAVDAAAKMGSLSIRFGLGWAKSHSFHTGQTPVMKYNRQLMQAIMWDRIKIADIVGVEVISLDDAPRGYGEFDSGVPKKFVIDPHGLFGAA

SEQ ID NO: 66838 - protein, 298 aa, Bacillus pumilus SAFR-032
MRDIRVYHVDAFTTEKFGGNAAGVVLDGDLLTEDEMQNIAKELNLPESVFLLPAHDKEADYRVKYFTPTEEVNFCGHATVGLTWLLATELGLAKEKTGVVLETKIGHVPVVWHEENGKVIDVEMTQVTPKTRDFMIDLEELSDMIGVSSDRIDPSYPIKLANTGNWHLLVPMKHQQDIDQAAPNLAALGKMNKEQNITTTHLYTFHTAKEVDLYTRDFAPGIGIPEDPVTGAANGALAGYLYIEGIISQQETTRLNIAQGDAIGRPGILRITVIPNESKPVIKVAGAAVITIRGVLTI

SEQ ID NO: 66839 - protein, 303 aa, Prochloron didemni
RIGRNFLRCWAGRENSQLDLVGINDTSDPKTNAHLLKYDSMLGIFDGDVDADENSLIVNGKTIKCVSDRNPLNLPWADWGIDLIIESTGVFVTEEGASKHLTAGAKKVLITAPGKGGNIGTYVVGVNEKDYEHHKHNVVSNASCTTNCLAPFAKVLNDTFGIVKGTMTTTHSYTGDQRLLDASHRDLRRARAAAINIVPTSTGAAKAVALVVPELKGKLNGIAMRVPTPNVSVVDLVVQVEQGCIKEQVNDALKAAAEGPLKGILRYNDLPLVSCDYRGTDCSSIVDGSLTMVMGGDMVKVVA

SEQ ID NO: 66840 - protein, 182 aa, Paxillus involutus
MGLSVSRLLSTLFKNREMRILMVGLDAAGKTTILYKLKLGEIVTTIPTIGFNVETVEYKNISFTVWDVGGQDKIRPLWRHYFQNTQGIIFVVDSNDRERVSEAREELQRMLNEDELRDALLLVFANKQDLPNAMNAAEITDKLGLQALRQRTWYIQAACATSGDGLYEGLEWLATNINKRRT

SEQ ID NO: 66841 - protein, 192 aa, Moritella sp. PE36
MKNIPNILTLFRVILIPFFVLAFYLPIENSFYIAAWIFFIAGVTDYLDGYIARRWNVSSKLGAFLDPVADKIMVITALVMVAADHDRIAATVGEHSALWIMIPTLIMIGRELAISGLREWMADLGKRANVAVGNAGKWKTSLQMLALGGFIWQQGPWMVYLAYLVFYAAMVLTVVSMVQYFAAAWGELTSED

SEQ ID NO: 66842 - protein, 647 aa, Kluyveromyces lactis NRRL Y-1140
MDLNRHATPGVPQYPLQNVPVPYRYQLHPQPASQSKRSIHYPLQQLDDDSDSDGQYHKKLKPNQQAVSSPNLIEDQDGPLPISPIASPCHTPEVEEPSIDEVIGTTVARLSSTTSHPNALTSLIFGLVSNMDRTQLSDLVSIITDNLKRDLFQSLPNEITVKILLNLSSEDIFACLLVNRNWNRLIEEAPVVWKWLMLNEGFVTEDQFPSYCNSLPSKYKHLINPDDRFRLDFLENNWCLQNWYDPNYKPGRTCLDGHSTNVVTCLQFENNYIITGADDKKINVYDAENDLFLLELNGHEGGVWALKFVDGKILVSGSTDRSVRIWNIETGKCTHVFKGHTSTVRCLEVVEYGDSKYIVTGSRDNTLHVWKLPPMKELDKGSQEPIFYRTPEENPYFVGVLRGHMSSVRTVSGHGRIVISGSYDHNLMVWDIISMKLLYILTGHTDRVYSTIYDYKRNRCISASMDTTVMIWDLENIENNGTTTTINDGASIKVVGSMKCLYGHTALVGLLCLSNKFLVSAAADGSIRGWDPNDYSRKFSFHHTNLAAITSFSMNDNILVSGSERQFNVYNLRTGKLIHRKLLTDSEQVWGIKLNNRKLVAAIESVGHSYVEILDFAARNGDKTIRTRTRTRVDHQIYRTSLWSSTL

SEQ ID NO: 66843 - protein, 300 aa, Gloeobacter violaceus PCC 7421
RIGRLVLRAGLDNPDLEFVGINDLVPPDNLAYLLKHDSTHGRFKGTVEAHPDGMVVNGRFIPCTAIKNPVELPWGSLGVDYVVESTGLFTGYDGASHHLAAGARRVVITAPTKDPEKVPTLLMGVNHDQFDPDQDLIVSNASCTTNCLAPVAKVIHERFGLAEGLMTTVHAMTATQPTVDGPSKKDWRGGRGAAQNVIPSSTGAAKAVTLVLPELKGRLTGMAFRVPVPNVSVVDLTFKTEQPTSYKAICAAMKEASENELAGILGYTEEQVVSSDFIGDAHSSIFDAGAGIELNSQFFK

SEQ ID NO: 66844 - protein, 582 aa, Blastopirellula marina DSM 3645
MRILQGIAVSPGVAIGEAVVIDDKGYRIPRRFIARGAVESEMQRLEGAFAAVGKQIEQSRDEIAGELGQQYGAIFSAHLQMLQDAKLRTEIDHLVKQRHYSAEYAITRALGKYSKFFENLPTAYLRERANDVHDIERRLMGELIGNRREALEEIKSPVVVLANNLTPSETANLNREMVLGFVTEVGGPGGHTAIVAEALEIPAVVGVGDFLNEVSGGDLVIVDGDQGRVIFQPDDETIARYEQEVEEHRSLAARLDLLRDLPSELLSGEQIHLYANIEFPHEVDACLQRGAEGIGLYRTEFLYLGQEQEPTEEDHYQVYAKVVQDMGGAPVVIRTLDLGADKIARAPNESRVAEANPFLGLRSIRLSLRNISLFRTQLRAVLRASMIGEIHVMFPLVSTLHELRQAKMLLTDIMEDLDEEGIPYDRNLKIGMMVEVPSSVIMLDHFAKEVDFISIGTNDLVQYTLAVDRSNKEVAALYNNCDPAVLRLIEMTVRLAKEADIKTTLCGQMGGNPIYAMLLIGLGLRSLSITPSAIPEIKKVCRSVSLAQCEEVARRVREMENAREIKRYLREEVRRAVPELMM

SEQ ID NO: 66845 - protein, 330 aa, Oryza sativa Indica Group
MALRGGHAAAAAGVSSGSEDDDEEAGFSRSYFLAKEKEPSSGKKRARAAGKLSDLNLVDEQVLRASLAEIPPKHEREVEALTRSYKEQYRNWLFELRCGFGLLMYGFGSKKMLLEDFASTTLSDFTVIVVNGYLPSINLKQVIVTIAEIFWEQTKLKRKRQTATRSQLQPFASQSIDDIISFLNNQTSDNGDDNVCLLIHNIDGPALRDAESQQYLAQVSCCPQVHVVASVDHVNAPLLWDKKMVHTQFKWSWYHVPTFAPYKVEGMHFSSLYTKCRERFLVSSQVTLNSHLTEFKDHDLVKIRKHSDGQDCLHIPLVSDALEKLLQELT

SEQ ID NO: 66846 - protein, 200 aa, Prochlorococcus marinus str. MIT 9303
MTTNECLRVGQQAPDFSATAVVDQEFKEISLSQYRGKYVVLFFYPLDFTFVCPTEITAFSDRYTDFSSRNTEVLGVSVDSQFSHLAWIQTSRKEGGLGDINYPLIADLKKEISTAYNVLDDAAGVALRGLFIIDPDGVIMHSTINNLPVGRNVDETLRVLQAFQYVQSHPDEVCPANWTPGEKTMKPDPVGSKEFFASIN

SEQ ID NO: 66847 - protein, 455 aa, Bacillus cereus G9241
MNISSIVNKQKEYFHNGHTRSVEVRKNNLKKLYEGIQRFEQEIFQALKLDLNKSGHESFTTEVGYVLKEISFQLKHISSWSKPKRVRTALTHFGSKGKVVPEPYGVTLIIAPWNYPFQLAIAPLVGALAAGNTIVLKPSELTPNVSKVLTRMLEELFQEELVAVVEGGVEESTALLKEPFDYIFFTGSVSVGKVVMEAAAKQLTPLTLELGGKSPCIVHKDAKIDVTARRIVWGKFLNAGQTCVAPDYMYVHASVKEQLIEALRHEIAEQYGKEPLHNDNYVRIVSERHFERLCRFLQDGQVVIGGNYKKDTLHIEPTVVTNITWQDAVMEDEIFGPILPIVEYDNIEDVIDIIQQHPKPLALYVFSEDKEVQKKVTSNISYGGGCINDVVYHLATPYLPFGGVGSSGLGSYHGEESFRTFSHYKSILAQSTAFDMKIRYSSTKSALKFIRKLLK

SEQ ID NO: 66848 - protein, 423 aa, Chlamydophila pneumoniae CWL029
MDKQSSGNSGCIWHPFTQSALDSTPIKIVRGEGAYLYAESGTRYLDAISSWWCNLHGHGHPYITKKLCEQAQKLEHVIFANFTHEPALELVSKLAPLLPEGLERFFFSDNGSTSIEIAMKIAVQYYYNQNKAKSHFVGLSNAYHGDTFGAMSIAGTSPTTVPFHDLFLPSSTIAAPYYGKEELAIAQAKTVFSESNIAAFIYEPLLQGAGGMLMYNPEGLKEILKLAKHYGVLCIADEILTGFGRTGPLFASEFTDIPPDIICLSKGLTGGYLPLALTVTTKEIHDAFVSQDRMKALLHGHTFTGNPLGCSAALASLDLTLSPECLQQRQMIERCHQEFQEAHGSLWQRCEVLGTVLALDYPAEATGYFSQYRDHLNRFFLERGVLLRPLGNTLYVLPPYCIQEEDLRIIYSHLQDALCLQPQ

SEQ ID NO: 66849 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLIALPIDKIDPTHSYVKDIDDLAKHTLDKIKHFFETYKDLEPNKWVKVKGFEN

SEQ ID NO: 66850 - protein, 320 aa, Magnetospirillum magnetotacticum MS-1
AGGDRGGGRVALRPLFHLVARTRSPELFMAACLLVIVATAVVAAGSGLSMTLGAFVAGLLLAETEYRRAIEATIDPFKGLLLGVFFVSVGMNLDPAQLVAAPGAILGLSVGLLAIKGAVVLAGARIMGLPRPVAFETALLLGPGGEFAFVLIGGAMAAGLVPEPVGGAALIVTTVTMIAIPGLAAFARRIGGRVSREQLGRARAEPVPDPQQNRVIVAGYGRVGRLVGEMLKRHAIPYLALDSDPGRVGEHGRSAIPSIRRSGNPRMWPREFARPASCNSIPGGRAAGPASGHTGRRAERAKRRNGRKAHTGGTQGSQGK

SEQ ID NO: 66851 - protein, 241 aa, Arabidopsis thaliana
MATTSLVTGLKVVLPVMFCLMLATLVYTIITDGLPLPDRQDVFTPWFVTTILDFYINLVPIAVWIVYKESTWSGSILWTILLIIFGSLTTCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSLIIGILWVALLIGLGSVGTSAVIVVQLFRLSPLDPLYLVLVNNSNR

SEQ ID NO: 66852 - protein, 251 aa, Brassica oleracea var. botrytis
MPIRNIAVGRTDEATRPDALKAALAEFISTMIFVFAGSGSGMAFNKLTENGATTPSGLVAAALAHAFGLFVAVSVGANISGGHVNPAVTFGAFVGGNITLLRGILYWIAQLLGSVVACLLLKFATGGLVVPAFGLSAGVGVSNALVFEIVMTFGLVYTVYATAVDPKNGSLGTIAPIAIGFIVGANILAGGAFSGASMNPAVAFGPAVVSWSWNNHWVYWAGPLIGGGVAGLIYEVFFINTTHEQLPTTDY

SEQ ID NO: 66853 - protein, 543 aa, Zea mays
MAPPTEDCGWLLYLSLAAKCGDPQRLLGFAAVFVAACVVTSLLHWASPGGPAWGWYWWTRRAGLGIVRAAIPGPRGLPVVGSMGLMTGLAHRKLSAAAERQASRRRLMAFSLGETRVVVTADPDVARELLASAAFADRPVKESAYGLLFHRAIGFAPHGAYWRALRRVASAHLFSPRQIAASAAQRAAIARQMVDATTTAAAHAPVVVARRFLKRASLHNVMWSVFGRRYDLMADSREAEELKALVDEGYDLLGQLNWSDHLPWLARFDLQKTRARCCALVPRVNRFVGNIIGEHRARLGRGGDTAVMDFTDVLLSLQGDDKLSDADMIAVLWEMIFRGTDTVAVLIEWVLARLVLHQDVQSKVQEELDRVVGLGQAVTESDTASLPYLQAVIKEVLRLHPPGPLLSWARLATSDVYVSGYLVPAGTTAMVNMWAITHDPSLWPEPMEFRPERFMGPAAEDVPIMGSDLRLAPFGSGRRSCPGKSLAVATVGFWVATLLYEFKWLPPSDEPRGGGVDLSEVLRLSCEMAAPLEARVVPRHAVC

SEQ ID NO: 66854 - protein, 301 aa, Chlamydomonas reinhardtii
MNRYKVVKQLGDGTYGTVWKAINRQTNEVVAIKKMKRKFYSWEECMNLREVKSLRKLNHPCIIKLKEVIRENDELFFVFEYLECNVYQLTKDRDKFLPESRIRNWCYQIFQGLAYIHKHGFFHRDMKPENLLASKDSIKIADFGLAREIRSRPPYTDYVSTRWYRAPEVLLRSPYYNAPIDLFAMGAIMAELYMLRPLFPGTSEADEIYKICSIMGTPTQQVWPEGLKLAATMNFRFPQFAPTPLNKIITNACPEAIDLMTQLCHWDPNKRPTAVQALQHPYFAVGVRPALPVSNSPMSID

SEQ ID NO: 66855 - protein, 238 aa, Oryza sativa Japonica Group
MAAVSEVEVDGVVFPPVARPPGSGHAHFLAGAGLFVFALCVPCQWRSGNAVQANLLAGLIDPSCSVRGVEIAGNFIKFTAIGVYLEEGAAVPALAKKWAGKSADELAADAAFFRDVVTGDFEKFTRVTMILPLTGEQYSEKVTEDWVAAWKAAGVYTDAEGAAADKSRSPRTRRCQRGAVAAAAIENRALCEAVLDSIIGEHGVSPAAKRSIAARVSQLLKAESTGDVAAAEPAPVSA

SEQ ID NO: 66856 - protein, 130 aa, Triticum aestivum
MAAAATATTTAAATAAAVGPGEVISVHSLEQWTMQIEEANAAKKLVVIDFTASWCGPCRIMAPIFADLAKKFPAAVFLKVDVDELKPIAEQFSVEAMPTFLFMKEGDVKDRVVGAIKEELTTKVGLHAAA

SEQ ID NO: 66857 - protein, 635 aa, Candida glabrata CBS 138
MMVPLLLSTYFITAVYGATHTFHWTTGWGNRNVDGIKERPVITCNGEYPWPDVRVAKGDRIEVYLTNGFNNTNTSLHFHGMFQRGTNQMDGVPYLTQCPIGPGDTMLYNFTVDENVGTYWYHSHTDGQYEDGMRGLFVIEDGENNKNFPYEYDEDVMLSIGEWYDTTVDVLTRKFLNLNNPTGAEPIPQNLILNNTMNLTWEVQPDTTYLLRIVNVGGFVSQYFWIEDHEMEVVEVDGVYVEKNTTNMLYITVAQRYAVLVHTKNDTSKNFAIMQKFDDTMLDVIPKDLQLNATSYLVYDKSKPMPEQNYVDSIDDYLDDFYLVPMDKEELYPEADHVITIDVIMDNLINGVNYAFFNNITYTTPKVPTLLTVLSAGQDALNPFIYGTNTNTFVLKKGEVVDLIVNNQDTGKHPFHLHGHVFQTILRDREFDDAKGEKPHSFNDSDHAAYPSIPMKRDTVYLNPQSNMVLRFKADNPGVWFFHCHIEWHLLQGLAVVMVEDPISIQNTASQHLTANGLQVCGNVKVPTQGNAAANDSDFFNLEGQNVQHKSIPTGFTKKGIIAMTFSCLAGVLGITMIAIYGFSEIPEPEIKVMRNLHLNPEDVLEKTSSSSVISASNSSSLEDSRNQKKKFIFF

SEQ ID NO: 66858 - protein, 126 aa, Zea mays
  misc_feature (18)..(18): Xaa can be any naturally occurring amino acid
  misc_feature (61)..(61): Xaa can be any naturally occurring amino acid
  misc_feature (74)..(74): Xaa can be any naturally occurring amino acid
  misc_feature (99)..(99): Xaa can be any naturally occurring amino acid
LIILTPIPCALLMEVREXPLHNVFAIFHDLDNCMHPIIVLYPYLPIPAHNLRNMSQPLLVXIFSTIFKSPNASXQSYEDMLHCYIDSNYNNRRPTTEVXVTQLLIAILFVIQLTISITLTLTEPYI

SEQ ID NO: 66859 - protein, 353 aa, Synechococcus elongatus PCC 6301
MSKIRVGINGFGRIGRLCLRAGFDDPQLDFVAINDLVPAKNLAYLLHYDSTHGRLQQTVRAEEDRICAGDRCIQCFSETDPAAIPWGELGVDVVIEATGRFTDYAAASRHLEAGAQRVVISAPTSEKDPDRVPTFVYGVNHQNYDPQQHRILSNASCTTNCLAPIAKVLQEHCGIEDGLMTTIHAVTATQPTVDGPSRKDMRGGRSAAQNIIPASTGAAKAVGLVLPELQGHLTGMALRVPTADVSVVDLTFRSRQSTTYAAICEVMQKAANTQLQGILGYTEDDLVSSDFIGDARSSIFDATAGMALNDRFFKVIAWYDNEWGYSNRMLDLIRYMRSVEQQPAWAPRSLTPA

SEQ ID NO: 66860 - protein, 490 aa, Pseudomonas syringae pv. syringae B728a
MARFELQKLYIDGGYVDASNPETFDAINPANGEVLAQIQRAGKDDVERAVVAAEKGQKIWAAMTAVERSRILRRAVDILRERNDELAALETLDTGKAISETRYVDIVTGADVLEYYAGLVPAIEGEQIPLRDSSFVYTRREPLGVVAGIGAWNYPIQIALWKSAPALAAGNAMIFKPSEVTSLTTLKLAEIYTEAGVPNGVFNVLTGSGREVGTWITEHPRIEKVSFTGGTDTGKKVMASASSSSLKEVTMELGGKSPLIVFDDADLDRAADIAMMANFYSSGQVCTNGTRVFVPNALKAEFEAKILERVKRIRAGNPEDENINFGPLVSFEHMESVLGYIAKGKEQGARLLCGGDRLTGGVFDKGAFVAPTVFTDCTDEMTIVREEIFGPVMSILGYDTEDEVVRRANDTDFGLAAGIVTRDLNRAHRVIHLLEAGICWINAWGESAAQMPVGGYKQSGVGRENGISSLAQYTRIKSVQIELGDYASVF

SEQ ID NO: 66861 - protein, 463 aa, Moorella thermoacetica ATCC 39073
MTGEKIISLETALQAGRQETRDLYRRYINPGLATMLALLDFDKAFVRAEGMAVWDKDGKRYLDFLGGYGALNLGHNPPEVLAAVKEAMGRPNLLQASLNPLAAALAHNLAQVTPGDLERVFFSNSGTETVEGALKLARASTGREKIIYCQNSFHGKSFGSLSVTGRQKYQRPFGPLLPGCEAVPYDDLEALEAKLSRRDAAAFIVEPIQGEGGVIVPHDGYLKGARELCDRYGSLLIIDEIQTGFGRTGYLFACEHEGVVPDIMCLAKSLGGGVMPIGAYIARPAVWDRAYGGMDKALLHTSTFGGNSLATAAGLAALQSILDQDLAGRAAAMGRYFLERLRQLKEKYDLIKDVRGRGLIIGLEFNQPVGGLLDKLTRGKVNELAGEYFGSLVAGELMNKYQVITAYTLNNPNVIRLEPPLIVGEEEIDHVVNALEAVLRGHGFLGVTLSSTRTALGSLFKRK

SEQ ID NO: 66862 - protein, 159 aa, Bacillus pumilus SAFR-032
MNISIITVGKLKEKYLKQGIAEYTKRLQAYAKIDIIELADEKAPEHLSEQDMKIIKDKEGERILSKINPDAHVIALAIEGKMKTSEELADTIDKLATYGKSKVCFVIGGSLGLSDAVMQRANEKLSFSRMTFPHQLMRLVLVEQVYRAFRIVRGEPYHK

SEQ ID NO: 66863 - protein, 547 aa, Lactobacillus plantarum WCFS1
MTKTASEILNNPFLNKGTAFTKEERQALGLTGTLPSKVQTIDEQATQAYAQFKSKPSRLEQRIFLMNLFNENRTLFFHLMDEHVVEFMPIVYDPVVADSIEQYNELFLDPQNAAFVSVDAPEDIEATLKNAADGRDIRLVVVTDAEGILGMGDWGVNGVDIAIGKLMVYTAAAGIDPSQVLPVSIDAGTNNQKLLDDPLYLGNRHKCVSGEQYYDVIDKFVAAEQQLFPDSLLHFEDFGRDNAQVILDKYKDQIATFNDDIQGTGMVVLAGILGALNISKESIKDQKILSFGAGTAGMGIANQILDELMQAGLTEEEAKQHFYAVDKQGLLFDDTEGLTPAQKAFTRKRSEFSNADELTNLEAVVKAVHPTVMIGTSTQPGTFTESIIKEMAAHTERPIIFPLSNPTKLAEAKAEDLIKWTDGRALVATGIPADDVEYKGVTYQIGQGNNALMYPGLGFGLIASTAKVLNAETLSAACHALGGIVDTSKPGAAVLPPVAKITEFSQKLAEVVAQSVIDQKLNKEPIADAKQAVADMKWVPEYRAISK

SEQ ID NO: 66864 - protein, 526 aa, Bacillus anthracis str. A2012
MFEGVNIKFTPGNCYGLIGANGAGKSTFLKILSGEIEPSTGDIHITPGERLAVLKQNHFEYEEFPVLETVIMGHTQLYKVMQEKNAIYMKEDFSDEDGMRAAELEGEFAELNGWEAESEAAILLKGLGIGEDLHDKKLSELTGAEKVKVLLAQALFGKPDILLLDEPTNHLDLKAIQWLENFLMNFENTVIVVSHDRHFLNKVCTHMADLDFGKIQLYVGNYDFWHESSQLALKLTQDANKKKEEKVKELQNFIARFSSNASKAKQATSRKKLLDKITLDDIRPSSRRYPFVGFTPEREVGNDLLTVEGLSKTIDGEKVLDNVYFTLNKGDKVAFIGRNDIAMTTLFKILMGEMEPDSGSFKWGVTTSQSYFPRDNSKYFENSDLNLVEWLRQFSPQDESESFLRGFLGRMLFSGEEVKKNVSVLSGGEKVRCMLSKMMLSGANVITLDDPTNHLDLESITALNNGLIAFKGTMLFTSHDHQFVQTIANRIIEVTPNGVIDKEATYDEFLENEELQKQVDAMYKGQ

SEQ ID NO: 66865 - protein, 475 aa, Lactobacillus plantarum WCFS1
MKASQRLLVKKSVNPANFNKGGLEKTLSAFSLTMMGVGAIVGSGIFITPGIIAAKYAGPAAMLSFVIAAVVCSLAALCYAEFSSTIPLAGSAYTYVYTVFGEFLAWILGWSLISEYLFAVSSVAVSWSSYFQNLMSGFGLKLPTFLTAAAGTAGVSGAGFNLIAFVVVLAVSLLLVGGLQESTRVNSIMVIVKILVIVLFIGVAIFFVKPANYHPFMPHGVSGLVKGASLAFYAYIGFDAVSTASEEVKNPKRNMPIGIVGSLVVASILYVAMAAVLVGVVHYSKLNVGDPVAYALAVIHQNWAAGIVSLGAVVGMTTVLIVMLYGGTRLLFAISRDGLLPKVFRTVSPHTKVPVKSTWIFGIIASVFAAVIPLDKIAELVNIGTLFAFAMVSIGVVFLRRHETLQQINSSFKVPFYPVLPVVSFLACVYLMLNLQAFTWHMFGIWLVIGIVIYFAYSYRHSRIRAGLRAKESKS

SEQ ID NO: 66866 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPIDKVDPTHSYVKDINDLSKHTLDKIKHFFETYKDLEPNKWVKVKGFEN

SEQ ID NO: 66867 - protein, 198 aa, Blastopirellula marina DSM 3645
MAYAEYQRQRQMTLGDMLLENRIVFLQGEIYDGNANELVMKLLYLQSENRRKPINFYINSPGGSVTATMAIYDTMKVISCPVSTYCVGLAASGGAVLLAGGEAGKRFILPHAKVMIHQPHGGVGGQVSDIEIQADEILKTRDVLNQVLADHCNQPVEKIAKDTDRDFYLDANAAKAYGIVDEILTKPLGEPGDEDDDK

SEQ ID NO: 66868 - protein, 196 aa, Blastopirellula marina DSM 3645
MPLIPYVVEKSGREERVYDIYSRLLKDRIIFLGTQVNDEMANCIVAQMLFLQSEDPAADIHLYVNSPGGSVSAGMAIYDTMQFITCDVATYCIGQAASMGAVLLTAGAAGKRHALPNARVMIHQPLAGMQGTAEEILIHATEFKRIKHRLNEILIKHTGHTIDRIEKDTDRDRFMSAEESCEYGLIDHVIEKMPGK

SEQ ID NO: 66869 - protein, 512 aa, Zea mays
DTIEQVCTKKQAGTGPEFPGSRRVQCATDAAALSPAVTTKHRRAADENIREEAARHPAPKQGLSAWYEPFPPAPNGDPNERYSLDEIVYRSSSGGLLDVRHDMEALSRFSGAYWRDLFDSRIGRTTWPYGSGVWTKKEFVLPEIEPDHIVSLFEGNSNLFWAERLGRDHLGARGDLWVKHCGISHTGSFKDLGMTVLVSQVNRLRRAPLSRPIAGVGCASTGDTSAALCAYCAAAGIPAIVFLPANRISLEQLIQPIANGATVLSLDTDFDGCMRLIREVTAELPIYLANSLNSLRLEGQKTAAIEILQQFDWEVPDWVIVPGGNLGNIYAFYKGFEMCRVLGLVDRVPRLVCAQAANANPLYGYYKSGWTEFQPQVARPTFASAIQIGDPVSVDRAVVALKATDGIVEEATEEELMNAMSLADRTGMFACPHTGVALAALFKLRDQRVIGTNDRTVVVSTAHGLKFSQSKIDYHDSKIEDMACKYSNPPVSVKADFGAVMDVLKKRLKGKL

SEQ ID NO: 66870 - protein, 179 aa, Gibberella zeae PH-1
MGNTTSAVLDNLVQGSNYVRFLVDREEVDRLRKRFMKLDKDNSGTIERDEFLSLPQISSNPLATRMIAIFDEDGGGDVDFQEFVTGLSAFSSKGNKEQKLQFAFKVYDIDRDGYISNGELFIVLKMMVGSNLKDQQLQQIVDKTIMEADLDKDGKISFEEFTKMVENTDISMSMTVDQF

SEQ ID NO: 66871 - protein, 440 aa, Chlamydophila pneumoniae CWL029
MSKIVYKFGGTSLATAENICLVCDIICKDKPSFVVVSAIAGVTDLLVDFCSSSLREREEVLRKIEGKHEEIVKNLAIPFPVSTWTSRLLPYLQHLEISDLDFARILSLGEDISASLVRAVCSTRGWDLGFLEARSVILTDDSYRRASPNLDLMKAHWHQLELNQPSYIIQGFIGSNGLGETVLLGRGGSDYSATLIAELARATEVRIYTDVNGIYTMDPKVISDAQRIPELSFEEMQNLASFGAKVLYPPMLFPCMRAGIPIFVTSTFDPEKGGTWVYAVDKSVSYEPRIKALSLSQYQSFCSVDYTVLGCGGLEEILGILESHGIDPELMIAQNNVVGFVMDDDIISQEAQEHLVDVLSLSSVTRLHHSVALITMIGDNLSSPKVVSTITEKLRGFQGPVFCFCQSSMALSFVVASELAEGIIEELHNDYVKQKAIVAT

SEQ ID NO: 66872 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLIALPIDKIDPTHSYVKNIDDLSKHTLDKIKHFFETYKDLEPNKWVKVKGFEN

SEQ ID NO: 66873 - protein, 468 aa, Xanthomonas axonopodis pv. citri str. 306
MSQGKIVQIIGAVVDVEFPRNEVPKVYHALKVDGTEITLEVQQQLGDGVVRTIALGSTDGLKRNLVATNTERAISVPVGAGTLGRIMDVLGRPIDEAGDVQASDHWEIHRGAPSYEDQSSSTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDEKDASGKGKDVLLFVDNIYRYTLAGTEVSALLGRMPSAVGYQPTLAEEMGVLQERITSTKSGSITSIQAVYVPADDLTDPSPATTFAHLDSTVTLSRNIASLGIYPAVDPLDSTSRQMDPLVIGHEHYDTAQRVQQTLQKYKELKDIIAILGMDELSEEDKQSVSRARKIERFFSQPFHVAEVFTGSPGKYVSLKDTIRGFKAICDGEYDHLPEQAFYMVGSIEEAVEKANKMSAKA

SEQ ID NO: 66874 - protein, 599 aa, Oryza sativa Japonica Group
MEQYEVLEQIGKGAFGSALLVRHKVEKKKYVLKKIRLARQTDRTRRSAHQEMQLIATVRNPFIVEYKDSWVEKGCYVCIIIGYCEGGDMAEAIKRATGDHFSEEKLCKWLVQLLMALDYLHANHILHRDVKCSNIFLTRDQSIRLGDFGLAKILTSDDLASSVVGTPSYMCPELLADIPYGTKSDIWSLGCCIYEMTALRPAFKAFDMQALISKITKSIVSPLPTRYSGAFRGLIKSMLRKSPEHRPSAAELLKHPHLQPYVLQVHLKSSPARNIIPSHQSPIDKVKKMTFPTESMCRSKGRRNSLGNERIVTFSKPSPERKFTSSIQSIKDYSTTRSVKDLSIDVSLVEEVSSKTTFTTRTSSIVKTPKRTPSKTITTPQLEPPKVSYNRVNRSELLSRTPVNRSARVIRRASLPLPLPSSETPKRGVSSISILEQLESPDVSVNSPRIDRIAEFPLASSEDPPFLKLHGRRSPTPTPQHCVIDQSITKDKCMVEAFHIIDVDDDDGRSDSSSGRNNAAAAASSRAGSSESTRQRRFDTSSYQQRAEALEGLLEFSAQLLQQERYDELGVLLKPFGPEKVSPRETAIWLTKSFKETGL

SEQ ID NO: 66875 - protein, 391 aa, Oryza sativa Indica Group
MEKDILLGSHSYAALCVVTLLIGWLTHWVYKWMNPPCNGRLPPGSMGFPVVAKTLNTIVDVNNAIYLRYGPLFKTSLVGQPLVVSLDPEVNRFIFQQEGKLFRSWYPETANNIFGKKSLTTYNGTVHKFIRSFASKLFGLENLKESLLPELENSMRESFASWASKPRIEVQDGVSDMIFDLVAKKLIGLNVTQSRELRKNFQEFFQGMVSFPIYFPGTSFYRCMQGRKNVRNTLTDVMKERLSAPEKKYGDLVDLIVEELQSEKPVIDENFAIDALAALLFTSFATLSSTLTVALKFLNDNPKIVEELKEEHDVILKKREVMNSGFTWEEYKSLKFTTQVTNEITRISNVAPGVFRKTLTDVQVNGGEEKLTAEELHAIWRRHQVVSRRRV

SEQ ID NO: 66876 - protein, 196 aa, Cryptococcus neoformans var. neoformans B-3501A
MPEGKKDDGQGKKDDNPIKKDDKPLPNVYLKISINGKEVGKVVIKLYDDVVPKTCANFRSLCTGNKPDQTPLPPSFTYRSTPFHRIIPSFMIQSGDFERQDGTGGVSIYGEKFPDENFEKKHDKVGLVSMANCGAHSNGSQFFITTVEKCEWLDGKHVVFGEVVEGMDVVKEVESKGNKEGKPPKDKIIISACGAV

SEQ ID NO: 66877 - protein, 175 aa, Gluconobacter oxydans
MDIMDVSKISPGKDLPNDINVVIEIPQGSQVKYEVDKDSGALVVDRFLFTPMPIRPPMASFRARWPRWRSGRRPCPDAGCRCAGLRDPRPSDRHAEDGRRERTGREDHLRPARKVHPQFSNVHSVDDLPEITKKAITHFFERYKDLEPNKWVKVTGWADKAEAGKVIMEALAAAK

SEQ ID NO: 66878 - protein, 575 aa, Raphanus sativus
MNSMWLVRTAIALLLIVFLQNAAAQKRPQQSIVKSRGAVATDDGRCSVIGMSVLRQGGNAIDASVAAALCLGVVSPASSGIGGGAFTVVKIAGGKAIAYDSRETAPLRATEDMYGSNPDLKKKGALSAGVPGEVAGLFTAWKQHGKLPWKQLVTPAEKLAEGFRVSKYLYMQMNATRSDILADKGLSELFVSNGELKKPGTIIHNRKLAFTLKQIGEYGPKAFYNGTVGVNLARDIIKAGGIITLKDLQSYRVKVSKPLSANILGYELLGMPPPSSGGAAMMLVLNILSQYGIPSGVSGSLGVHRLIEALKHAFAVRMNLGDPDFVNVTKVVSDMLSPEFAKDLKKKINDDKTFDPKYYGGIWNQINDHGTSHLSIIDRERNAVSMTSTINGYFGAVMLSPSTGIVLNNEMDDFSIPTKSTGNLNVPPPAPANFIRPGKRPLSSMSPTIVLKDGKVKAAVGASGGANIISGTIEVFLNHFFLNMDPLSSVLAPRIYHQLIPNRVSFENWTTVFSDHFEVPKETRVVLEKKGHVLTPIAGGTIAQFIVQESDRNAGGMSKLVAVSDPRKGGFPSGY

SEQ ID NO: 66879 - protein, 408 aa, Ralstonia solanacearum GMI1000
MTTAATHPSYALETRYGARNYAPLPVMLERGEGVWLFDTAGRRYLDMMSAYSAVSFGHSHPRLVAALVEQAGRLTLTSRAFHNTELGPFLADVCRITRMDRALPMNTGAEAVETAIKAARKWAREVKGTPPDAAEIIVFDNNFHGRTTTIVGFSSHEQYRYGFGPFAAGFRRIPFGDAEALKAAIGPHTGAILIEPIQGEGGIVVPPPGYLKLARDLATQHNALLVCDEVQTGLGRTGDVLASWHEDVQPDLVVLGKALGGGMVPVSAIAGREDVIGVFQPGDHGSTFGGNPLAAHIGRAALALLQEAQLPRHAARLGEAFIAELQSLIGHGVRQVRGRGLMIGLQLDADIDAHDFAAALAGHGVLTKDTYGNVVRLTPPLVIAQQELELARDVIRRTLADWPRRKAA

SEQ ID NO: 66880 - protein, 437 aa, Thermoanaerobacter tengcongensis MB4
MSSGVLEKYSKILREKRLVGYYGKVSQVIGLTIESVGPLSNIGEICYIKTIDGNEVLAEVVGFKEEKVYLMPLGNMEGIGPGSKVIATGQTLKVNVGKSLLGRVLDGLGNPIDGKGPLKYEKSIPVNNTPPDPLERKRIREVMPLGIKAIDGLLTCGKGQRIGIFAGSGVGKSTLLGMMARNAKADLNVIALIGERGREVNEFIEKDLGEEGLKRSVVVVATSDTPALVRVKGAMTATAIAEYFRDQGLDVLLMMDSITRFAMAQREIGLSIGEAPVSRGYTPSVFSVLPKLLERSGSSQKGSITALYTVLVDGDDLNEPIADAVRGILDGHIVLSRKLANKNHYPAIDVLASVSRVINDIITDEHKELVAKFKNILATYAEAEDLINIGAYNFGTNPKIDEAIELNEKMNSFLRQKIDEAYDFETTKKLLAKSLER

SEQ ID NO: 66881 - protein, 255 aa, Oryza sativa
MSVSSNPLYLTPAKCHELADIANRMVAKGKGLLAADESTGTIGKRFASINLENVEENRRLYRQLLFTTSPDLKVSDYISGVILYEETLFQKTDSGEPFVNVLKKAGIIPGIKVDKGTVTLAGTNDETTTQGLDGLDERCKKYKSAGADFAKWRCTLKIGANEPTQLAIIENANVLARYASICQQNGLVPIVEPEILPYGDHDLEKCQIVSEKVFAAVYKALSDHHVFLEGTLLKPNMVTAVSRAQKVHASAERVG

SEQ ID NO: 66882 - protein, 487 aa, Silene latifolia
MSTQAHRNRLLGTENGNGGGGVKVVNNPKLTKKRPPLSNLTNHPRPSLVPSAITKSTKAKRDSSTGVRSTSFPAENPSATLNSKPSAVVPLKTAFTRSNVLVSCKASLPNGKGEQSHITRHPASCTMDTTPTPEDAQSVSMDESMSTCDSLKSPEVEYMDENDVAALCSIERKTSKNLYISDDMETTGSFCKREIVSAMEIDKVVDVDDNHMDPQFCSTIACDIYKHLRESETQKRPSTDFMEQTQKDINASMRAILVDWLVEVAEEYRLVPDTLYLTVNYIDRYLSGNAMNRQRLQLLGVACMMIAAKYEEICAPQVEEFCYITDNTYFKEEVLQMESGVLNFLKFEMTAPTTKNFLRRFVRAAQVMNEVPAFQLECLANYVAELSLLEYSMLKYAPSLIAASSVFLAKYMLTSSRPWNATLRHYTLYEASDLEECVKALHQLCLNSHISSLPAIREKYSHHKYKSVAKKHCPSSIPAEYFQNSSC

SEQ ID NO: 66883 - protein, 413 aa, Lotus japonicus
MGSLGAIVKHPDDLYPLLKLKMAARHAEKQIPSEPHWGFCYSMLHKVSRSFALVIQQLDTDLRNAVCIFYLVLRALDTVEDDTSIATEVKVPILKAFHRHIYDRDWHFSCGTKEYKVLMGQFHLVSTAFLELAKNYQEAIEDITDRMGAGMAKFICKEVETIDDYDEYCHYVAGLVGLGLSKLFHASGKENLAADSLSNSMGLFLQKTNIIRDYLEDINEIPKSRMFWPRQIWSKYVNKLEDLKYEENSVKAVQCLNDMVTNALMHAEDCLKYMSDLRDDSIFRFCAIPQIMAIGTLAICYNNVEVFRGVVKMRRGLTAKVIDRTKTIADVYGAFFDFASMLESKVDKNDPNATKTLSRLVAIQKTCRESGLLNKRKSYILRKENGYGSTLIIILVLLFSIMFAYSSATRHSN

SEQ ID NO: 66884 - protein, 524 aa, Zea mays
HLLVIKKVNRDRYNDGSIKHSLLKQSSLDLLTIETPGLKKNDSFSRWMSKELEEVVDLGIKSTSDAFWSSIETVKVPDGSNVLTNEQLDAYVVNPSLSQDQLFSILDVSPSCAYIGTNTKVCAQFSQGNLCKRFVTGAGIAEADSCASGAGISLGRIPNFIFSKMCTSKQHSALAFFHCLLPCEVSVLCCKIPTILPQYGMTSIIEGIDAIATTWVVVTRDMSNNRRCSGRGGGGRGGGPGNVALAGVRFWILMAPVFMPWLRIKNHALLLQTQYTSFGFYWALLFIPAYKFFAFYMEGPWAAMTTTGIFLAVAVTDWLDGYIARKMQLGTPFGAFLDNSNKYRHCRSITNIARASSTIPLSVSMSSSGSIGTNPALTAFPLLPCTFNHQLHGVFEVASFGGSNIDPTAWEDKKCKGESRFPAQVRIRVRKLCKPLCPVLHHYDGPKFRLELSIAEDRRGLIGRRRRRAEAVIGGQGAQKEKDDDFLAMKGTKLPQRPKKRAKNVDKTLQVLNTWPEIDLILYF

SEQ ID NO: 66885 - protein, 423 aa, Triticum aestivum
MHRRICPSVFARKHETTRPSRAIMSMLACALQTMGSSCSRPHSVNEAEAADNTRSADIDRRILQETKADQHVHKLLLLGAGESGKSTIFKQIKLLFRTGFDEAELKGYTPVIHANVFQTIKVCQYWERILYDGAKELAQLETESLKHVISPDNQEIGEKLSEIGGRLDYPLLNKELVQDVRKLWEDPAIQETYSCGSVLQVPDCAHYFMENLDRLAEPDYIPTKEDVLHARVRTNGVVEIQFSPLGESKRGGEVYRLYDVGGQRNERRKWIHLFEGVDAVIFCAAISEYDQLLFEDETQNRMMETKELFDLVLKQRCFEKTSFMLFLNKFDIFERKIQKVPLTVCEWFKDYEPIAPGKVQDVEHAYEFVKKKFEEVYFQSSKPERVDRVFKIYRTTALDQKLVKKTFKLIDESMRRSREGTGT

SEQ ID NO: 66886 - protein, 440 aa, Yarrowia lipolytica CLIB122
MPLNIIQTLATEGKDAVPYFDQIAVAVPVLGVVSLLKTYFGGSTNTWQRDMHGRVVIMTGGTSGVGAEIARELAQKGAQLILLVREHTTYAAEFVDDLRAASGNELVYMETCDLNDLHSVRKFATKWLDNQPPRRLDTVICCAATATPPSVERKYSRDGIEEMLQVNYLAHYHLLTLLEPALKVQPPDRDVRIVLTSCVAHVMADLDFSDLQFTRRKYPTYSPWRAFGASKLLLNMFGYEYQRRLAAYERPDKAPCNVRVVMADPGMMRSPSFKRFITCGSVLLLLLYLVFWPFWWLVLKTSKQGMQSILYGVFCGELPAPIEEAVYIQECDVRSHMARAEMNDKELQKEVFDKTKLMVEVIEKKSAIDRKKLEEKLKKEGKASNGSKTEYTPNSTASDEKITPIEEEDEESTTGSTTTTATGSATSRNDKKKRNRKRKT

SEQ ID NO: 66887 - protein, 862 aa, Ustilago maydis 521
MSLQGRRDLKAAYLTQRDNPCPPNHKSRIRSNSVWSRAQRQSITNADFEPTWRDDRLVTQSTLASPTHVVSISLVLLTLTYKNCAWRSSFLASSCNQRAATVESSGMQLRNDLSTWAAILGALVLTAGSQTSASPIHGIVDRESRNNGKQPSFYGAASQGNSAEYSVEGKHGAVSSEVDVCSNIGAQLLQQGGSAVDSIIGTALCVGSIASYHSGLGGGGHAVLRSPITNDDRTNRKRSNPNDARSKTSTYVHIDFREVFPAAATEDMYTNNPVKNASLYGGLAVGVPGEPKAWWDLHQKYGKLEWSKVFEPAITLNRRGFKVTAELAKALNTTQYPFLCKDKRWSRFYCVNGKVAQLGDTIKKERFAKTLELIASKGVDPYYYGEIADDIVDTIANNKVLKGILTKHDLANYKVEYRNPRNVTLRDGKYRLFGTVAPSSGSVVLSTLQTVDQFRVDGEEDLSNVNVSTHRLIEANKFSYGQRTNYGDPGFVKNVSRLEGEYLELPFSKENKNQISDTRTFSASHYIPDHKNAEVKSDHGTSAITVVDADGMAISLTTTINTFWGSQLMTEHGFPLNNELDDASSPGQTNFFGYLATPANYIEPGKRPLSSISAVIAEEVRTGELKLSLSSAGGSRIITAVTQVAYNVLFKGQDAQAALAEPRWHDQLSPNQTTLESAAAAIRGFVGFNNQTAAFLASVGHNVSWTPIGSSTAQAVERFPDGVLLAATETRSSLMLILVKVVFQFWQFSSKCTITSWEPTTTFTALVRGLAECRQRADLYGTLTSRPFERRAYLASDARRVRVLRDARLSLRMIEWRLDNISLPMLQHSDDDDLRVQRWPIKQDKTQASNSGFFHSWLVKLS

SEQ ID NO: 66888 - protein, 114 aa, Oryza sativa Japonica Group
MTPCVTPAARQVIWHVIAQVQDLPGHIARECTNEPVCNLCNVSGHLARNCQKTTISSEIQGGPFRDITCRLCGKPGHISRNCMTTMICGTCGGRGHMSYECPSARMFDRGLRRF

SEQ ID NO: 66889 - protein, 534 aa, Arabidopsis thaliana
MDTCMQELIAGDQNMADQDFPSVINIVLLVKLLDHVAATQNQNSGHPYTHQEGNNMPGEKEKKIEPKNLTEAELITMEEKSRMEHEHTMNIMEHKVEHALKQNEETYDKEMQHCVIDVSNSTDKNMADQELPPSVTSIVLVGRNNGNGKSFTGNTLLGEKLFISKADAGGVTMEEDDKLKEKEREIESKSLAEAEVIAMKERSRKEHDHTMNMAHEEVEHALKQNTETHEKETQHHVIDVSDSTADEVSVFVVNPLIMPPGAKKRKALKKKQQEQEATGVATNNKGFNGHEFVVAGSIWILVILVAVYRILCLKWVSGVSLLNISGHDEHGSQDERDSDGNLSSPGSQGNEEFGTRDPSPPPLSSLGKDIVKEKAEDADFTGGQVAKGEDVIEVGRGRTDHEENGVNKQLNSCPENFTQTSREADSTSSLEISPALDSVKPMGSSVSKVVMSDKSKQVESSTDSDSLQQKSDEKEEILSPRSAEETNKEIKNVKEYEVPECSKEKSLLPSGPPVFRTSWLSCCGLFDVMAGSER

SEQ ID NO: 66890 - protein, 524 aa, Oryza sativa Indica Group
MANRRKFSQAGGGGGGGVFDPFGTKQAVSSLRKGGRLPVYVAGVFFVIFVIIMYGEDIRSLTLDPIARAGTTPARIVEPVVTEERHVARVNPPRREVSSAEKAAALPLDVDERPKLATPTPTEAAKEVPKVEKIRKPKKPKTTKKKPRKPRPAKKTVAAAAGGLLGVPETCDLSKGEWVFDNTSYPLYREEQCEFLTSQVTCMRNGRRDDTYQKWRWQPKDCSMPRFDAKLFMERLRGKRFMFVGDSLNRNQWESMVCLVQSAMSPGKKYVTWEDQRVVFHAVEYNATVEFYWAPFLVESNSDDPKIHSIQHRIIKADAIAAHAQNWRGVDYLVFNTYIWWMNTLNMKIMRPGGQSWEEHDEVVRIEAYRKVLTTWASWVNDNIDPARTSVFFMSISPLHISPEVWGNPGGIRCAKETMPLLNWHGPIWLGTDWDMFHAAANVSRTAAPRVPITFVDVTTMSERRKDGHTSVHTIRQGKVLTPEQQADPGTYADCIHWCLPGVPDIWNLILYTRIMSRPQLGLG

SEQ ID NO: 66891 - protein, 638 aa, Yarrowia lipolytica CLIB122
MNLKELDEKAKYVFDTKDRVADKFFESMSPKPRKLMKFLFSPDYDYSSATENFDPNDTVDDLQLTHSEIVRKVWNKKQLIMGWGFLLFMSLVSTIMSSSFPSYIVYASSEFSQMGALASVQIVQSCIFLIARALCGKLADNFGRFEAMFISVCSLTVGCGLYMGTHNIVTYFAALAFYSIGDIGIQMMYEIFAADTCDLRDRTFFQTITLFANLFTPWIAGPMVQSMLQHSTWQWGMGMWAIIVPVCSIPFLVTLLYFRIKAYKMGLRIRRGDPNRTWWQNTITGIIRMDLPGLCFLCAGLILFFVPISFCAGTDNWKQPGNIAMLTVGTFLLYVAFPLWEFFVTKHPFLKYKLMSKRLVTIPGFIILFYNMSFAIYHPYFQVWLLLAKGLKQAKATNLHMAMFVSLTGTTLLFSPLMRWRAKLKSVMVWGTILYFIGMGLTYEFRKPEKPLHTMILAQVFEGVGAGLLVIPVMVYIQVVCKQSDAAAAITVYYFFNSTGTILGNVISAAVYRNHFPKLLRETGSFTDREIQAIFGSIYAGLRYPVGSPQRAAIGTSLNTVIRSLLIGPLILCAIMFCLSLTNADINLDTAQRIKEESEHVKADESTDDNGLVVETDSIEKPPSYDEKKQVEEMVQKA

SEQ ID NO: 66892 - protein, 3175 aa, Ustilago maydis 521
MLKSLRRSFGMSPSSSGIHSDHIGNSDVPTGLLSPSNKPNTFVPLRRSNSFTNLFSFSRSSSPVKESLEHSPTDTLTSPAKEASSAESEQTHAGLDSDPVLASLVLLGKKGKRDERFPIQALKTTIGRSLDNDLRIYSFGVSRLHCTINIEVQQQHQRDEGNKAFLQVFSSNGVILNDNHALPAPSGSGRYELHTGDIINISDQAFVFELPQSSSADVKAAEASIVSSPVKGGVSSSAGAPQTPAPAKRRRIRMSLVDAAEINTPSRPSTKSASPSKASNPERDARRADSIKRFMQSANVSPAKCNKIKSRQSLNAPAPFTDLFGTPVMRHKALVDPKTAPPKQASFNLYANSFTGRLSPVKQMRMMPPLDTMNEEQEGSFRSENQQLHEEQQLETHDVQKDDEDSVDCFVIIEEFEQEQEQPEIISSADDLVAVSHAVTATNDVEDDENNSIQTSSNASTPCGSPNKSDSPKRAKRRSSFFGRAGPFSGMSLGFYAEERTDDKKAHIPTSEPQQASQVAEETELHLSDAPELEPQPMEEEELVDEAAESPTVHRFVPRSMTLGISKTPSPVKQQHFVGLTPLPRRPRLSLASRRKVSLRTQTLLRSSEAYADRLFLPPPPPTPVSNSPSGLSKSMSMPNNISAMASSQPLSVLEPSSTLSSDFSLHSDDGQNEQPEAGNFDAQLDPALSEHEAHVQVWKACSEGEDEDEDEVDQSLSVLSPLAPKTSAHDLSPVKAMTLPRFATPQPASKTHSRRISMPLAGATDAKLSIRSALVRLQISGAGERIVHQIARKEVEAAATSVVEAMRSSPTKDRKVVRVSDVGLPATELSMGFDLVEDAAAEPESDKIAQALDDLFKAEEDELTDDEEADEELEQQEDIVQISCKLQQSPSRPSDAVAVAPLQAPQTPAALNSVRHLFSAASAAPATPDMRGLGALLNPSPEKASKYGNLADKMRANPDIAELLSPSRSSPKKKAILGSVPSPVKGRRGVRRSQAAEIAAPAPVTPQARDYQLDPASPTVTSSLPSSEAPPQVQPAFEAELQVTMFDASAMDAENEALAQALAESNVQEAHRVEAIEPIAAEPAINDHLQEAAVQVQEPASLLESEELGQTLEPIHSVIEEVVHEAVVEEQEAAPVLEGEELGHVSEPLREPETLEVVKGTEEAIRVPTADVVPVGAEQQEALNARSEEPAPVEASPAKTRTSRHAASASPVKGTARSTSPTKRALRSSPIKRSAAASTQVAPGLAPETETAQEETMQEAAVPTEQSQPENELIEIGRSTASKPARRTAARKAKLAATEAISTTLAPSEVFQMSSPVKATRRGKTAAAKKGKEERAHVEEGQESEQESGEVEQVAQDKVEEAPKRATRTRITRGAGAPAAKPVRAPRSRAAKTGAPALPSSSAGYGDDEASEEDVAAKTKRTTATRTRSTRTPAASRTKSTSRATKSTVLEASEPEAEAADADPSVQDDDHVESQEQPSPAKTSQTRAAATRTTRAKAATSAPTKAKPKAKAAAEAIDVDASASCSTTTTRSGRTTRRTVVTKTSDDYDYGLDVCRKSAYHITASLDSQARSTRGCTRAENMVESRRVLIANRGEIACRLMRTYRQFPQCLGLETLVTSASIETVAVYTEAESSALHVSLADHSHLLSATGPRAYLDRHAMVEAALKWNCWGVAPGYGFLSEDADFAALCEAGGLVFLGPTEEQLRQLGDKVSARELAKSVNLPVLQGTCASKDGLNEILAFARGVQAGSSIILKAANGGGGRGIRVVHLPTHAVQLEREVSQAYESCMREANASFGNGTVYAERFLCNAKHVEVQILGDGSGNVCHFWDRECSLQRRNQKLVEVAPAPFLEATLRQSMLEAALRLTKAVNLRSLATVEFLVEPQQHAFYFIEANPRIQVEHTVTENVTGYDLVALQLAVGLGARLQHLGLPSDAATTPFPTRTAIQVRINAESFRNRTDETIPESGTISSLIWPLGGDVRIETAAHAPHPTLGRYKVSPLFDSLLAKVIVTSASYASAVDAARIALQETLIYGLRTNKTFLMALLQDQEVKRGTQHIHTVQAGFQRFLNASNQLQADYDAQHKRTDSLVGTARLDDKADEFHIEVGQHAVKSHLSGLVVKISVQEGQPIAPGQELAVIEAMKMEHVIRAEAACGGGQVHKVVVKQGSVVNASDVIMLIDITQLTACSAGAGEKSTALATMDATPDASVARPELQELQERRCANSDQARADAVAKRHARGFRTVRENVSMLLDQDSLIEYGDLALAAQRARYSMDHLIAKTSGDGIVTGFGRIDGHTVSVILGDYMVLAGTQGYLHHLKLDRMLTATLAHPAPLVLYAEGGGGRPGDTDYPTASGLMTPSFALMGQVRAQGIPVIGVANGYVFAGNAALLGTCDVVIATKGGNEALARSKQKLGQTSIGMGGKAMIEAGGLGVVDSDDIGPATVHAETGGIEVLVDHEDDAALMARKVVSFFTQPWIDRAKWSYSHNVQLLRTCLPPVEQRRRAFDMRRVISLLVDDASFVELAPDWGTAIITGFARIQGSATAILANNPMSPLGGAIDFNAALKATRMLKLLARTRATHLISLCDTPGFMVGPHFERTSTAGGSFRAFGDWFTSAAEFTQSGGRVIGLVLRRAFGLGAQAMLGGSTLSNTICASWPAASLGPMSLEGAVQLSMNKQLAQIQDAQHRADMAHKAVEQLYNNGRAINVASMAEVDTVLDPAETRDWLGRLLKHVLGERRPTYKSYTLNHHEPRHRTNSHVSQLSHGNFAIRRLRGALVSVEVREISREAHDVRFVTWVDFHVSFWLALRSCMTDDGNRIRLERARLQLHDQDDLVGQLGSAKRSHIAKPRIKSQRSRLRKLSLISTTHNAEKIVRARGDQQHELINSKRGVLSYQPNQQYYGAGRRIAMSSIRTLTLYAGRMSAYRRTSALPQLTCVGTLCSHYQPDVVQCTAMGDEQWKCSADLPATMRMGRVQVSCEGYDYAQDPYVLKDSCVLEYTLLPSGIGREDAWRRHSASTETLAEALFYMVFLAILAMIIVSFIRAIRANHGSANSSTSPRSGHGGGYGGGWWPGGSNPPPPPYTPKPDPNTPSWRPGFWTGLGLGGLAAAAATSSSRPRRPNAPQSSLFNPDPHAYGVRYGAGPSNLSGRGRGYDDSDHSSSGWRESTGFGGTRNR

SEQ ID NO: 66893 - protein, 366 aa, Desulfococcus oleovorans Hxd3
MSAESSGQDEKIANLRRSIDEIDDTILDLLNRRVSLAEAIGTLKTQTGNRVMDKAREESILQRLAGLNPGPLSSEMLRRIFVDIIAASRQAQEPKRISFLGPEATFTHVAALAFFNELDTFVPHPSIRDVFDDVEKGTSRYGVVPVENSIEGAVNHTLDLFLESELHICAESYLAISHDLLSKSGDLEKIHTIYSHPQPFAQCRTWLKTHLPHAELVECGSTSQAAQKALLADDAAAIAGSAAARLYDLKVAAPAIQDAVRNTTRFLVIGRDAPRPTGNDKTSILFVTAHIPGALFKALEPIAASGLNMLKLESRPARHKNWSYVFFVDLEGHVENEKVKQCLAKMEAFCQFIKILGAYPVALSDA

SEQ ID NO: 66894 - protein, 522 aa, Sulfolobus tokodaii
AMYEKPPVEKLIEELRQLKEKAYKGGGDERIQFQHSKGKLTARERLALLFDDGKFNEIMTFATTRATEFGLDKQRFYGDGVVTGWGKVDGRTVFAYAQDFTVLGGSLGETHANKIVRAYELALKVGAPVVGINDSGGARIQEGALSLEGYGAVFKMNVMASGVIPQITIMAGPAAGGAVYSPALTDFIIMIKGDAYYMFVTGPEITKVVLGEEVSFQDLGGAVVHATKSGVVHFMVDSEQEAINLTKRLLSYLPSNNMEEPPYIDTGDPADRDATGVEQIVPNDAAKPYNMREIIYKIVDNGEFLEVHKHWAQNIIVGFARIAGNVVGIVANNPEEFGGSIDIDAADKAARFIRFCDAFNIPLISLVDTPGYVPGTDQEYKGIIRHGAKMLYAFAEATVPKITVIVRKSYGGAHIAMSIKSLGADLVYAWPTAEIAVTGPEGAVRILYRKEIQQASNPDDVLKQRIAEYRKLFANPYWAAEKGLVDDVIEPKDTRRVIVAGLEMLKTKREYRYPKKHGNIPL

SEQ ID NO: 66895 - protein, 286 aa, Desulfococcus oleovorans Hxd3
MSNTQQGVPLCGTKQKQQQQQQRDPGAGIEESLARIKHKFIVMSGKGGVGKTSTSVNLALALADRGFKVGLMDVDIHGPDIPRMLGLTEMPGVTQERKMIPVPYSDNLSAISIESLSLSKDDAIIWRGPIKHTVIQQFIGDVAWGDLDFLIIDSPPGTGDEPLTVAQLILGAKAIIVTTPQEVALADIRKSINFCKTVKMEAFGLIENMSGFTCPHCGKTVDLFGSGGGERTAKDADINFLGRIPFDTNMVTCGDSGISYQSEYPDSPVTKAFASVAQAMADLVGK

SEQ ID NO: 66896 - protein, 473 aa, Gibberella zeae PH-1
MEKLSETTPNGTSPRTFALNHSRPRSSFKGCSRISDYELLGKLGEGTFGEVHRARLRKTGALVALKKIIMHHEKDGFPITALREIKLLKLLSHKNILRLEDMAIEHPTRQTDKRKKPIVYMATPYMDHDLSGLLDNPSVQFKEPQIKCYMLQLLEGLRYLHDSRILHRDMKAANLLINNKGILQIADFGLARHYDGRTPESGVPMGEGKRDYTGLVVTRWYRPPELLLQLRQYTPAIDVWGVGCVFGEMLYGKPILAGESDAAQLDIIWDLMGSPNEENMPRWKSLPGADHLTPRPRTGNLETRFRQYGSGAVSLLKELLRLDWRTRINAVDALQHPWFKMQPLPLEPHEIPTYEESHELDRRKFHDRKAALPPAPKGGTVGVGPDANGATAGFNSNEPYGNGRNGVNGGRRRDDRPPPPRDDRPPPRDDRRRRNSREDRRFDRDRGTMSRSRSPRHDRSRDRDRPDHNGYRR

SEQ ID NO: 66897 - protein, 129 aa, Oryza sativa Indica Group
MGEVMSKEYELEYGADCLEMHVGAVQPSERALVVDDLVATGGTLCAAIVLLERAGAEVVECACVIELPELKATESVASHTCLTLPKSRLAVWNAYMKKREEKIEVVKRWDRGRERLNGKPLYVLVESHS

SEQ ID NO: 66898 - protein, 644 aa, Chlamydophila pneumoniae CWL029
MTSSSCPLLDLILSPADLKKLSISQLPGLAEEIRYRIISVLSQTGGHLSSNLGIVELTIALHYVFSSPKDKFIFDVGHQTYPHKLLTGRNNEGFDHIRNDNGLSGFTNPTESDHDLFFSGHAGTALSLALGMAQTTPLESRTHVIPILGDAAFSCGLTLEALNNISTDLSKFVVILNDNNMSISKNVGAMSRIFSRWLHHPATNKLTKQVEKWLAKIPRYGDSLAKHSRRLSQCVKNLFCPTPLFEQFGLAYVGPIDGHNVKKLIPILQSVRNLPFPILVHVCTTKGKGLDQAQNNPAKYHGVRANFNKRESAKHLPAIKPKPSFPDIFGQTLCELGEVSSRLHVVTPAMSIGSRLEGFKQKFPERFFDVGIAEGHAVTFSAGIAKAGNPVICSIYSTFLHRALDNVFHDVCMQDLPVIFAIDRAGLAYGDGRSHHGIYDMSFLRAMPQMIICQPRSQVVFQQLLYSSLHWSSPSAIRYPNIPAPHGDPLTGDPNFLRSPGNAETLSQGEDVLIIALGTLCFTALSIKHQLLAYGISATVVDPIFIKPFDNDLFSLLLMSHSKVITIEEHSIRGGLASEFNNFVATFNFKVDILNFAIPDTFLSHGSKEALTKSIGLDESSMTNRILTHFNFRSKKQTVGDVRV

SEQ ID NO: 66899 - protein, 607 aa, Xanthomonas axonopodis pv. citri str. 306
MAVIEIKVPDIGDYSDVPVIEVLVAVGDSVAKDQGLVTLESDKATLEVPSSAAGVVKELKVKVGDTLSEGALVLLLETEGEAAAPAKAEPKAAPAAAAPAAAPGSKPPVTPSHRAPAEPAAPKPALASGKPADIECKMVVLGAGPGGYTAAFRAADLGLDTVLIERYASLGGVCLNVGCIPSKALLHAAAVIDEVAHAGDFGVDFGQPKITLDKLREYKEKVVGKLTGGLASMAKQRKVRTVTGVASFVSPNELEIVGDDGKTQLLRFEHCIIAAGSQAVKLPNFPWDDKRVMDSTDALELHDIPKTLLVVGGGIIGLEMATVYSALGSKVTVVEFMDQLMPGADKDLVKPLADRLKKQGVEVHLKTKATDVKADKSGITVSFEAAVEGEKPGLQATAYDRVLVAVGRSPNGKKIGAEKAGVTITERGFIPVDRQMRTNVPHIFAIGDIVGNPMLAHKATHEGKLAAEVAAGEKKEWVARVIPSVAYTNPEIAWVGVTETEAKAKGLKVGVAKFPWAASGRAIGIGRTEGFTKLIFDEQTHRVIGGAIVGVHAGDLLAEIGLAIEMGAEAEDIGHTIHAHPTLSESVGMAAEVYDGTITDLYIPKKK

SEQ ID NO: 66900 - protein, 402 aa, Synechococcus sp. RS9917
MAKRSLASLSGTDLSGKRVLVRVDFNVPLNDAGAITDDTRIRAALPTIKDLLGKGAKVILAAHFGRPKGQVNEGMRLTPVAARLGELLGKPVVKTDSCIGPDAEAKVAAMANGDVVLLENVRFFAEEEKNDAGFAEKLAGLADVYVNDAFGAAHRAHASTEGVTKFLKPAVAGFLMEKELQYLQGAVDEPKRPLAAIVGGSKVSSKIGVLEALIDKCDKVLIGGGMIFTFYKARGLAVGKSLVEDDKLELAKELEAKAAAKGVQLLLPTDVVLADNFAPDANSQVASINAIPDGWMGLDIGPDSIKVFQEALADCQTVIWNGPMGVFEFDKFAAGTNAIATTLADLSGKGCCTIIGGGDSVAAVEKAGLADKMSHISTGGGASLELLEGKVLPGVAALDEAA

SEQ ID NO: 66901 - protein, 592 aa, Xanthomonas axonopodis pv. citri str. 306
MAEIKEALVPDIGDYSDVPVIEVLVSVGDTVSKDQSLVTLESDKATMEVPSSVAGVVKEIKVKVGDSLSQGALVALIEVADAGADAAKPAAAAAPAAPAKAAPAATPAPAARAESAAPAASSDGGGLIEARVPDIGDYTDIPVIEVLVAVGDTVAKDQSLVTLESDKATMEVPSSAAGVVKELKVKVGDTLSQGNVVAIIAAADGGAGAAQSPAKPTTDTAETAGKVEPVAVPAEPDKLAQREIAQVQGARSGTGTPAAQGGQPSAGNPSSPPVTFDADSVLPSKVPYASPVVRVFARELGVDLNQLKGSEKGGRITREDVQRFVKAALSGGAPAAAGAAPAGGGNGLNLLAWPKVDFSKFGETETQPLSRIKKVSGANLARNWAMIPHVTQFESADITDLEALRVALNKENEKAGIKLTMLAFLVKASAAALKKFPEFNASLDAAGDNLTLKKYFHIGFAADTPNGLVVPVIRDVDKKGVLQIAQESGELAKKARDGKLGPADMSGGCFSISSLGGIGGTAFTPIINAPEVAILGVSKSAMQPVWNGKDFAPKLMLPLSLSYDHRVIDGALAARFTTYLSQVLADMRRVLL

SEQ ID NO: 66902 - protein, 250 aa, Klebsiella pneumoniae subsp. pneumoniae MGH 78578
MAVTKLVLVRHGESQWNNENRFTGWYDVDLSEKGVSEAKAAGKLLKAEGFSFDFAYTSVLKRAIHTLWNVLDELDQAWLPVEKSWKLNERHYGALQGLNKAETAEKYGDEQVKQWRRGFAVTPPELTKDDERYPGHDPRYAKLTDAELPTTESLALTIDRVVPYWNETILPRLKSGERVIIAAHGNSLRALVKYLDNMGEDEILELNIPTGVPLVYEFDENFKPIKHYYLGNAEEIAAKAAAVANQGKAK

SEQ ID NO: 66903 - protein, 301 aa, Triticum aestivum
  misc_feature (74)..(74): Xaa can be any naturally occurring amino acid
STCSAQKVSSYHRKTSIHLLGSAHSQRTHASARVSERERERWRICSLKQAKHYAAARPDYPAELFHFIASKTGXHDLAWDVGTGSGQAAVSLAKLYKNVVGTDTSAQQLAYAPALPNVRYAHTPADLPLDGIHAAVAPPGSVDVVTVAQAFHWLDLPRFYAQVRSLLRPHGVLAAWCYTEPRMGAAVDAVFWRLYDGSQPHWAPNRKMVDDEYRSADFPFDPVDGETHTGPFEFSTERCMNLDDYFTYIKSWSAYQTAKDNGVELLDAETVLDFADAWGGDREEVKTVRYPIFLRIGKVRP

SEQ ID NO: 66904 - protein, 309 aa, Cryptococcus neoformans var. neoformans B-3501A
MSAPTSFKLNNGVEIPAVGLGTWQAPPGQVQAAVAHALKNGYRHLDCALIYQNEAEVGDGIKESGVPRSEIFITSKVWNTHQPNVADGLRQTLEALQTDYLDLYLIHWPVRLVPNESSGLLPVNPDGSRAVDRDWDQSETWRQMEEVYASGKVKAIGVANWSIPYLEELKKTWKIVPAVNQVELHPFLPQHKLVKYCRDLGILLEAYSPLGSTNAPLLSDPEINAIAEKYKTSPATICISYQVNRGIVVLPKSVSPKRIEDNLKTIPIEKEDMVKLDGMAAAGKAQRINTPKWGWDLGFDDWYGPVKQQ

SEQ ID NO: 66905 - protein, 425 aa, Podospora anserina
MGPRKPPNKHPFYAPEDSSSLKHVTNAEDIKDFAPRRSGRATKKPSYPGDTEQEQAPAKTRKRKANNPALDEPEPEAEQDEGQQSGPDSDPDSEPEPELPEHVTKDIIAASLEPWKENELEEWDGWAEVVSDPKLFTDILRKLGVEDAEIREPLDLETLAATFEYDSQLLRMVHLANSPSNRSPVYGLVFLQSYRSMRQVWLPRQPDDKSDLWFSRQTATNACGTIALLNIVMNAKDLALGEKLSEFKEQSKDLSPSFRGNKVATSTFIRAAHNMHNSRLDLLNAVLELEQDAMRNKRARAAKRARGKAASANRRRSSGASSAAYHFVAFVPIGNGIWLFDGLDTEPGYICDIENPDNWLIDIQSTLEEYMRGRETECNLMALCGNTQTDSDNRAASRQNDFGLAIHEWIKRLSESGALDELVEN

SEQ ID NO: 66906 - protein, 395 aa, Zea mays
  misc_feature (121)..(121): Xaa can be any naturally occurring amino acid
MHIWPTCTFLKRQPHVHTDGCIPTPKSMASSPRSPPPAPTPEFEISRQSRLFAALSKKVIDLDELRMLAAQGVPDAAGVRATVWKLLLGYLPNDRSLWEQELAKKRGQYAAFKDEFLTNPXVERAQQVPTEGHHNVSAEHVDNGFLHRSEVTREEHPLSLGKTSAWNQFFEYSEIMEQIDRDVKRTHPDMQFFCGDSSFAKSNQESLKNVLLIFAKLNAGIRYVQGMNEVLAPLFFVFRSDPDDKNAEFAEADSFFCFVELLSGFRDNFCQKLDNSAVGIRGTLAKLSQLVAKYDGELQQHLEITTEVNPQFYAFRWITLLLTQEFNFADTIHIWDTLLSDPGGPQETLLRICCAMLILVRKRLLAGDFTSNLKLLQNYPPTNISHLLYVANKLH

SEQ ID NO: 66907 - protein, 718 aa, Kluyveromyces lactis NRRL Y-1140
MYGGYSNQNYYQQPSGRPNDFQQQGNMPFSEPSQPMFSTNYMKQQGSQPSLQDRLTQQQSQPQSHNNQYYPNGGFTDVPNLNYPATPPPTQSIYSHNNNSNSKVYQSAQHTSPGQYSVASESGLYIPPPLQQQQNGQQSPVRSVHQQTQQTPPTFTQQQSSSQPQSPQHNTYHAQQQQQQQQQQQQTQQAQQQGQRQTQQQSQQQAQQQNGSANNYMYFERRPDLLTKTTQDKAAAVKLKIENFYQSSVGYAIERNQRRLELESELASQDWSEERKNRQLASLGKKESQFLRLRRTRLSLDDFNSVKVIGKGAFGEVRLVQKKDTGKIYAMKTLLKSEMYNKDQLAHVKAERDVLAGSDSPWVVSLYYSFQDSQYLYLIMEFLPGGDLMTMLIRWQIFTEDVTRFYMAECILAIEVIHKLGFIHRDIKPDNILIDIRGHIKLSDFGLSTGFHKTHDSSYYKKLLQEDEAKKQQQQQQQQQQLNLQKPQLPNETNNGNRNTMLVDAIHLTMTNRQQMQTWRKSRRLMAYSTVGTPDYIAPEIFLYQGYGQECDWWSLGAIMYECLIGWPPFCSETPQETYRKIMNFEQTLQFPDDIHISYEAEDLIRRLLTHSENRLGRHGGADEIKAHPFFSGVDWNTIRQVEAPYIPKLSSVTDTRFFPTDELENVPDSPAMAQAARQREQMMTQQQGVPQSNAKEDLPFIGYTYSRFDYLTRKNAL

SEQ ID NO: 66908 - protein, 288 aa, Synechococcus elongatus PCC 6301
MKVLILGGGYTGQRLAQLLAAQSIPVLATTRSGQWPLDEPCVTFDAGSTPLLLPDPAALAGVTHVLSTIPPLGDGGDPVLSTLLPTLQYLSLQWCGYLSTTGVYGDTQGAWVDEDSPLQSTNRRSQQRIAIEAQWLASGLPAHIFRLPGIYGPGRSSFDRLRRGDNQRLLKPGHVFCRIHVDDIAAALWASLQQPNPGRIYNVSDDFPCEPALLIEAAAQLMGVELPPPLPVDAVELSPMAASFWSECRRVRNDRLKQELGVQLRYPSYREGLAAIWAAENHEEPIPR

SEQ ID NO: 66909 - protein, 446 aa, Candida glabrata CBS 138
MGCIISTSSNEDENDPFIKNKRANDIIEQSLLKERQKEKNEIKLLLLGAGESGKSTVLKQLKLLHKGGFSHQERLQYAQVIWADVIQSMKILIVQARKLGISLDCDDPVNHPDLFEHKRVLLSAKALNYVDASVAGGSGFLNDYVIKYSETYALKRRSQSTGKAKAFEDSFQYPYDDNEKLNLEEISKGLHENDDGSIFINSKQIKSPTVNNKTIAAAISNLWLKDRGIKQCFACANEFQLETSAAYYFDNVERFSENNYVCTDEDILKGRIKTTGITETQFNIESTKFKVYDAGGQRSERKKWIHCFEGITAVLFVLALSEYDQMLFEDSTVNRMHESIMLFEKLINSRWFKDTPFILFLNKVDLFEEKVKREPIRKYFPDYPGKVGDEKAGIKYFEKLFLSLNRSNKPIYVKQTCATDTETMKFVLSAVTDLVVQQQLKKSGII

SEQ ID NO: 66910 - protein, 385 aa, Oryza sativa Indica Group
MADCMQEWPEPVVRVQALADSGLEAIPRCYVKPPCDRPAPEADDASSGASIPVVDLGNGGDDEGGQLAEAVAAACRGWGFFQVVNHGVRPELMRAAREAWHGFFRLPLQEKQKYANSPRTYEGYGSRLGVEKGAILDWGDYYFLVLSPDAAKSPAKYWPANPGICKEVSEEYGREVIKLCERLMRLLSASLGLDETRFQEAFGGADCGAGLRANYYPRCPQPDLTLGLSAHSDPGILTVLLADDHVRGLQVRRRDGHWVTVQPLPDAFIVNVGDQIEELISSCTVHGWNSWTDDVQILSNSMYKSVEHRVIVNAEEERISLALFYNPRGDVPVAPAPELVTPERPSLYYRPMTFDEYRVYVRKNGPKGKAQLEALKGQSITQNNE

SEQ ID NO: 66911 - protein, 412 aa, Pseudomonas putida KT2440
MNTPFPINQVAVIGAGTMGRGIVISLANAGLSVLWLDCNAAALEAGLGMVSQAWAQQVDKQRITQAQADACLARVQAVDGYPALAEADLVIEAVYENLALKQEIFCALDAHLKPRAILASNTSALDIDAIAAVTQRPSQVLGLHFFSPAHVMKLLEIVRGTHTDQKVLDAAKALGERMGKVAIVAGNCPGFIGNRMLRSYVGEARKLLLEGALPHQVDAVLQQFGFAMGPFRMYDVVGIDLEWRARQLAGQGMHDPLVQVDNALCELGRLGQKTGQGYYRYAPGSRQAEHDPQVDALVLQVSQNLGYRRRGISAEEILERCLLALVNEGAKVLQEGIAASSGDIDQVWLHGYGFPAATGGPMRWADEQGAPFILARLEYLQGVLGEHWRPAGLLYSLVAGGKRFEPRGEVQA

SEQ ID NO: 66912 - protein, 254 aa, Chlamydophila pneumoniae CWL029
MTRQSYVLGNWKMHKTIQEAKEYVQTLASLLQGEPLSCTIGIASPFTSLRAIHEVINTTGAFLWLGAQNVHPELSGAFTGEISLPMLKEVGVEFVLVGHSERRHIFGESDAFIASKVKSVAQAGLVPVLCVGESLEVREEGKAHQVIKKQLLLGLEQMDNGSEFLIAYEPVWAIGTGKVAEASDVQDIHMFCREVVAERFSEATAEEISILYGGSVKVDNAQRFGQCSDVDGLLVGGASLEGQSFFEVAKNFNV

SEQ ID NO: 66913 - protein, 338 aa, Klebsiella pneumoniae subsp. pneumoniae MGH 78578
MKVLVTGGSGYIGSHTCVQLLQQGHEVVILDNLCNSKRSVLPVIERLGGKEATFIEGDIRNEALMTEILHDHAIEAVIHFAGLKAVGESVAKPLEYYDNNVTGTLKLVSAMRAAGVKNFIFSSSATVYGDQPKIPYVESFPTGTPQSPYGKSKLMVEQILTDLQKAQPEWSIALLRYFNPVGAHPSGDMGEDPQGIPNNLMPYIAQVAVGRRESLAIFGNDYPTEDGTGVRDYIHVMDLADGHVAAMEKLADKAGVHIYNLGAGVGSSVLDVVNAFSKACGKPINYHFAPRRDGDLPAYWADAAKADRELNWRVTRNLDEMAQDTWHWQSRHPQGYPD

SEQ ID NO: 66914 - protein, 254 aa, Leersia virginica
GARGIGEAIVRLFVKHGAKAVIADIDDAAGEALAAALGTHHVAFVRCDVSVEEDVERAVERAVARYGRLDVLCNNAGVLGRQTRAAKSILSFDAGEFDRVLRVNALGAALGMKHAALAMTPRRTGSIISVASVAGVLGGLGPHAYTASKHAIVGLTKNAACELGAHGIRVNCISPFGVATPMLINAWRQGHDAATADEADADIDLDIAVPSDGEVEKMEEVVRGLATLKGPTLRPRDIAEAALFLTSDESRYIS

SEQ ID NO: 66915 - protein, 253 aa, Zizania aquatica
GARGIGEAIVRLFVKHGANVVIADIDDAAGEALAAALGPHVSFVRCDVSVEEDVERAVERAVARHGRLDVLCNNAGVLGRQTRAAKSILSFDAGEFDRVLRVNALGAALGMKHAARAMTARRTGSIVSIASVAGVLGGLGPHAYTASKHAIVGLTKNAACELGAHGFRVNCISPFGVATPMLINAWRRAHDASTADDADADIDLDIAMPSDEEVEKMEEVVRGLATLKGPTLRPRDIAEAALFLASDDSRYIS

SEQ ID NO: 66916 - protein, 241 aa, Zea mays
  misc_feature (24)..(24): Xaa can be any naturally occurring amino acid
  misc_feature (83)..(83): Xaa can be any naturally occurring amino acid
  misc_feature (175)..(175): Xaa can be any naturally occurring amino acid
  misc_feature (193)..(193): Xaa can be any naturally occurring amino acid
PNYMDPEQWQPSIRGPISFETDSXGFVCSVLEMLSGIQPGCGKSADEIYQLVVSKKEKPMFPYSLPPDIENMLSGCFEYDFRXRPLMKDILHAFDSNKDAHHDNIGWHSLENLMVDKPPMENHINWLRKNKFQVGDKVRSRKLEISCSLETMEIPNGTVVGVDDDEGRDAYVLVXVYGLHNVLKVRCSMVERXVSYGLVAGNWVTAARKPLCLNLRSFSIYIFTRHSAYLSLVFEHLAIKQ

SEQ ID NO: 66917 - protein, 832 aa, Oryza sativa Japonica Group
MAPPCSSALVLPCLLVIAMAALQSAVVFADTVTAKRPLSGSQSALVSKRRKFALGFFQPENSQHWYLGIWYNQISKHTPVWVANRGTPISNPDTSQLTIATDGNMVLLDNSTTAIWSTNISKIASNSTVGVILDTGNLVLADESNTSIIHWQSFDHFGNTWLPGGKLGRNNKLAGVSTRLVAWKARNDPSPGVFSLELDPNGTSQYLLEWSITQQYWTSGNWTGRIFADVPEMTGCYPSSTYTFDYVNGENESESYFVYDLKDESVLTRFFLSEMGQIQFLTWIYAAKDWMPFWSQPKVKCDVYSLCGPFSVCTENALTSCSCLRGFSEQNVGEWLQGDHTSGCRRNVELQCSSNASVMGRTDGFYTMANVRLPSNAESVVVIGNDQCEQACLRSCSCTAYSYNGSCSLWHGDLINLQDVSAISSQGSSTVLIRLAASELSGQKQKNTKNLITIAIVATSVLVLMIAALFFIFRRRMVKETTRVEGSLIAFTYRDLKSVTKNFSEKLGGGAFGLVFKGSLPDATVVAVKKLEGFRQGEKQFRAEVSTIGNIQHVNLIRLLGFCSEKSRRLLVYEYMPNGSLDKQLFDNKKHVLSWNTRYQIALGIARGLDYLHEKCRDCIIHCDIKPENILLDGSFAPKVADFGLAKLMGRDISRVLTTARGTVGYIAPEWIAGTAVTAKADVFSYGMTLLEIVSGRRNVQGRRRRQEQQDDGGAAADRPFPLVAAGRLVGGGGGRREELVSAVVDGRLGGDADMGQGGESMQGGVLVHPGRREREAGHGDGGAGARRARGDRRPADSEITSVPRGVGRSIKLLAVLLRFITVELRSLQVQA

SEQ ID NO: 66918 - protein, 293 aa, Triticum aestivum
  misc_feature (117)..(117): Xaa can be any naturally occurring amino acid
  misc_feature (125)..(125): Xaa can be any naturally occurring amino acid
TTGRVHPAATSSDFSGEYAYSSSDPSSSPLYSFHFEKPVPPPPQHQNKPQPGTYVVQVPKDKVFRVPPPENARLFQHYTRRAKRRAGCSCLRACLYLAVAILSLAVLLAAAVGDVYXLAFKPRQXPAYSVVSLWPSWGLYPGSGNAFAPGALSPGFAATVRADNSANGKVGVHYDGAGSRVAVSYEGVSLADGAWPAFYQAPCNITVFVAKAKGTGIRFSERERGQMAAAERLRSVPFDVDITVPVRLQLGGVRTWAVPVTVRCAMTVDRLAASAKVVSKPCDVNVPFLFWRN

SEQ ID NO: 66919 - protein, 151 aa, Ricinus communis
HVNPAVTFGLFLARKVSLVRAIMYMAAQCLGAICGCGLVKAFQRAYYNRYGGGANELADGYSTGTGLGAEIIGTFVLVYTVFAATDPKRNARDSHVPVLAPLPIGFAVFMVHLATIPVTGTGINPARSFGAAVIYNKEKAWDDQWVYWAGP

SEQ ID NO: 66920 - protein, 580 aa, Oryza sativa Japonica Group
MTPTGIYPNSLYTFDYVNGENGSYFVYDLKDDSVLTRFVLGEMGQIQFLTWMNGANDWMLFWSQPKAQCDVYSLCGPFSVCTENAMAPCSCLRGFGEQNVGEWLQGDHTSGCRRNVELQCSSNGSVVGRSTDRFYTMGNVRLPSDAESVVATSTDQCEQACLRSCSCTAYSYNGSCSLWHGDLINLQDVSAIGSQGSNAVLIRLAASELSSQKQKHAKKLITIAIVATIVAALMVAALVVILRRRMVKGTTQVEGSLISFTYRDLKSMTKNFSEKLGGGAFGSVFKGSLPDATMVAVKKLEGFHQGEKQFRAEVSTIGNIQHVNLIRLLGFCSEKSRRLLVYEYMPNGSLDKQLFDGRKHVLSWDTRYQIALGIARGLDYLHEKCRDCIIHCDIKPENILLDGSFAPKVADFGLAKLMGRDISRVLTTARGTVGYIEPEWLAGTAVTAKADVFSYGMTLLEIVSGRRNVERREDGTADILPLLAASRLVGGVGDGRREELVSAVVDGRLGGDADMGEAERACRVAFWCIQDDENARPAMATVVQVLEGLVEIGVPPIPRSLQLLADESNYLQFSDLLPSK

SEQ ID NO: 66921 - protein, 396 aa, Clostridium acetobutylicum ATCC 824
MIQLLALKRDLKVEIREKFSIIEKRIGDKDVLLKEVCNEVVILSTCNRIEIYFNSEKNRKQIIEEIFSKMGWNINFLENFFYCKGDEAINHLMEVACGFDSLILGEDQILGQIKAAYDTALKNKTSGSELKKLFQLVITCGKEFRSISMLNRIPVSSASIAVNKARQENLRRFMVFGFGDVGSLVCKYILSSDFDVLYIVVRNKAAVSIKDKRIKVLSFNEKNSYYDDVECMISCTSAPHPVIWEKELPYRKFTIFDLAVPRDVEETVYGRNNIDIYDIDQISMIDNNNRKKRKEIMMANRHIMSKYIVEFYDWQKVQEIVPDIIKLKLYGESVNKRRYETFKNKKATKDNDMLVNMLIKSTSNVYINRAIEVLKEEQLKGRGEDCLRILRRIFQK

SEQ ID NO: 66922 - protein, 319 aa, Streptomyces hygroscopicus subsp. hygroscopicus
MRLLVTGGAGYIGSVVARRLLDEGHRVVVVDDLSSGFADAVPEGAQFVRGDMAVAARILAGPDRFDGVVHLAARSLIDDSVRRPERYWRGNTQQSLVLLDGMLAAGVGRIVFSSTAATYGQPERVPIPEDAPTRPTNPYGASKLAVDVALADYARAHGLAAVSLRYFNVAGAVGRHGERHEPETHLLPLALAAALGRGPELRLNGDDYPTRDGTCVRDFIHVADVADAHLAALSGAVSGTHRIYNLGNGRGFTVLEVLEAVARVTGRRVPFRRAERRPGDPATLVASAERILAELGWKPGRPTLEEMIEDARAFHARRC

SEQ ID NO: 66923 - protein, 152 aa, Ricinus communis
HVNPAVTFGLFLARKLSLTRALFYMVMQCLGAICGAGVVKGFEGSHDYTRLGGGANSVNPGYTKGDGLGAEIVGTFVLVYTVFSATDAKRSARDSHVPILAPLPIGFAVFLVHLATIPITGTGINPARSLGAAIIFNKDQGWDEHWIYWVGP

SEQ ID NO: 66924 - protein, 557 aa, Coprinopsis cinerea okayama7#130
MSLAIHNAARIPPYLFNTDHAQRVLAQLRSKHNGLEKYIYLNGLKERDPNLFYELLLANMLEMVPILYTPTGLLQVGDACSNYSHIWRRPEGLYVTIENKGHIREVLRTWPAGQAARIAVVTDGSRILGLGDLGANGLPISIGKLDLYVAGAGIKPTTTLPICLDLGTNTQRFLEDPLYIGVRRKRPATAEMDEFMHEFMEAMREVFPQLLVQFEDFSTDNAFRYLDLFRNQYRVFNDDTTYPRGIGSVILSGFLNAARIASEAAGTPLTEHRILFFGAGSAGIGVAKQLLSFFTLQGMSVEEAKKRIYTVDSKGLITADRKGLQEHKIFFARTDYQGPPLTNLVDVINYVKPTALLGLSTVRNAFPEEVVRLMASLNTRPIIFPLSNPVSLCEVDYADAIKWTNGSVIFASGSPYKPVEYEGKTYEPGQGNNMYVFPGIGMGAILSKARHVTDSMVEQASIALASSLTPEEKAAGLVYPRLVRIRDISAQVALAVIRAAQKDHALQNVDENSLFRNLSDDALLEYIKAKQWQPASSHLPRLPLHLASSGTARRPLL

SEQ ID NO: 66925 - protein, 647 aa, Bordetella parapertussis 12822
MNTPDLAYTHWRLHREADGLAWLALARADAAANSLSAEVMAELAAVLDALQAQPPKELVILSGKENGFIVGADINEFGALQTPQQARELVARGWQLFNRLAATPYPTLALIRGHCLGGGLELALACRYRIAADDADTALGLPEAMLGIFPGWGGMRRLPALIGAPAALDMMLTGRRVDARRAAALGLVDARVPPRLLQAAARATVLSGRAPRRARGLPAWLNRWPLKALAARRARQSVAAKDPQGHYPAPRAIIDIWARHGGNALHAPDLIDGILASDTARQLLRVFRLQERLKGYGKAAVDAPVRRVHVVGAGVMGGDIAAWCAYRGLTVTLQDQDMARIAPALARAGAFFARKLKDRRAARAAFDRLVPDPQGDGVAQADLVIEAISESAQAKQALYRQLEPRLKPGALLATNTSSLSLAGLAQVLDQPQRLVGIHFFNPVARMPLVEVVLAADSDPRALARACAFVGRIGKLPLPVRDAPGFLVNAVLAPYMLEAMRCVDEGMAPAAIDAAMAAFGMPMEPLELADTVGLDIAAAAGAQLTGEHAPPRCLAERLARKELGRKSGRGFYAWRDGKAVKPAARGVPPGLVDRLLQPLIDSARERVAAGVVADADLADAGAIFGTGFAPYTGGPLQYASQREAVQRP

SEQ ID NO: 66926 - protein, 152 aa, Ricinus communis
HVNPAVTFGLFLARKLSLTRALFYMVMQCLGAICGAGVVKGFEGDRTYETLGGGANVVNAGYTKGDGLGAEIVGTFVLVYTVFSATDAKRNARDSHVPILAPLPIGFAVFLVHLATIPITGTGINPARSLGAAIIFNKDHAWDDHWVYWVGP

SEQ ID NO: 66927 - protein, 436 aa, Haemophilus somnus 2336
MSIYTYICFLSTISILIGFVTQKISDRIQYTIAITATATVGSLILLIAGSTNLFHLDDIAQNVMQRIDFKDFLLNGILGFLLFAGALGIKLPVLKSQKLEITILALFSTIASTLFIGVLFYGISALLRLHIDFIYCILFGALISPTDPIAVLAIIKNLKAPKKLSMKVEGESLFNDGVGLVIFTTIFTVAFGGHEPTAMEITKLFLAEAVGGIFFGLILGVIAHFLISATDDGSLEILLTLTIPTAGFMLANLLHVSGALAMVVAGIMISNWTRHSGFSEQSQHYLDHFWEMIDHFLNSLLFLLIGSAMLLVNFTSQAIILSLIAIPVCLFCRYASVWIPFKFLSMKTVYNPYTLRILTWGGLRGGLSLAMALSIPATSAFLENIGMNVRDLFIIITYSVVLFSILIQGTTIETMIRKSKEATLQKRGYIGLKNQT

SEQ ID NO: 66928 - protein, 130 aa, Platanus x acerifolia
THKGADDKAYRCVYEEEDPEGKVGVSLQKDLMAIAGEALKSNITTIGPLVLPASEQLLFLFTLVGRKLINPKWKPYIPDFKQAFEHFCIHAGGRAVIDELQKNLGLSAEHVEASRMTLHRFGNTSSSSLW

SEQ ID NO: 66929 - protein, 565 aa, Yersinia pestis biovar Microtus str. 91001
MKTHGINGIRPFSAIIDACWRETYTLQRLFKDIIAGVTVGIIAIPLAMALAIASGVPPQYGLYTSAIAGIVIAVSGGSRYSVSGPTAAFVVILYPVSQQFGLAGLLLATILSGLFLLCMGFARLGRLIEYIPLSVTLGFTSGIAITIATMQVKDFFGLHLVAVPENYVGKVTALAQAMPTINVSDTLIATVTLLVLILWPRLKLKLPGHLPALVAGTAVMGVLSLFDQQVATIGSRFGYLLADGTQGQGIPPILPQFVLPWQLPAANGQEFVLNWATLSALLPAAFSMAMLGAIESLLCAVVLDGMTGQKHHSNSELVGQGLGNIVAPFFGGITATAAIARSAANVRAGATSPVSAIIHAVLVLLALLVLAPMLSYLPLAAMASLLLIVAWNMSEAHKVIDLLRRAPKDDIIIMLLCMSLTVLFDMVIAITVGIVLASLLFMRRIAQMTRLSEIPAAVNDKTLVLRVNGPLFFAAAERIFSELLTRCDNYDTIILQWDAVPVLDAGGLNAFLRFTEALTEQQLLVITDIPFQPLKTLARARVKPISGKLNFYASLPEALAALQNN

SEQ ID NO: 66930 - protein, 523 aa, Bordetella parapertussis 12822
MPENAQPHAVIPAADLQLSAQSPQWRVFAAAAAGASLVARPLRVIEAAGIYVDLSMQRHSSALAQAGLALLQARDVLGARAALFAPGAPDAAHGRYPVLRAGYGAHPEEQCDIEVEIEYARMLEFVRELDRGGACPAVLYLGGGAGQWALRLALQAFGGPAQRRQLRFVSGGDAAALHEALAGLGPRRTLVVAASRGFEPSETLDNARAAIDWLRRAGIDDVSAHLVTVTGNESAARALGVAAARVFRLPSWLQPRHELWSVGALPVALALSVDMLKALRSGAAAMDQHFLQAAPAVNAPMQMALAAVANTSAMHWPTHALAVYSARLAALPACVQQLEMTLAGRAPASLPAYSVVWSPAGAPGPGAFFEWLHRAPAGAPVDFIAGLDEYPASPPAHRALLANCLAQREALLRGLPAGPGQPAAGGGRPSTLVVLRQVDPRAVGALLALYEHKAFVQAALWGAALGGADQAQACQRLAQDIARQLAVPPAAGPVDWGHDSSTAFWIDRYREQGGAGAAAGRTA

SEQ ID NO: 66931 - protein, 317 aa, Bordetella parapertussis 12822
MSGSSHYPVANWNLDGIVSGLRGARQEWRGPRGRLREESESGVREFPSQESLRDIMRQLVGALFPMRLGPIDLREEVEDFYVGHTIGAALDALLHQVCLELQHLGRDDPQPYGQVLERAVDIVRRFGAELPAVRKALDLDVTAAYQGDPAARSVDEVLLCYPGVTAMIHHRLANVLYRLGAPMLARIVAEIAHSDTGIDIHPGATIGRSFFIDHGTGVVIGETAIIGERVRLYQMVTLGAKRFPPGENGELKKGLPRHPIIEDDVVIYAGATILGRITIGQGSTIGGNVWLTHSVPPNSTVTQAGAINDMPDCGLGG

SEQ ID NO: 66932 - protein, 421 aa, Methylococcus capsulatus str. Bath
MKARIESVQAMPIYDSRGVPTVRVRLTLTDGTAATASIPSGASTGENEAVELRDGDPKAHGGKGVLKAVSNVNDVIAPAVMGLEPWRQAEIDRLMIELDGTANKERLGANAILGVSEAVAAAAAKSAGLPLYAYLGGAGQARLPIPMINILNGGKHADSSLDFQEFMIMPVGAPSFAEAMRYATETFQALKSILKAKGHATSVGDEGGFAPQLQSNDEACDLIVEAITKAGYEPGEDIAIALDPAASSFHENGVYRLTRSGQGDKTSSEMTDLYRRWIDKYPIVSIEDGLAENDWDGFREHTAVLGEKIQIVGDDLLVTNTRFIQRAIEEKSCNAVLIKLNQIGTVTETVEAIHLCRKAGWGFVISHRSGETEDTFMADFAVAMGGGQIKTGSVCRSERMAKYNRLLEIESDLGKAARFGR

SEQ ID NO: 66933 - protein, 146 aa, Brassica napus
MGARFSRIAKRFLPKSKVRILMVGLDGSGKTTILYKLKLGEVVTTVPTIGFNLETVEYKGINFTVWDIGGQEKIRKLWRHYFQNSQGLIFVVDSSDSARLSEARNELHRILTNNELQNACVLVFANKQDSRNALPVDQVANNLGLH

SEQ ID NO: 66934 - protein, 486 aa, Gibberella zeae PH-1
MGSLSYNNSPDLGWVVQKFGGTSVGKFPDKIAKDIVRLLAVYVKLRGVGAAICSDEEQQNELVEQARGLMLDICNDHVFAAESFIKDQNLRETLIQTVKDECQELVEYIVAAKRFNLEINSRAKDRVISFGEKLSCRFMTTLLQDVGVESEYVDLCDAFHYDAAGRLDDRFYRTATEAFTRKIAACENRVPVVTGFFGNVPGSLIDGDIGRGYTDLCAALLSVGVKAEELQVWKEVDGIFSADPSKVPTARLLSSITPSEAAELTFYGSEVIHHLTMDQVIRAEPPIPIRIKNVKNPRGNGTIVVPDRMRSASHQLTRGSPTPKAEAEHRKPKRPTAVTIKDHISVINVHSNKRSISHGFFARVFSILNHYSISVDLISTSEVHVSMAIHASSQQVEAFANAAAELADCGDVSILTDMAILSLVGAEMKNMVGIAGRMFSTLGEHNVNLEMISQGASEINISCVISARDATRAMNVLHTHLFTFLE

SEQ ID NO: 66935 - protein, 339 aa, Streptomyces hygroscopicus subsp. hygroscopicus
MRAAVLNGPRDITVTEVPGPRLPEGWALVRVAYNSICGSDVSLYNNAWHGTAFPAVPGHEWSGVVEQAPPGQVAPGDRVVADLTLSCGQCRWCRRSQPVMCPGLREFGFTDPGGCADYVAVPAANLVRLPPDTDLLAATQAEPLAVSLHALSRVRLAPGETVAVLGCGGIGLTLLQAAQVAGAQVVLAVDPLPGRARTAGLLGAGAALNTPEEVAGWIADAGPDGLPDVVLEASGEPEAIRAATELVVPGGRVALVGYRVGRQVELESARWPLKLMETVGTMGPGRFMGAAAALVARGALRTDLVVTDVLDLTAADEAFRLAGAPGTDTIRVAVRADGA

SEQ ID NO: 66936 - protein, 351 aa, Synechococcus sp. RS9917
MNERSLQSQPRLLVLCTGGTIAGAGVSSCDLETYSAGVRSGEQLLAALPEARAVAALTVEQIANIDSADMSHSLWFRLLQRIDAAFRADPDLTGVVITHGTNTLEETAYWLHLALAHARPVVLVGAMRPATALSADGPLNLLQALQLAVDPQAAGRGVLVVMDGVIHGAREVTKAACAGVGAFRSPGHGRLGTVDGEGVRFTRTPSHRHTVASTLAVRGASLKAWPEVKAWPSVEILYGYVQPSATWLACWLQSGVDALVVAGTGAGQLSCFERDALEEACRQRQQAGQATPLIVRSSRTGNGRVPARKDDASLGLLAADDLSPQKARVLVLLALLQGIDRGRIAELLLTH

SEQ ID NO: 66937 - protein, 151 aa, Ricinus communis
HVNPAVTFGLFLARKVSLVRAIMYMVAQCLGAICGVGLVKAFQSSHYKRYGGGANTLDDNYSTGVGLGAEIIGTFVLVYTVFSATDPKRSARDSHVPVLAPLPIGFAVFMVHLATIPITGTGINPARSLGAAVIYNQDKAWDDQWVYWAGP

SEQ ID NO: 66938 - protein, 151 aa, Ricinus communis
HVNPAVTFGLFLARKVSLIRAVAYMVAQCLGAICGVGLVKAFMKDPYNRLGGGANSVASGYSNGTALGAEIIGTFVLVYTVFSATDPKRSARDSHVPVLAPLPIGFAVFMVHLATIPITGTGVNPARSFGAAVIYNNDKVWDDHWIYWAGP

SEQ ID NO: 66939 - protein, 258 aa, Ralstonia solanacearum
VANFKDIEVVAINDLLEPDYLAYMLKYDSVHGRFDGEVSVDGDTLIVNGKKIRLTAVKDPAELKWGEVGADVVVESTGIFLTKEGAQKHIDAGAKKVIMSAPSKDDTPMFVYGVNHGTYKGEAIVSNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELDKLATYDEICAEMKAQSEGALKGVLGYTEDK

SEQ ID NO: 66940 - protein, 333 aa, Haemophilus somnus 2336
MFLLKKFSHLLAKYTALVIIALACVTFYSPNLFTWVKGDAQIIVLGLIMLSMGMTLGKEDYRILAKRPFDILVGTIAQYSIMPFVAISIAQLFNLSLGLTLGLVLVGCCPGGVASNIMSFLCKGDVAYSVGMTTVSTILAPIMTPLLLNYLVGETVAMDGWAMFKFMLLVTLVPVGIGSIMNITFENKKWFQELRELMPGVAVINFAFIVGGVVAVHGNKFLESGFIIFVCIVFHNVIGYILGFFTGRLFGMSTAKKRTLSIEVGVQNAGLATGLSSKFFPTNAESAIACAVSCVWHSISGTILANLFLWWDKRKNTSTQENNPAKNLMNSTK

SEQ ID NO: 66941 - protein, 629 aa, Myxococcus xanthus DK 1622
MPTSATRSAASWLSRAVPFLESVRGYRATWLKRDTVGALTVTALLIPEGMAYAELAGLPPTAAFYAAPAGLVLYALFGSSRQLIVAVSAAVAVLSAATVGALAQAGSPRFVVLTAALALMAGLISLLAGVLRLGRIAQFFSASVLTGFVFGLALIIAIKQVPKLFGVKGGDGNFFERLWFLVTHLGSTHLVTLLVGAGSLIMLLALDRVSKRLPAALVVLALSIVVTALLGLDARGVSVVGKVQAGLVPPQVPDVGLGDLLRLLPGASGIALVAFAEAIGPARMLAARHGYEVDANRELVGLGAANMGAGLFQGFSIGCSLSKSAANDAAGARTEVSAMLAAGFTLLVALFLTPLFRLLPEATLGAIVVVAVSGMMDVREMRRLHRMRRADFLGALVALVGVLALDVLPGLLVAVGVSLFLTVYRASVPRLSELGRVPGTLAFGDVRHAPRPLTVPGMLILRPNEGIFFANATALRDEVMTRVRHAGPSLHAVLLDMEVTADLDVPGADMLAALHDDLARRRVTLMLTRVMAPTGRMLERTGVTAKVGAEHLYAQVLDAVVEHLARASAATPEAQGLVRDGLRRLRMLVEEASTTLDADEGADRERLQTLGRRLGRAESALGEERPGPH

SEQ ID NO: 66942 - protein, 964 aa, Oryza sativa Indica Group
MERSLLPWLLLLLCFADGVFQSRAQPDSKGFISIDCGIQPNTSYVHNTTKISYVADDDFTDGGSNYNVSPEYIKPQLSQRYYNLRAFPDGARNCYTARSLAPGIKYLIRASFLYGNYDGLNKLPVFHLYIGVNFWTMVNITSLGLGGSRYEEAIVVVPDDFVQVCLINTGTGTPFISSLELRPLDKRLYPQVNATLGLLQLNRLNFGPTDNSLVRYPDDPHDRFWGNWDSYTSSLWKEISTASRVDNLDGDIFDAPTAVMQTAVTPRNASGNIYFFWEPWPQPNDPTPPYTVIFHFSELEILTNNASRQFYINLNGEPLIDTAYEPTYLTARYLYGLEPLERTSRYNITINATANSTLPPLINAAEIFSIISTAVIGTDSQDASSMMAIKDKYQVKKNWMGDPCMPKTFAWDKLTCSYPNSSGARIISLNLSSSGLSADISSAFGNLKALQYLDLSNNSLTGSIPDVLSQLPSLRVLDLTGNQLSGSIPSGILKRIQDGSLNVRYGNNPNLCINGNSCKAAKKKSKLAIYTVIPAVLVVLIASVTTLFCLLRRKKQGPMNNSLEQQNEMSTSTSHVLINSGYGDNVSLRLENRRFTYKELEKITNKFKRVLGRGGFGYVYHGFLEDGTEVAVKLRSESSSQGAKEFLIEAQILTRIHHKNLVSMISYCKDGIYMALVYEYMPEGTLEEHIVGENKKGKILNMEREAQYRIGICTRCIILTIPMDPYALQQTLLGLEYLHKGCNPPIIHRDVKATNILLNTRLEAKIADFGLSKASSYDNITHVSTNALVGTLGYVDPEYQMTMQATTKSDVYSFGVVLLELVTGKPAILHEPNPISVIHWTRQRLARGNIEDVVDTCMPSDYDVNGVWKAMDIAFTCTAQASTQRLTMTEVVMQLQECLELEDARCAIGDAHNEFYPDPRSDHNLSYNTYVSDRSNDVSQNSGVSMMEHNFGRVPTMASGPAAR

SEQ ID NO: 66943 - protein, 213 aa, Haemophilus somnus 2336
MSDQSCIIIAIDGASASGKSLIASTIHEELCNELGCEEIGIVTEDSYYKDQTHLSFEERIKTNYDHPNSMDRDLLIQHLCDVKKGKAVDIPVYSYVEHTRTQEVTRFEPKKVIILEGILLLTDERIRQEVNMSVFVDTPLDICFIRRLQRDMEERGRSLQSVIDQYKSTVRPMFLQFIEPSKQYADIVVPRGGKNRVAINMLKVQIQHLLNNK

SEQ ID NO: 66944 - protein, 489 aa, Bordetella parapertussis 12822
MTQLTQPLSRAELLRDACYIDGKWVGAGNGPSIPVDNPSTGKTIISVPKLGRKEAEQAIDAAEAALPAWSARTGKERAAILLKWAQLTMENQQDLAVIMTSEQGKPVAEAAGEIAYAASFLEWFAEEAKRIDGDILQSPKGGQRLMVLKQPIGVTAAITPWNFPAAMITRKVGPALAAGCTMVVKPAQQTPLTALALAVLAEQAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGQPHALGGSFFQPTVVRDVTQSMRFAVEETFGPVAPLFKFESEDEVIGMANNTIFGLAAYFYTRDYARIWRVSEALEYGIVGINTGIISNEVGPFGGVKQSGLGREGSKYGIEDYLELKYLCVDLGA

SEQ ID NO: 66945 - protein, 433 aa, Bordetella parapertussis 12822
MHTAFHLPNEPEMKNRDLNTRRTLATPRGVGVMCDFYAVRAENSTLWDAEGKEYIDFAGGIAVLNTGHRHPKVKAAIAAQLDNFTHTAYQIVPYEGYVSLAERINAVAPIEGLKKTAFFTTGVEAVENAVKIARAYTGRSGVVAFSGAFHGRTMMGMALTGKVAPYKLAFGPMPGDVFHVPFPNATQAISVADSLKALDLLFKVDIDPKRVAAIIIEPVQGEGGFNVTPPELMQALRKVCDEHGILLIADEVQTGFARTGKLFAMQHHSVQADLITMAKSLGGGMPISGVVGRAEVMDGPAAGGLGGTYAGNPLAVAAAHAVLDVIAEEKLCERAAELGKRLMDRLEGLRAKCPAIADVRGLGSMVALELNDPATGKPDAEAVKRIQQQAIERGLILLSCGVYGNVLRFLYPLTIPDDQFARALDILAETIAA

SEQ ID NO: 66946 - protein, 334 aa, Burkholderia xenovorans LB400
MDYQISVADSDIAFHCEAGETVLDAAERSGYSVPYSCRKGVCSTCEGGVVAGAGRSSVQGDVQGPAGHVLLCCLRPSSDMTIAPRKIDRREPVVRKTLDMSVYRITQPAADVSIVQLRLPTGVRAKFRAGQYLQIELEDGSRRNYSMANPPHESDSIQLHVRHVPGGRFSEGMLRRLDKGHKLRVELPFGEFSLQDDSTKPVILLATGTGFAPVKSIVEDAIKRRLDRPLTLYWGARRAEDLYLAELAQKWHDSGKLKFVPVLSEPNADWNGRRGFVHETVLEDFGSLDGYQVYACGNPAMTTAAHESFLKAGLPDDDFFSDAFVHTDTAPAMT

SEQ ID NO: 66947 - protein, 230 aa, Triticum aestivum
  misc_feature (208)..(208): Xaa can be any naturally occurring amino acid
MTSKEEKVDIGTHTPPSHEVAPGHQKDVFTGDIEGVREDFREDDFMTRNGLNLKSFQRRDYGTGVVELDRSMKKRHLHMIAIGGSIGAGFFVGSGGAFTKGGPGAVLICFMIAGVMIFNVVHALGELAVMYPVSGGFYTYSTRFIDPSWGFAMGWNYVFQWVIVLPLELTVASFTVQYWNPNINEGIWITVFWLFIIFINVFGTLGYXEEGVWSSCFKLAAIIIFMIVAV

SEQ ID NO: 66948 - protein, 425 aa, Ustilago maydis 521
MPFHNPLAKQPDSYVKKKEYDFKKTLGEGTFGIVRQATWKAADPPINVAVKVISKRILRGHDEIVKDEMNVLKGLDQPHVVKFLDWFESKDKYYLVFEEATGGELFERILSRGRFTELDACRTIRAVLSAIQYLHHHNIVHRDIKPENILYRTKAEDANVVLVDFGIAAHMKDDNEVLTSVCGSFGYAAPEILAKKGHGKAVDMWSLGVITYTMLCGYTPFRSDDAAALAAETQRGKVEFHDRYWKNVSNEAKDFVKACLTVDPKKRLTADQGMSHPWLTEHSEETQGVHDISAGLRENYRKRWKSAIAAVRASTKFRTFAQLASESRSGSQASLQTSDSSTAFADDPGKISPPTKRELYSESEDEQDGEDNQWFDTEDGSAARGNDATLADAASSQSENEPGWVEKLENKLDDLHLHSSSKSSE

SEQ ID NO: 66949 - protein, 163 aa, Desulfovibrio desulfuricans G20
MRHVLSVLVENEPGVLSRVAGLFSGRGFNIESLNVAPTLEAGVSLMTISTSGDDQIIEQIVKQLRKLVTVIKVVDFEDIAAVEREMVILKVNAEETRRAEVLRIADIFRCKVVDVSLHDLTLEATGDHGKIQAVIQLLTRFGIKEIARTGTVAMKRSMQPEQV

SEQ ID NO: 66950 - protein, 448 aa, Lactobacillus plantarum WCFS1
MSQATDYVQHVYQVIEHRDPNQTEFLEAINDVFKTITPVLEQHPEYIEANILERLTEPERIIQFRVPWLDDAGHARVNRGFRVQFNSAIGPYKGGLRLHPSVNLSIVKFLGFEQIFKNALTGLPIGGGKGGSDFDPKGKSDNEIMRFCQSFMTELSKYIGLDTDVPAGDIGVGGREIGFLYGQYKRLRGADRGVLTGKGLNYGGSLARTEATGYGLAYYTNEMLKANQLSFPGQRVAISGAGNVAIYAIQKVEELGGKVITCSDSNGYVIDENGIDFKIVKQIKEVERGRIKDYADRVASASYYEGSVWDAQVAYDIALPCATQNEISGDQAKNLIANGAKVVAEGANMPSSPEAIATYQAASLLYGPAKAANAGGVAVSALEMSQNSMRLSWTFEEVDNRLKQIMQDIFAHSVAAADEYHVSGDYLSGANIAGFTKVADAMLAQGLV

SEQ ID NO: 66951 - protein, 477 aa, Triticum aestivum
MAQRWRSKARRDPDLDDAGSPSPARRRAPPSDDEDEAGNEDLTLEIVARARRREAAGGQPGFAEVLSLSSDEEVDEDAVVELGEADPSRRKDKKKKQRRKERRKKQRKEDAAAAAAADKEEPQVAGAQEGQTGTVESVPTENGVDAPVSDNTVLRKLLRIPRYFDPGETILETCFNCGEEGHVAVNCPMEKRKKPCFVCGLFGHNAKQCTQGQECFICKKGGHMAKDCPDKHTKNTQQYTTLCLRCGETGHDMFGCSNDYPPDDVKEIKCYVCNQNGHLCCTDFSDSCSKEVTCYNCAQSGHTGLGCAKQRRETSVATTPTLCYKCGEDGHFARGCTNSAKPGRFKGELSSHSRRKDKWKNDSGPRSAPHGSHKRKSPLFEDRWETPRGKSRARGGWIPEDHDDLPSKKYKGNGWDSQSTPKKPYNNHHHRSSGGDYSSPQGQDFSWHNSQYSPSARKHGSSSSRFASNTHHRFERS

SEQ ID NO: 66952 - protein, 318 aa, Brassica napus
MATKRNVGTLKEADLKGKSVFVRVDLNVPLDDNSNITDDTRIRAAVPTIKYLMGNGSRVVLCSHLGRPKGVTPKFSLKPLVPRLSELLGIEVVMANDSIGEEVQKLVAALPEGGVLLLENVRFYKEEEKNDPEFAKKLAALADLYVNDAFGTAHRAHASTEGVAKYLKPSVAGFLMQKELDYLVGAVANPKKPFAAIVGGSKVSTKIGVIESLLSTVDILLLGGGMIYTFYKAQGHAVGSSLLEEDKLDLARSLMEKAQDKGVSLLLPTDVVIADKFAPDANSKIVPATAIPDGWMGLDIGPDSIKTFSEALDTTKTI

SEQ ID NO: 66953 - protein, 224 aa, Bacillus anthracis str. A2012
MDKQIGFIGCGNMGMAIIGGMLNKKIVSSNKIMCSDLNTTNLENASEKYGISITTDNNEVAKNADILILSIKPDLYASVINEIKEEIKSDVIVVTIAAGKSVKSTEDSFDTKLKVVRVMPNTPALVGEGMSALCPNEMVTEKDLEDVLNIFNSFGQSEIVSEKLMDVVTSVSGSSPAYVYMIIEAMADAAVLDGMPRNQAYKFAAQAVLGSAKMVLETRNTSWE

SEQ ID NO: 66954 - protein, 460 aa, Klebsiella pneumoniae subsp. pneumoniae MGH 78578
MQQQHKPHLLRGLNARHIRFIALGSAIGTGLFYGSASAIKAAGPAVLLAYLIGGAAVFIVMRALGEMAVRNPVSGSFGSYARQYLGPLAGFITGWTYTFEMVIVALADVTAFGIYMGLWYPDVPRWIWILSIIFFIGAMNLCNVRVFGEMEFWLSLVKVVAIIAMMLAGAGIIFFGFGHSFPATGLENLWSHGGFAPNGWQGVIASLGIVMFAFGGVEIIGVTAAEAKDPKKVIPQAINTIPLRIILFYVCTLAVLMAIFPWNSFGEQGSPFVLIFDGLGIPAAATILNIIVISASISAINSDIFGAGRMMYGMSKEGLAPKSFQRIASNGVPWMTVVVMGGALLAAVVLNYLIPEQVFVLIASLAAFATVWVWLMILLSHFAMRRGLSAEERSQIAFPIPFWPVAPLLTLLFMGLVIAVLGMFAETRMALIAGLVWLGLLTVVWYARVRKTALQVATEQ

SEQ ID NO: 66955 - protein, 189 aa, Methylococcus capsulatus str. Bath
MHFNLPTYLTLLRIVLIPVLTVAFYLPWSGAHVVSGVIFAIAAITDWLDGYLARRMGLATRFGAFLDPVADKLMVAVALVLIVQAEPRPLIALASAIIIGREITIASLREWMAEIGQRKRVEVSALGKWKTTFQMLAITLLLLGLDIPHGGVKTTGELLLVVSATLTLWSMIVYLQAAMPVFKAGAEAE

SEQ ID NO: 66956 - protein, 429 aa, Klebsiella pneumoniae subsp. pneumoniae MGH 78578
MTLDDLAFDRRHIWHPYTSMTSPLPVYPVVSAHGCELSLAGGEQLVDGMSSWWAAIHGYNHPRLNAALKGQIDQMSHVMFGGITHPPAVALCRQLVAMTPASLECVFLADSGSVAVEVAMKMALQYWQAKGEPRRRFLTFRNGYHGDTFGAMSVCDPQNSMHSLWQGYLPDNLFAPAPQSRFDGEWDEIDMVPFARLMAAHRHEIAAVILEPIVQGAGGMRMYHPEWLKRVRKMCDREGILLIADEIATGFGRTGKLFACEHAGITADILCLGKALTGGTMTLSAAITTRTVAETISNGEAGCFMHGPTFMGNPLACAVASESLRLLESGEWQPQVAAIEAQLQAELAPARGSALVADVRVLGAIGVVETRRPVNMAALQRFFVEQGVWIRPFGRLIYLMPPYIITPEQLTRLTRAVNQAVQDETFFSE

SEQ ID NO: 66957 - protein, 225 aa, Zea mays
MDAADARPSAPSAAAAAVAGASVADEPRDARVVRELLRSMGLGEGEYEPRVVHQFLDLAYRYVGDVLGDAQVYADHAGKAQIDADDVRLAIQAKVNFSFSQPPPREVLLELARSRNRMPLPKSIAPPGSIPLPPEQDTLLAQNYQLLPPLKPPPQFEETEDENEESNPSLTPNPANSNPTFSQDQRSNEQQHTPQHGQRVSFQLNAVAAAAAKRPRMTVDQLNIG

SEQ ID NO: 66958 - protein, 251 aa, Ricinus communis
MPIRNIAVGHPHEATQPDALKAALAEFISTLIFVFAGEGSGMAFNKLTNNGVATPSGLVAAAIAHAFALFVAVSVGANISGGHVNPAVTFGAFVGGNITLLRGILYWFAQLLGSTVACLLLKFSTGGLTTSAFALSSGVGVWNAFVFEIVMTFGLVYTVYATAVDPKKGSLGTIAPIAIGFIVGANILAGGAFDGASMNPAVSFGPALVSWSWENHWVYWAGPLVGGGLAGLVYEFFFIHSTHEQLPTTDY

SEQ ID NO: 66959 - protein, 250 aa, Neptuniibacter caesariensis
MRTAFVAGNWKMNGNTDSINELMDGLVNSINSSSVEVLVCPPSVYISQVKSLTESSKISVGAQNVSENANGAFTGEVSLSMLNDLGCEYVILGHSERRSLYAETDQLVAAKFIAAVESGVKPILCVGETLDERENGETLKVVSRQLNAVIDAAGIEKFADAVVAYEPVWAIGTGKTATPEQAQEVHAAIRAEIAKSDAATAEKTRILYGGSVNAANAAELFANADVDGGLVGGASLKVNDFIAICQAADA

SEQ ID NO: 66960 - protein, 70 aa, Glycine max
PKLPYTDLSTMIRRQRQAIDEKIRELSNCHIVYAGIDFQKKEAGIPKKIIDDIPGLSKYLIPNLSLITWQ

SEQ ID NO: 66961 - protein, 446 aa, Fusobacterium nucleatum subsp. vincentii ATCC 49256
MISNLSELQKKDLKYVFHPCAQMKDFEENPPLVITKGDGIYLIDENGNRYMDCISSWWVNLFGHCNKRINKVITEQVNTLEHVIFANFAHEPAAELCEELTKVLPKGINKFLFSDNGSSCIEMALKLSFQYHLQTGNPQKTKFISLENAYHGETIGALGVGDVDIFTETYRPLIKEGRKVRVPYINSKLSDEEFTKLEDECIKELEDLIKKKHNEIACMIVEPMVQGAAGIKIYSARFLKAARDLTKKYNIHLIDDEIAMGFGRTGKMFACEHAGIEPDMMCIAKGLSSGYYPIAMLCITTDIFNAFYADYKEGKSFLHSHTYSGNPLGCRIALEVLKIFKDDDVLRTINKKGTHLKNKMEEIFKDKSYIKDIRNIGLIGAIELKDNLLPNVRIGREIYNLALKKGIFVRPIANSVYFMPPYIITYEEINKMLQVCKESIEEILKI

SEQ ID NO: 66962 - protein, 338 aa, Arxula adeninivorans
MDKGKKVETVEKQENSLPWVEKYRPTTLDEVAGHEGVITTIKKFVEEGKLPHLLFHGPPGTGKTTTIIAVARQIYGKNYRNMILELNASDERGIDVVRDQIKTFASTRQIFSSGFKLVILDEADAMTNAAQNALRRIIEKYSAHTRFCILANYTHKLNPALLSRCTRFRFSPLKEDAIKHRLAHVIEQESVDLSPEAFQSLLHLSSGDMRRALNVLQACYASVDAGEQISEELVYDCVGSPRPADIRTVLQAVLDGSWESALHTFSYIKQSKGLALADMLTAFAVEFQKLDLQNKTRIALLDGLSEIEWRLSSGGNESIQTSATIGVIKQSMELEASS

SEQ ID NO: 66963 - protein, 88 aa, Oryza sativa
FLGNRPTTSILADKITPATLGALIVYYEHLTFTEGAIWNINSFDQWGVELGKSLAKKIQAELDDDKESTAHDASTSGLINAFKKKSAL

SEQ ID NO: 66964 - protein, 442 aa, Zea mays
MASRNHNAAAPQLHHHNRAGVPALGKAKAVPARADALNRRPPLGDIGNLVSVRPATGNPQEQVNRPITRSFGAQLVKKAQAKAAIKNAAILPARHAPRQERKAPVKQQPPPEDIIVLSSDSEQSRAQSESSASSVRSRRKAINTLSSVLSARSKAACGIAGKPRQVVDDIDKLDVNNELAVVEYIEDIYTFYKIAQHERRPCDYIDAQLEINSKMRAILADWIIEVHHKFELMPETLYLTMYIIDQYLSLQPVLRKELQLVGVSSMLIACKYEEIWAPEVNDFILISDSAYSREQILSMEKGILNRLEWNLTVPTVYMFLVRFLKAATLGGKVEKEMENMVFFFAELALMQYDLVTRLPSLVAASAVYAARLTLKRAPLWTDTLKHHTGFRESEAELIECTKMLVIAHSTAPESKLRVVYKKYSSEQFGGVALRPPAEEICK

SEQ ID NO: 66965 - protein, 288 aa, Ricinus communis
MEGKEEDVRLGANKYRETQPIGTAAQSQDDKDYTEPPPAPLFEPGELTSWSFYRAGIAEFIATFLFLYISVLTVMGVVKAPTKCSTVGIQGIAWAFGGMIFALVYCTAGISGGHINPAVTFGLFLARKLSLTRALFYMVMQCLGAICGAGVVKGFEGSHDYTRLGGGANSVNPGYTKGDGLGAEIVGTFVLVYTVFSATDAKRSARDSHVPILAPLPIGFAVFLVHLATIPITGTGINPARSLGAAIIFNKDQGWDDHWIFWVGPFIGAALAALYHQVVIRAIPFKKC

SEQ ID NO: 66966 - protein, 1119 aa, Aspergillus nidulans FGSC A4
MSPLECVEPAIQRSSIADSPRDRLEQSHREPSEAFSNQEEAEAGSYSGESEPSGVRHVGPCHLGLALNGLLERHTEGPWEYLPGGHHPVHLGDRIGDYKQFKVIHKLGSGGFGIVWLCSWVGTDPTIYVAIKILKAEWSGEDCREQENIRWLQGIADRDPDVEEWCLLPWQEFTLDGPNGTHQCFVYEVAASGLGNISHVVDDVDVFLRKLTRQAAEAMSVLHRHNICHGDFRPSNILLRVNGLDVSWRSTSSTQVCCHQIRIADFGESFIAGNPPPHGSGIPFQYAAPEVALDEKAGKESDIFALAATMYEIRFGNRLFRIQEDGVEAYVHFMVKYCGRLPEPWWSRWKETWKKVTEPANEDELQDESTVKLWHIRKAVCEPIGHRVSTPESWAYPHKLLGRNGVIGCDELIPVKEKIYLADLLYRMTALDPRERITIDEVLEHRWFRYEAENAEPARHDKFEERKDDLSRTENSDPDASGNQAIVDELPQAVNPEKPQKVADYNLPQLKTNHTGIHNNSPTAEAETAEGFAIQPAPKQSEPAEHKTLPSTGASELQLPDEQKAEVLSLNIPLTPAAAAIRLPESGKPQYAAAVTLQPVEDAKLIYIPTNLSPVHEIDGLQSCLPEHLRPPTPYSSWQMIHVTRTSSLRDSSPMAEDSHEHAVLLPRELPDTDRDEYDGFSRQRRHLGLLSTTFLITNRMIGTAIFSTPSAIAASVGSAGAALALWVVGLILAYCGLFIWIELGSLMPRSGGIGSVVVAENILLALNGSATDWVKRGLAIAVLAIIATIHIRFSALGVKIMILILFLIIVAGLRALRGDLPQIPDPASSLKSPFTGSSSSVSRYTNALFKILATYQGWSNAAYVLDEVKDPRKVLKIAGVVGVGLVGILYTLTNISYFIVATPDEISKTGVTVVALLIGKVFGDTMLWLTATLAALSSFGNLMTASFTMSRVVREFAREGIVPYSRFFAATTSSGSPSAAFLLVFLSSAVMILFIPFDVSQYAIALVNVLVVIALFIIRRKQPHRRTFRAWTPVIYLFLASQVFLLVTPFIPAALDTGRALPPWLYSVVALLVFFGSGVYWFMSWEVLPRRGQFVWTARESVLADGSSVVLWDKVKIN

SEQ ID NO: 66967 - protein, 280 aa, Ricinus communis
MAKDVGEETQTSHGKDYVDPPPAPLVDMAELKLWSFYRALIAEFIATLLFLYITVATVIGYKKQTDPCGGVGILGIAWAFGGMIFILVYCTAGISGGHINPAVTFGLFLARKVSLIRAVAYMVAQCLGAICGVGLVKAFMKNPYNRLGGGANSVASGYSNGTALGAEIIGTFVLVYTVFSATDPKRSARDSHVPVLAPLPIGFAVFMVHLATIPITGTGINPARSFGAAVIYNNDKVWDDHWIFWVGPFVGALAAAAYHQYVLRAAGIKALGSFRSNPTN

SEQ ID NO: 66968 - protein, 226 aa, Platanus x acerifolia
MGNNLLEALNVRVVGTGERTLVLAHGFGTDQSAWQRVLPYFVPHYRIVLYDLVCAGSVNPDHFDFRRYTSLYAYVEDLLHILEALGIEKCAYVGHSISAMIGILASIRRPDLFTKLVLIGASPRFLNDRDYHGGFEREEIEKLFSAMEANYEAWVNGFAPLAVGADVPAVVREFSRTLFNMRPDISLFVSRTVFNSDFRGVLGLVKVPCCIIQSVRDVSVPVSVAT

SEQ ID NO: 66969 - protein, 229 aa, Platanus x acerifolia
TGPLEGCKLIRKENSSYGFVDYFDRRSAALAILTLNGRHLFGQAIKVNWAYASGQREDTSGHFNIFVGDLSPEVTDATLFACLSVYPSCSDARVMWDQKTGRSRGFGFVSFRNQQDAQSAINDLTGKWLGSRQIRCNWAAKGAGANDDKQNTDAKSVVELTSGTSEDGQETINDDAPENNPQYTTVYVGNLAPEVTQLDLHRHFHALGAGVIEEVRVQRDKGFGFVRYS

SEQ ID NO: 66970 - protein, 258 aa, Ralstonia solanacearum
VANFKDIEVVAINDLLEPDYLAYMLKYDSVHGRFDGEVAVDGNTLIVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPELNKKLTGMSFRVPTSDVSVVDLTVELEKAATYDEICAEMKAQSESALKGVLGYTEDK

SEQ ID NO: 66971 - protein, 184 aa, Salmonella typhimurium LT2
MSDTLRPYKNLFPGIGQRVMIDTSSVVIGDVRLADDVGIWPLVVIRGDVNYVAIGARTNIQDGSVLHVTHKSSSNPHGNPLIIGEDVTVGHKVMLHGCTIGNRVLVGMGSIVLDGAIIEDDVMIGAGSLVPQHKRLESGYLYLGSPVKQIRPLSDAERSGLQYSANNYVKWKDDYLSQDNHIQP

SEQ ID NO: 66972 - protein, 117 aa, Legionella pneumophila
MLDFSLNRDPQTGELYIETSLCGKPLLTTPQLNKGTAFTQEERKDFGLLGKLPHRVETLDEQVKRAYLQYSSYTTRLQQHIYLNNLHDKNQIVFYKLLSRHLGEMLPIIYTPIVGAA

SEQ ID NO: 66973 - protein, 366 aa, Bacillus pumilus SAFR-032
MALTAGIVGLPNVGKSTLFNAITQAGAESANYPFCTIDPNVGIVEVPDERLQKLTELVQPKKTVPTAFEFTDIAGIVKGASKGEGLGNKFLSHIRQVDAICHVVRAFADDNITHVSGKVDPVSDIETINLELILADLETVEKRLARVSKLAKQKDKEAVAEFDILSKLMHAFEAGKSARSVEFTEEQQKLVKQLHLLTSKPVLYVANVSEDEVADHDGNEYVQQIREFASGENAEVIVVCAKIESEIAELEGEEKQMFLEELGIKESGLDQLIQASYSLLGLATYFTAGEQEVRAWTFKKGMKAPECAGIIHTDFERGFIRAETVAYEDLLAGGSMSAAKEAGKVRLEGKEYVVKDGDVIHFRFNV

SEQ ID NO: 66974 - protein, 307 aa, Rickettsia sibirica 246
MQENLKLVWQNASNLKNKEVDSISSLNNIAIIKNIIKCSSELKNQAIVLKLPATIIIDDKLFTAFIESVRLLEMCGAKIYIVHDHIDLRSSSLISQIDENFSQKISKISDYSSLNNPIIMEILSSYVNKLIVTKLSSIGCYAVGISGKDANLLQAKKSKLSYRKIVNHDVINIGFLSEPIMINPEILLNFADNNIIPVIAPFASGDQEKTHLLNVNLTLATIASALSAEHLILPYEILQVSETFPYNIKIRDINLLKSMLDDSNNFIEEALIKIAVNALENNNGYVHFVNSEAPHSILSTMFDININ

SEQ ID NO: 66975 - protein, 765 aa, Glycine max
MGAVILPDLGTEILIPVCAIIGIGFALFQWVLVSKVKLSAARDASPNAAGKNGYNDYLIEEEEGLNDHNVVLKCAEIQNAISEGATSFLFTEYKYVGIFMVAFAILIFLFLGSVEGFSTSYQPCTYDQTKMCKPALATAVFSTISFLLGGVTSLISGFLGMKIATYANARTTLEARKGVGKAFITAFRSGAVMGFLLAANGLLVLYIAINLFKIYYGDDWGGLFEAITGYGLGGSSMALFGRVGGGIYTKAADVGADLVGKVERNIPEDDPRNPAVIADNVGDNVGDIAGMGSDLFGSYAESSCAALVVASISSFGVNHELTAMLYPLIISSVGILVCLLTTLFATDFFEIKAVKEIEPALKKQLIISTALMTIGIAIVSWIALPTSFTIFNFGVQKDVKNWQLFLCVAVGLWAGLIIGFVTEYYTSNAYSPVQDVADSCRTGAATNVIFGLALGYKSVIIPIFAIAISIFVSFTFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPKVFIGLIVGAMLPYWFSAMTMKSVGSAALKMVEEVRRQFNTIPGLMEGTAKPDYATCVKISTDASIKEMIPPGALVMLTPLVVGILFGVETLSGVLAGSLVSGVQIAISASNTGGAWDNAKKYIEAGASEHARSLGPKGSDCHKAAVIGDTIGDPLKDTSGPSLNILIKLMAVESLVFAPFFATHGGLLFKI

SEQ ID NO: 66976 - protein, 423 aa, Staphylococcus aureus subsp. aureus MRSA252
MPEVKVPELAESITEGTIAEWLKNLGDSVEKGEAILELETDKVNVEVVSEEAGVLSEQLASEGDTVEVGQAIAVIGEGSGNASKENSNDNTPQQNDETTNNKKEETTNKSADKAEVNQTNDDNQQRVNATPSARRYARENGVNLAEVSPKTNDVVRKEDIDKKQQAPASTQTTQQAPAKEEKKYNQYPTKPVIREKMSRRKKTAAKKLLEVSNNTAMLTTFNEVDMTNVMELRKRKKEQFMKDHDGTKLGFMSFFTKASVAALKKYPEVNAEIDGDDMITKQYYDIGVAVSTDDGLLVPFVRDCDKKNFAEIEAEIANLAVKAREKKLGLDDMVNGSFTITNGGIFGSMMSTPIINGNQAAILGMHSIITRPIAIDQDTIENRPMMYIALSYDHRIIDGKEAVGFLKTIKELIENPEDLLLES

SEQ ID NO: 66977 - protein, 191 aa, Glycine max
  misc_feature (17)..(17): Xaa can be any naturally occurring amino acid
RDSEMLASGSQDGKIKXWRIRTGQCLRRLERAHSKGVTSVTFSRDGTQILSTSFDTTARVHGLKSGKMLKEFRGHSSYVNYAIFTTDGSRVITASSDCTVKVWDTKTTDCLHTFKPPPPLRGGDASVNSVHLFPKNTDHIVVCNKTSSIFIMTLQGQVVKSFSSGKREGGDFVAASVSPKGEWIYCVGEDM

SEQ ID NO: 66978 - protein, 380 aa, Thermoplasma volcanium GSS1
MLRKLMHVGPSMTSYEVQLEGVRENVGFASPEFLEAMRNSLEGLRIVVGADNSYLPFILPGSGTVAMESVTSILPRKGKVLVASNGVFGNRWKPILDAHRMEYEVLEAEPGKSVDPASIKDKLSSGNFASLVFTHVETSTGVRADIEEICRKARPLVDRIVVDGVASVGGETLKVKEWGIDAIITASQKGLASPPGAALLVVAKDSLNNTAGDGYFFDLKNWVEPMNTYLKGENGYLSTEPVGVVMALSHVFNDIRAEGLENTIKRHRVFSEALNEGLEEIGLKVLADREHWSNTVTAVVAERSDDIVKFALSMGIEFATGVHPKLKGKYFRIGHMGYFNYYDVFSALSVIERSALRAGINIKLGSGLTRAQEILIKNGV

SEQ ID NO: 66979 - protein, 472 aa, Staphylococcus aureus subsp. aureus N315
MENTVKYRKFILPIVVGLLIWALTPFKPDAVDPTAWYMFAIFVATIIACITQPMPIGAVSIIGFTIMVLVGIVDMKTAVAGFGNNSIWLIAMAFFISRGFVKTGLGRRIALHFVKLFGKKTLGLAYSIVGVDLILAPATPSNTARAGGIMFPIIKSLSESFGSKPKDGSARKMGAFLVFTEFQGNLITAAMFLTAMAGNPLAQNLASSTSNVHITWMNWFLAALVPGLVSLIVVPFIIYKIYPPTVKETPNAKSWAENELATMGKIALAEKFMIGIFVIALTLWIVGSFIHIDATLTAFIALALLLLTGVLTWQDILNETGAWNTLVWFSVLVLMADQLNKLGFIPWLSKSIATSLGGLSWPIVLVILILFYFYSHYLFASSTAHISAMYAALLGVAIAAGAPPLFSALMLGFFGNLLASTTHYSSGPAPILFSSGYVTQKRWWTMNLILGFVYFIIWIGLGSLWMKVIGIF

SEQ ID NO: 66980 - protein, 445 aa, Pseudomonas aeruginosa PAO1
MTQSVDAFLERLKRRDPDQPEFHQAVEEVLRSLWPFLEANPHYLEAGIIERIVEPERAILFRVPWVDDQGRVRVNRGYRVQMSSAIGPYKGGLRFHPSVNLGVLKFLAFEQVFKNSLTTLPMGGGKGGSDFDPKGKSDAEVMRFCQSFMSELYRHVGADLDVPAGDIGVGAREIGYLFGQYKRLSNQFTSVLTGKGLSYGGSLIRPEATGFGCVYFAQEMLKDRGRGFDGQRVAISGSGNVAQYAARKVMEMGGKVISLSDSEGTLYAEAGLSDEQWEYLMELKNVRRGRIREMAEQFSLQFLEGRRPWGLACDIALPCATQNELDAEDARRLLANGCVCVAEGANMPSTLEAVDLFLEAGILYAPGKASNAGGVAVSGLEMSQNAMRLRWSEGEVDTKLHGIMQSIHHACLLYGEEQGRVNYVKGANIAGFVKVADAMLAQGVV

SEQ ID NO: 66981 - protein, 474 aa, Bacillus anthracis str. A2012
  misc_feature (470)..(470): Xaa can be any naturally occurring amino acid
MLPRNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKXSETI

SEQ ID NO: 66982 - protein, 195 aa, Thermoplasma volcanium GSS1
MIELYSNAKLPTEFGLFRIYTFVNDENKDHAVIVRGDPRGKENVPLRIHSECLTGDVLGSLRCDCRDQLIQSLRYLGRQEYGMLIYLRQEGRGIGLLNKIKAYSLQDMGADTVEANLKLGLPVDSRNYSFAAEVLRYFEIKSIYIMTNNPEKIKSLIESGINVKGRIPIFSDPTPYDKFYLETKKTKLGHEIENI

SEQ ID NO: 66983 - protein, 487 aa, Porphyra yezoensis
MPTLPPPLFLPLPQLAFRLSTPPTAIMSGLSAKLQPVFDSIKARNPNEPEFLQAAEEILHSLGPVVEAEGGDKFIPVTKALFEPERVIQFRVAWYDDAGELQVNRGFRVQMNSAIGPYKGGLRLHPTVNLSILKFLATEQVLKNAVTTLPLGGGKGGSDFNPKGRSEAEVRRFCQSFMGALARHIGPDTDVPAGDIGVSGREIGYLFGAYKRVTNRFEGILTGKGPTFGGSLIRPESTGYGVVMFVREMLKVKGDTLEGKVVVISGSGNVAQYATQKVNALGGKVIALSDSKGVLVDEEGITDKKLAEVMDIKNVRRTSLKAFTEKFSTAKWTDFSEQYTDEDEKSNPLWEIKCDVALPCATQNELNADGARALVDNGVSIVAEGANMPSTPGAIEVLRSAKVAFAPGKASNAGGVATSGLEMSQNSQRMAWSAEKVEEELDGIMTRIHADCVETAKAYDRAGDYVFGANVTGFLKVAEAMLAQGLA

SEQ ID NO: 66984 - protein, 217 aa, Aeromonas veronii
MNQSLLSEFGDPVARVEAALSALRAGGGVLVADDEDRENEGDLIFAAESMTNEQMALMIRECSGIVCLCLPDERVRQLELPMMVEANSSHYQTAFTVTIEAAQGVTTGVSAADRITTIRAAIADGAKPGDLHRPGHVFPLRARTGGVLTRRGHTEATVDLMQLAGLKPFGVLCELTKEDGSMARLPDLVAFGRKHQMPVLTIDDLVQYRQLLSERTA

SEQ ID NO: 66985 - protein, 395 aa, Phytophthora infestans
MKTLMEPERLIQFRVPWIDDEGSSRVNRGFRVQFSSALGPYMGGLRFHPETTHGTAKFLGFETIFRNALAGPYGGAHGGSDFNPMDKSESEIMRFCQSYMTELVNYIGPHTDVPTAGVGVGPQEIGYMFGQYKRMRQLHPGGTEGILSGGAYHYPQVTGYGVAHFANRILETRGETLKGKRCLISGSGTVALNVARKLLDFGAIPIGMSDNFGYVIEDQGFSSKSLEELKRIKEERNARLGAYIMSSTTANYHPSEEGRLWETPCDYAFPCAIQNDVDADAVRLLVKNGCKGIFEGANFPCTDEAISLIKQHGLAFGPNKASNGGSFALITKNLGSSTQMLDDEVDVIVKEYMDKLHDRVAASAEEFNAGGDLHVGANITAFMSVAAAMFRQGVV

SEQ ID NO: 66986 - protein, 266 aa, Nostoc punctiforme PCC 73102
MGQIITQVDAFTNRPFAGNPAAVCVLPTRQNERWMQNVAQEMNLSETAFLVKQDDGFNLRWFTPTIEVPLCGHATLASAHVLWSEGHLSENEVARFYTKSGVLIAKLQGEWIELDFPVNHSQETVAPRELKQALGVPYKSVFLNSFGYLVELESEDLVRQVQPNFQILKTLPISEIIVTSLTDSDSEYDFVSRLFAPGLGIDEDPVTGATHCCLAPFWRDRLHKDELLAYQASRRGGVVKVRYTGGDRVFIAGQAVTVLRGELFTI

SEQ ID NO: 66987 - protein, 534 aa, Petunia x hybrida
MGQKEDTRSLSDEYEVTDILGRGGFSVVRRGRTRSSEEVAIKTLRRFGPPEKKEFSRSTTHVNSRPAAQALISETLLTNELLVMRKIVEDVSPHPNVIHLYDVCEDSSGVHLILELCCGGELFDRIVGQARYNEAGAAAVVRQIAKGLEALHGASIVHRDLKPENCLFLNKDENSPLKIMDFGLSSIEDFANPVVGLFGSIDYVSPEALSRGNITSKSDIWSLGVILYILLSGYPPFFAPSNRQKQQMILNGEFSFDEKTWKNISSSAKQLISSLLKVDPNMRPTAQEILEHPWVTGDLAKQEQMDAEIVSRLQSFNARRKFRAAAMASVLSSSFSLRTKKLKKLVGSYDLKPEELENLSHNFKKICKNGENATLLEFEEVLKAMEMSSLVPLAPRIFDLFDNNRDGTVDMREIIGGFSSLKYSQGDDALRLCFQMYDTDRSGCISKEEVASMLRALPEDCLPMDITEPGKLDEIFDLMDANSDGKVTFDEFRAAMQRDSSLQDVVLSSLRPTLIPLLFNFPFSILVVLISNLL

SEQ ID NO: 66988 - protein, 518 aa, Zea mays
MAPPRISFLELCLSFLCFVVFYYFHMRSKRKNPFVPLDWPLVGMLPALLGNLHHLHDWITSLLVASQLSFLFTGPPRSGMQFFVTADPANVRHVFTSNFANYPKGPEFEEIFDVLGGGIFNADGESWRRQRAKAQLLMSSAPFRALVSRYSRAKVDTALLPLLSHMAATGEAFDLQDVFLRLTFDTTTTLVFGVDPGCLSVGLPEVPFARAMDDAMGVLLLRHVVPMTWWKLARRLRIGHERKMAEAWRTIDQFVADTIAKRRAEKARHGNGQVSADLLSSYINDDEDEEGGVDAFLRDTTINLMLAGRDTTGSALSWFFYLLTRNPRVVGKIRQELECVKSKSSGSGGGMASFDPDELSRLTYLHAALCESLRLYPPVPQELKEAAAADVLPCGHEVRAGDKILVSLYAMGRMEEVWGSDCREFRPERWIPELEDGRRVVQVRYVPSYKFMSFNSGPRTCLGKDMAFVQLKAAAAALEYPSRGPSLRVPSFLYKVSIILHMKNGFMATVKRRRQTFA

SEQ ID NO: 66989 - protein, 358 aa, Arabidopsis thaliana
MGQKRLLFLLAVFTFLVSSSYGRGVLKLKSDDDRPVYNHTLAVTLVEYASAVYESDLTKLFTWTCERCNGLTKDFEVIEVIFDVEHCLQAYVGVAKDLNAIIIAFRGTQEHSIQNWVSDLFWKQLDLNYPDMPDAMVHHGFYSAYHNTTLRPAVLDAITRVKKVYGANINIIVTGHSMGGAMASFCGLDLVVNEGEENVQVMTFGQPRVGNAAFASYYSLLVPNTFRITHDRDMVPHLPPYYYHFPQKTYHHFPTEVWVKDFSFSNFVLFGLEKVCDNTGEDPTCSRSVRGNSISDHLRYFGVELKCESWRQCSIVMNQDMERYSRKDSRGNLFLSRTVPPKDVVKTSSLSKTGISSL

SEQ ID NO: 66990 - protein, 163 aa, Zea mays
  misc_feature (119)..(119): Xaa can be any naturally occurring amino acid
MAENGSLDQFLAAAVDAAQKAGQVIRKGFYETKHVEHKGQVDLVTETDKGCEELVFNHLKQLFPNHKFIGEETTAANGVTELTDEPTWIVDPLDGTTNFVHGFPFVCVSIGLTIGKVPXVGVVQNPNGWEGPPGPRKRPSLRETQKGGPPRGVFNPFSPKKGG

SEQ ID NO: 66991 - protein, 395 aa, Neptuniibacter caesariensis
MHVSFLIFVVANLRGEVQLARPAILALEDGSIFKGLAIGADGLSSGEVVFNTSMTGYQEILTDPSYCRQIVTLTYPHIGNTGTNSEDEESSRTWVAGLVIRDLPLVASNFRNEKNLDQYLKDNNIVGIADIDTRRLTRLLREKGSLNGCIMAGEIDESKALDEAKAFPGLKGMDLAQVVTTESTYEWNSSTWQLGAGHEDKNPSDQEFHVVAYDYGVKRNILRMLVERGCKITVVPAKTPASEVLALNPDGVFLSNGPGDPEPCDYAIEAIQEICKTDLPVFGICLGHQLLALASGAKTVKMKFGHHGANHPVQDLDGKQVMITSQNHGFAVDEDALPENVRATHKSLFDGSLQGIERTDRAAFSFQGHPEASPGPHDVAPLFDRFIADMRAAKA

SEQ ID NO: 66992 - protein, 502 aa, Aspergillus nidulans FGSC A4
MSEYPQYYSNDLQLPHIEKATLRRTLQVLSSAVCNGVNVIESTAPASNEYDGRGVYTGDLAQQKRVLEDNASSLPDFLSLARARIPTRGPDIPLRIGGLSPLASRSPIAAVVLRILHKCATGRVETISAHDIECLDNAVHLALSHGSTAFYHGHDLGADEILFGRAGLLWALLNIRAAATDLPHAQMEVFQPIISQIPEIVRSIIDAGREGAAKYKRSHGKVDALPLMWPWKPGYYGVGWAHGLCGIIPVLLACNLDELDDCLPEIGGTISALCRICIAHNGHLPTKIPLRSSSRQSLLVQMCHGAPAILGLLGCALKHTELVLEHWEPNWNRAVCLATDRVWEQGLLSKGGGLCHGIAGNAWPLLLLHDVFEDSSAVLDRARLNYTTRKSDLAATEGLLSGDFFLSRAIAMMLYARETPPYNASLETASNNYRMPDNPFSLFEGLSGTVCAWAEASIVVKARLRKLEVGDEDIDQDPMFRRCRQKQLGFPCLGGNGATGVL

SEQ ID NO: 66993 - protein, 89 aa, Actinidia chinensis
TLTRPELNLLLTFITSKNIHLISDEIYSGTVFSSPNFVSIMEVLKDSSHSTEVWNGVHIVYSLSKDLGLPGFRVGAIYSNDDVVVAAAS

SEQ ID NO: 66994 - protein, 88 aa, Actinidia chinensis
TLTRPELNLLLTFITSKNIHLISDEIYSGTVFSSPSFVSIMEVLKDSSHSTEVWNRVHIVYSLSKDLGLPGFRVGAIYSNDDVVAAAT

SEQ ID NO: 66995 - protein, 549 aa, Physcomitrella patens
MGNTSSRGSRKSTRQVNQGVGSQDTREKNDSVNPKTRQGGSVGANNYGGKPSSGAQAGERSTSAPAALPRPKPASRSVSGVLGKPLSDIRQSYILGRELGRGQFGVTYLCTDKMTNEAYACKSIAKRKLTSKEDIEDVKREVQIMHHLSGTPNIVVLKDVFEDKHSVHLVMELCAGGELFDRIIAKGHYSERAAADMCRVIVNVVHRCHSLGVFHRDLKPENFLLASKAEDAPLKATDFGLSTFFKPGDVFQDIVGSAYYVAPEVLKRSYGPEADVWSAGVIVYILLCGVPPFWAETEQGIFDAVLKGHIDFENDPWPKISNGAKDLVRKMLNPNVKIRLTAQQVLNHPWMKEDGDAPDVPLDNAVLTRLKNFSAANKMKKLALKVIAESLSEEEIVGLREMFKSIDTDNSGTVTFEELKEGLLKQGSKLNESDIRKLMEAADVDGNGKIDFNEFISATMHMNKTEKEDHLWAAFMHFDTDNSGYITIDELQEAMEKNGMGDPETIQEIISEVDTDNDGRIDYDEFVAMMRKGNPGAENGGTVNKPRHR

SEQ ID NO: 66996 - protein, 449 aa, Pseudomonas syringae pv. syringae
MNAALNLWKDAHAKRLSQYCAVRVIGRVSAVRRILLECRIPSAKVGDLCEVSKADGSLLLAEIVGFTQECTLLSALGPPDGIQVGAPIRPLGVAHRIGVDDSLLGCVLDGFGRPLMGDCLGAFAGPEDRRTTLPVIADALPPTQRPRITRALPTGIRAIDSAILLGEGQRVGLFAGAGCGKTTLMAELARNMDCDVIVFGLIGERGRELREFLDHELDETLRRRSVLVCATSDRSSMERARAAFTATAIAEAFRARGQKVLLLLDSLTRFARAQREIGIASGEPLGRGGLPPSVYTLLPRLVERAGMSENGSITALYTVLIEQDSMNDPVADEVRSLLDGHIVLSRKLAERGHYPAIDVSASISRILSNVTGRKHQRANNRLRQLLAAYKQVEMLLRLGEYQAGADPVTDCAVQLNEAINAFLRQDLREPVPLQETLDRLLQLTSQLPE

SEQ ID NO: 66997 - protein, 365 aa, Zea mays
  misc_feature (194)..(194): Xaa can be any naturally occurring amino acid
MAGSAVAVVLLSAVALLCLYHLLFLSLSVPDPAAAAAVPRRAGGHHGSNVPSGSGTANVVLRFGLSGQPLRLHDPASAAGLPDIDTFRGKLERLLPPDDHDPGWSRRFDAELGPVHRYFGPDAPLDVRQRIAYLFAILDRSPRGVGVGVGVGELEAWLRWQAAARLDAVTRREMAPHDTDRDGAVTLREFFAVXSADRDGDGSLNAVEFNDFLHPEDSSQESVMLWLLKDKLSEMDHDGDGRLSQEEFVAQSHIIISGARHADDGGHAHDLERAEAAKKFTELDADKDNYLTVEEARCVLQSLVTGEFSYATSHAKFLMKADVNHDGKLSLEEMLDDYISFYSTVYMDDHYASEGEVDSDSRDEL

SEQ ID NO: 66998 - protein, 168 aa, Bdellovibrio bacteriovorus HD100
MISGILEFLRTYKNYDPAAKSLWEIALLYPGPKAVALHRIAHELYGVKLFFLARLVAEISRWLTGIEIHPGATLGKRLVIDHGFGVVIGETAVIGDDCIIFHGVTLGGLKFDPVKRHPTVGNKVLIGTGAKILGPITIGDGALVGANAVVIREVPAGATVVGPVATLK

SEQ ID NO: 66999 - protein, 501 aa, Salmonella enterica subsp. enterica serovar Paratyphi B str.
METVGNFIHGKTTLSSSGETLPVTNPATGKVIRQVTQSTREEMLAAIQSAHEAFPAWSKMTPLRRARILFEFKVLLEKHREELAALIVSEHGKVWSDALGELTRGIEVVEFACGIPHLSKGEYSFNVGSGVDSFSLMQPLGVVAGITPFNFPAMVPMWMFPVALACGNTFVLKPPALVPSASLRMAQLLQEAGLPDGVFNVVHCGNEAASLLTSDPRVQAVSFVGSSAVAEHIYTTASAHGKRVQAFGAAKNHAIVMPDADLDATVNAIMGGAFGSAGERCMALPVVVAVGDETADRLIERLKPLIAALRIGPGELRGKDENEMGPVVSRAHQQKVLGYIDKGVSEGATLVMDGRNYSVAGYPEGFYVGGTLFDNVTPEMTIWREEIFGPVLGIVRVPDYATAISTVNSHEFGNGSVIFTTNGHYAREFAQSVEAGMVGINIPVPVPMAFHSFGGWKRSVFGALNVHGPDGVRFYTRMKTVTSRWPNGQQIVSEFSMPTLG

SEQ ID NO: 67000 - protein, 170 aa, Platanus x acerifolia
FDVVPFTHVLHLAAQAGVRYAMRNPQSYVNSNIAGFVNLLEIAKSANPQPSIVWASSSSVYGLNTQNPFSESHRTDQPASLYAATKKAGEEIAHTYNHIYGLSITGLRFFTVYGPWGRPDMAYFFFTKDILQGKPITIYQTPDEKEVARDFTYIDDVVKGCVGALDTAEK

SEQ ID NO: 67001 - protein, 253 aa, Candida glabrata CBS 138
MSAPEGQQRRGGFGGRNRRGGNRRGGRNTEEKGWVPVTKLGRLVKAGKISSIEEIFLHSLPVKEFQIIDTLLPNLQDEVMNIKPVQKQTRAGQRTRFKAVVVVGDSNGHVGLGIKTAKEVAGAIRAGIIIAKLSVIPIRRGYWGTNLGQPHSLATKTTGKCGSVTVRLIPAPRGSGIVASPAVKKLMQLAGVEDVYTQSNGKTRTLENTLKAAFVAIGNTYAFLTPDLWTEHPLPLSPLDVYSDEASAQKKKY

SEQ ID NO: 67002 - protein, 326 aa, Triticum aestivum
  misc_feature (80)..(80): Xaa can be any naturally occurring amino acid
MARSALDEVTDTGAFDRTPSTFRSFVSRDASARFPAVAGRYHLYVSYACPWASRCLAYLKLKGLDHAISFSSVKPIFERXTRESDDHLGWVFPASAGEVPGADPDPFNGAKSVRDLYEIASTNYTGKPTVPVLWDKQLKTVVNNESSEIIRMLNSEFNGIAENPGLDLNPAHLQASIDEVNGLVYDAINNGVYKCGFAKKQGPYDEAVTTLYEALDKCEEILGKQRYMCGNQLTEADVRLFVTLIRFDEVYAVHFKCNKKLLREYPNLFNYTKDMYQIPGISSTVNMEHIRKHYYGSHPSINPYGIIPQGPNVDYNAPHDRERLFL

SEQ ID NO: 67003 - protein, 609 aa, Streptococcus agalactiae 2603V/R
MEFSRETRRLALQRMQDRTLDLLIIGGGITGAGVALQAAASGLDTGLIEMQDFAEGTSSRSTKLVHGGLRYLKQFDVEVVSDTVSERAVVQQIAPHIPKPDPMLLPVYDEPGSTFSMFRLKVAMDLYDLLAGVTNTPAANKVLSAEDVLKREPDLQKEGLLGGGVYLDFRNNDARLVIENIKRANRDGAYIASHVKAEDFLFDDNNQIIGVRARDLLTDQVIDIKARLVINTTGPWSDTVRNFSNEGKQIHQLRPTKGVHLVVDRQKLNISQPVYVDTGLNDGRMIFVLPREDKTYFGTTDTDYHGDLEHPTVTKEDVDYLLNIVNKRFPEAELTIDDIESSWAGLRPLLSGNSASDYNGGNSGKLSDESFEELIDSVKDYIAHKNHREDVEKAISHVESSTSEKELDPSAVSRGSSFERDDNGLLTLAGGKITDYRKMAEGAMETIINILDKEYNRKFKLINSKTYPVSGGEINPSNVDSEIEAYAQLGTLSGLSIEDARYIANLYGSNAPKLFALTRQITEAEGLSLVETLSLHYAMDYEMALSPTDFFLRRTNHMLFMRDNLDSLIQPVIDEMAKHYQWSDQDKTFYEEELHETLKDNDLAALKDN

SEQ ID NO: 67004 - protein, 316 aa, Triticum aestivum
NKFVQKSRLVPVRNSRDIVDPRVRAMASSTTASVAAASLRALAGASPAPLPKPFLVLLSPAPPRRLGLGLRAARPRGPLAPLASSDSFFETSAAVDVAEPEDEAVAEEEPAVAEEEEDVAAEEEVEEVGEYVEPPEEAKVYVGNLPYDVDSERLAQLFEQAGVVEVSEVIYNRETDQSRGFGFVTMSTIEEAEKAVEMFHRYDVNGRLLTVNKAAPRGARVERPPRDSGSSFRIYVGNLPWQVDDSRLVELFSEHGKVVDARVVYDRDTGRSRGFGFVTMASQPELDDAIAALDGQSLEGRALRVNVAEERPPRRF

SEQ ID NO: 67005 - protein, 327 aa, Desulfovibrio desulfuricans G20
MQPQKVLVCGGAGYIGSHMVRALMRAGHLPVVFDNLSTGHLESIGQAEFVRGDLLDMQALRRVFGEYCFDAVMHFSAKSLVGESVVHPALYYTNNVTGTCNLLEAMRESGVGRLVFSSTAAVYGDPQAPVIAEDHPCLPVNPYGRSKLMVETMLADHAAAYGLRSVSLRYFNAAGADEDGGIGEAHSPETHLLPNVLLAALGRNDGLKIFGDDYTTPDGTCVRDYIHVTDLCSAHLAALEYMTLHAGAAVFNLGNGNGFSVREILDAACRVTGVDIPFTVEGRRAGDPPMLVADAARARTALGWTPVYTDIDRIIETAWRWHSDQRY

SEQ ID NO: 67006 - protein, 116 aa, Glycine max
MASSMISSPAATTDNRAGAAMGASFTGLKPMAGYPTRKTSSDITYIASNGGRVHCLLVWPPGGLKKYVTLSYLPDLDDAQLAKAVEYLITMGRIPCSAFEMERCFQHREHTREPGY

SEQ ID NO: 67007 - protein, 646 aa, Oryza sativa
  misc_feature (200)..(200): Xaa can be any naturally occurring amino acid
  misc_feature (217)..(217): Xaa can be any naturally occurring amino acid
  misc_feature (372)..(372): Xaa can be any naturally occurring amino acid
MEPPFFLLLLLLLLLVVSSSSPSAALLSAKGVNNEVQALIVIKNLLKDPHGVLKSWDQNSVDPCSWAMITCSPDFLVTGLEAPSQHLSGLLSPSIGNLTNLETVLLQNNNITGPIPAEIGRLENLKTLDLSSNSFYGEIPSSVGHLESLQYLRLNNNTLSGPFPSASANLSHLVFLDLSYNNLSGPIPESLARTYNIVGXIPLICDANREQDCYGTXAPMPMSYSLNGSRGGALPPAARDRGHKFAVAFGSTAGCMGLLLLAAGFLFWWRHRRNRQILFDVDEQQIENVNLGNVKRFSFRELQAATEGFSGKNILGKGGFGNVYRGQLPDGTLMAVKRLKDGNAAGGEAQFQTEVEMISLALHRNLLRLYGXFCMTATERLLVYPFMSNGSVASRLKAKPALEWGTRRRIAVGAARGLVYLHEQCDPKIIHRDVKAANVLLDEACEAVVGDFGLAKLLDHRESHVTTAVRGTVGHIAPEYLSTGQSSDRTDVFGFGILLLELVTGQTALEFGKSSNHKGAMLDWVKKMQSEKKVEVLVDKGLGGGYDRVEVEEMVQVALLCTQYLPAHRPRMSDVVRMLEGDGLADRWEKASGHSTAAADSLSHSHRTSDPAPPAADFAAAFGRCFSDLTDDSSLLVQAVELSGPR

SEQ ID NO: 67008 - protein, 385 aa, Desulfovibrio desulfuricans G20
MKETGRTAGIKPFYAMDVLERAQELERQGADVIHLALGEPDFDVPEPVRQALVQAVEGGHTHYTGSMGMLELRQAIAKDYRRRYGVDVSPERIAVTSGTSPAMFMLFGALLQQGDEVIISDPHYACYPSFISFAGGVPVKVRVYEEDGFQYRLDAIKAKLTGRTRAIFINSPSNPTGNQLPADRMRRIASLGIPVISDEIYHGLEYGEKEHTILEFTDNAFVFNGFSKLYAMTGLRLGYVIAPDAWVPVLRKLCQNFFISPNSVSQHAGVAALTQCDADVARMRIIYDERRKFMIRRLREMGFGITVEPTGAFYVLANARFLSADSYALAFEILEQAHVGVTPGIDFGEGAEGYLRFSYASSLEKIHEAMNRLEQFVRSRTGCAC

SEQ ID NO: 67009 - protein, 186 aa, Neptuniibacter caesariensis
MSSSFENRFGGTRRLYGNDAVDRFRESNICVIGIGGVGSWVAEALARTAIGKITLIDLDDICITNTNRQIHAVDGNVGRPKTEAMAERIKLINPECEVIQIEDFITRENIPELITGEFDYVIDAIDSVKEKAALIAHCCYRKIPIITIGGAGGQTDPTKIDICDLAKTNHDPLAAKCVPFCEALSL

SEQ ID NO: 67010 - protein, 274 aa, Porphyra yezoensis
REFLSNKTVATAAGLPTPWSIPASTFAIQGLGNVGYWAAHFIAKNGGRITTVGERDGTVSDPAGVDVEALKLHLTNNGGSVVGFANGGSPSLSVVADPAAVLSADVDVLIPAALEGAITTANAKAVRAKVVAEAANGPVTAGADVVLAAAGVVVLPDLVMNAGGVTVSYFEVAKNLAGLRFGRLTQRAEEAAMANLLATLQSHGVTITDRDRRRLIIGADERAHVYSGLEDSMCAACGETVKVAAELGVSLRIAAYFTAIRRVAETFESRGLWP

SEQ ID NO: 67011 - protein, 199 aa, Zea mays
MAFDCNKERGVSSPDSCSRICTEGTLVQANPLSHYWKPKRLENFNKLENQKSSYESAPSGSDPKQDAEASDEATASLCGFRCFTDLPASLVCEVLARLDAKDLGIVSCVSTLLHALATDHQGWKKLYCERWGLPDLPTTLNGPLLPGVPLDGKFWKTFFVEREFRSKSFMGRFNLDILRGHNEDVRAVSLLVSANLIFT

SEQ ID NO: 67012 - protein, 334 aa, Mycobacterium avium subsp. paratuberculosis K-10
MASYVAGSGEFTRDTDYITTRITADGRDGYPVEPGRYRLVVARACPWANRAIIVRRLLGLESVLSIGFCGPTHDERSWTFDLDPGGVDPVLKIPRLQDAYFKRFPGYPKGITVPAIVDVGTGAVVTNDFAQMTLDLSTEWSAYHRDGAPELYPERLRAEIDEVNKRVYTEINNGVYRCGFAGSQQAYEAAYDRLFTALDWVSDRLADRRYLVGDTITEADVRLFTTLARFDAVYHGHFKCNRSKLSEMPVLWAYARDLFQTPGFGDTVDFVQIKQHYYIVHSDINPTGIVPKGPDLAGWLTPHGREALGGKPFGDGTPPGPPVEAERVPAGHGA

SEQ ID NO: 67013 - protein, 316 aa, Triticum aestivum
  misc_feature (149)..(149): Xaa can be any naturally occurring amino acid
  misc_feature (163)..(163): Xaa can be any naturally occurring amino acid
  misc_feature (199)..(199): Xaa can be any naturally occurring amino acid
  misc_feature (216)..(216): Xaa can be any naturally occurring amino acid
PTRSGSATTWTTDSSLISGGDDARTGAGAPAEEEPHVERLPADILAHVLSLLPSFHDLSMAGAVSRRWRRAVGRSLATRRRLSLAGQRTGDESTGGLVRAAVNLRDLDISRSCWGCHITDQGLLDISSAACVGNLTSVSLWGLAGITDXGVVHLVSKARSLQXHLNIGGTFITDESLYAVADSCTNLKSIILWSCRHVXTEAGLVALVNKCPELEXCINVGGMRVSPESFAGPAVHQPPPWRIRSIPQILNADVAGRLKEKRYHSLYTGTHGPNGNSYGKKTVRITRFIPALIQAARDVSTRLVHMFDWHLLLGNK

SEQ ID NO: 67014 - protein, 1257 aa, Corynebacterium glutamicum
MLQLGLRHNQPTTNVTVDKTKLNKPSRSKEKRRVPAVSSASTFGQNAWLVDEMFQQFQKDPKSVDKEWRELFEAQGGPNTTPATTEAQPSAPKESAKPAPKAAPAAKAAPRVETKPADKTAPKAKESSVPQQPKLPEPGQTPIRGIFKSIAKNMDISLEIPTATSVRDMPARLMFENRAMVNDQLKRTRGGKISFTHIIGYAMVKAVMAHPDMNNSYDVIDGKPTLIVPEHINLGLAIDLPQKDGSRALVVAAIKETEKMNFSEFLAAYEDIVARSRKGKLTMDDYQGVTVSLTNPGGIGTRHSVPRLTKGQGTIIGVGSMDYPAEFQGASEDRLAELGVGKLVTITSTYDHRVIQGAVSGEFLRTMSRLLTDDSFWDEIFDAMNVPYTPMRWAQDVPNTGVDKNTRVMQLIEAYRSRGHLIADTNPLSWVQPGMPVPDHRDLDIETHNLTIWDLDRTFNVGGFGGKETMTLREVLSRLRAAYTLKVGSEYTHILDRDERTWLQDRLEAGMPKPTQAEQKYILQKLNAAEAFENFLQTKYVGQKRFSLEGAEALIPLMDSAIDTAAGQGLDEVVIGMPHRGRLNVLFNIVGKPLASIFNEFEGQMEQGQIGGSGDVKYHLGSEGQHLQMFGDGEIKVSLTANPSHLEAVNPVMEGIVRAKQDYLDKGVDGKTVVPLLLHGDAAFAGLGIVPETINLAKLRGYDVGGTIHIVVNNQIGFTTTPDSSRSMHYATDYAKAFGCPVFHVNGDDPEAVVWVGQLATEYRRRFGKDVFIDLVCYRLRGHNEADDPSMTQPKMYELITGRETVRAQYTEDLLGRGDLSNEDAEAVVRDFHDQMESVFNEVKEGGKKQAEAQTGITGSQKLPHGLETNISREELLELGQAFANTPEGFNYHPRVAPVAKKRVSSVTEGGIDWAWGELLAFGSLANSGRLVRLAGEDSRRGTFTQRHAVAIDPATAEEFNPLHELAQSKGNNGKFLVYNSALTEYAGMGFEYGYSVGNEDSIVAWEAQFGDFANGAQTIIDEYVSSGEAKWGQTSKLILLLPHGYEGQGPDHSSARIERFLQLCAEGSMTVAQPSTPANHFHLLRRHALSDLKRPLVIFTPKSMLRNKAAASAPEDFTEVTKFQSVINDPNVADAAKVKKVMLVSGKLYYELAKRKEKDGRDDIAIVRIEMLHPIPFNRISEALAGYPNAEEVLFVQDEPANQGPWPFYQEHLPELIPNMPKMRRVSRRAQSSTATGVAKVHQLEEKQLIDEAFEA

SEQ ID NO: 67015 - protein, 197 aa, Glycine max
  misc_feature (16)..(16): Xaa can be any naturally occurring amino acid
  misc_feature (62)..(62): Xaa can be any naturally occurring amino acid
  misc_feature (86)..(86): Xaa can be any naturally occurring amino acid
  misc_feature (149)..(149): Xaa can be any naturally occurring amino acid
  misc_feature (158)..(158): Xaa can be any naturally occurring amino acid
DFWSAGGPGYNDMIMXRVLAHKDILDLAKYANVPVMSVLTDYNHDCQIMAGALTMGEHIGRXERTFVVYAGDGKNIGHSCLLWGSXCRKTLSSVSCKGLEPDAKTVERVGKAGIMENEVTNDPKEGFKGAVVWCRRGGSRMGQKEEAVXCSHVFKGLXVKRDVMDLVGYRGWLWIVYPGGRVGWGWWCVWGWVGVGC

SEQ ID NO: 67016 - protein, 258 aa, Ralstonia mannitolilytica
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARVVVQGFGNVGSVAAKLFHDAGAKVIAVQDHKGIVFNGSGLDVDALIKHVDHNGSVAGFAAETVSADDFWALDCEFLIPAALEGQITAKNAPHIKAKIVVEGANGPTTPEADDILRERNILVCPDVIANAGGVTVSY

SEQ ID NO: 67017 - protein, 476 aa, Bacillus anthracis str. Ames
MIEKNVVELHVDNNDTPKVKSSWVLPVALILIVEIVLLLPSSLTMEAKWSLFGFCSAIILWTTTTINSAYIALGSVLFLIISGTAKQDLLFDSLASDVIWLMIGSFILGRALQITGLAEKMTYFVVNRARNISGLCWILTMIIQILAFFIPSTSGRAAVVLPVFQAICKEIGSRRIAKALAILMPTVILVSTSSTIIGAGSHLIALDMLNEFNNKNITFVEWLIWGLPFGIIMSFISCRVILVLFLDKEEVKTKLQQKKVKFELSRNEKYTISILIAMVAFWLTEWLHGLEIATVTIIGVFLLTLPKLGVMQWKESLKGVSWNLILFVGAAIALGKSLMESGAAQWIMQNLFLVTELINKQSIFIVLLVIVILSVTSHLYITSHTTRAVIFIPPLLYFASSLQLNEVAVLFLGIVGMNYCLTFPVSSKALLLFQESDRETFQPQDLLKLSSYLSVIYIFVMVIFYYAYWQWVGLSL

SEQ ID NO: 67018 - protein, 643 aa, Salmonella enterica subsp. enterica serovar Paratyphi B str.
MNKAVSSEQKPLDVICLGRVAVDLYGQQIGSRLEDMTTFAKYLGGSSGNVAYGTAIQGLRSAMLARVGDEHMGRFVREELNRVGVDTQCLLSDRDRLTALVILGIKDQDTFPLIFYRDNCADMALTPEDIREDYIASSRALAVTGTHLSHPNTRAAVLKALEYAQKHGLRRALDIDYRPVLWGLTSLGDGETRFIASSQVTEQLQQVLRHFDLIVGTEEEFHIAGGSTDTLTALRRVRQLTQAVLVCKRGALGCSVFEGNIADDWSQVKIHSGVRVDVLNVLGAGDAFMSGLLRGYLNDESWEQACRYANACGALVVSRHGCAPAMPTKKELDNYLAREQSITRPDKDPRLNHLHRVTTRKQHWPELCVFAFDHRKQLVDIANEVGASESAIPPLKMLLLEGARQAALEAGLQNNSGILADTTFGQQALNDVTGQGWWIGRPVEMPGSYPLKLEHGDIGSQLVSWPQEHVVKCLVFYHPLDAESVRLEQEALIDEVYRACCQSGHDLLLEVILPRDAADQNEQYYPQIVERFYQLGILPDWWKLPPLSPDRWREISQHIEHYDPECRGILILGLDAPESELKSGFAAAADMPWVKGFAVGRTIFGEPSRQWLGGQLNDEQLIATVKQKYRMLIDYWREYRPAR

SEQ ID NO: 67019 - protein, 401 aa, Rickettsia sibirica 246
MSIISTRLSSIKPSPTLAIVKKTLELKQAGVDIITLGAGEPDFDTPDNIKEAAIKAIKDGFTKYTNVEGMPLLKQAIKDKFKRENNIDYELDEIIVSTGGKQVIYNLFMASLDQGDEVIIPAPYWVSYPDMVALSTGTPVFVNCGIENNFKLSAEALERSITDKTKWLIINSPSNPTGASYNFEELENIAKVLRKYSHVNIMSDDIYEHITFDDFKFYTLAQIAPDLKKRIFTVNGVSKAYSMTGWRIGYGAGSKTLIKAMTIIQSQSTSNPCSISQMAAIEALNGPQDYIKPNALNCQKKRDLALSILKRVKYFECYKPEGAFYLFVKCDKIFGHKTKSGTIIANSNDFAEYLLEEAKVAVVPGIAFGLEGYFRISYATSMEELEKACIRIERTIDVIPA

SEQ ID NO: 67020 - protein, 144 aa, Zea mays
EFASSSCGCQCQAARLRGFRWDRQWVVVNAKGRAYTQRVEPKLALVQVELPPEAFAENWQPTPDYHLVITAPGMDTLKIPIITEHTTIDDVSVWEWSGSAYDEGAEASEWFFTYFGKPSRLVRFKEAFETRPTDPDYAQGYQIM

SEQ ID NO: 67021 - protein, 329 aa, Bacillus cereus E33L
MIDNFWRDLPRPFFVLAPMEDVTDVVFRHVVSEAGRPDVFFTEFTNSDSYCHPEGMKSVRGRLIFTEDEQPMVAHIWGDNPEYFRQMSIGMAELGFKGIDINMGCPVPNVASRGKGSGLILRPDVAAELIQAAKAGGLPVSVKTRLGFKELSEWEDWLTHIFKQDIANLSIHLRTREEMSQVDAHWELIPEIKKLRDRIAPNTLLTINGDIPDRKTGLELAEKYGIDGVMIGRGIFKNPFAFEKEPREHSSKEHLDLLRLQLDLQDQYAEVLPRSITGLHRFFKIYVKGFPGAAELRNQLMSTKSTDEVRALLDKFEASVSETQGSETV

SEQ ID NO: 67022 - protein, 341 aa, Oryza sativa Japonica Group
MDHAAEAQRTDLMTITRHVLNEQGRHPESRGDFTILLSHIVLGCKFVASAVNKAGLAKLIGLAGDTNVQGEEQKKLDVLSNEVFVKALVSSGRTCVLVSEENEEAIIVDAPLRGKYCVCFDPLDGSSNIDCGVSIGTIFGIYMIKDKDNVTLDDVLQPGTDMLAAGYCMYGSSCTLVLSTGNGVNGFTLDPSLGEFILTHPNIKIPNRGKIYSVNEGNAKNWDAPTAKFVEKCKFPQDGSPSKSLRYIGSMVADVHRTLLYGGIFLYPADQKSPNGKLRVLYEVFPMSFLMEQAGGQAFTGKQRALELVPRKIHDRSPIFLGSYDDVEDIKALYASESIIG

SEQ ID NO: 67023 - protein, 309 aa, Thermoplasma volcanium GSS1
MMHAELGPDMVSKILDHMKAAHIGNTPVEEIDANGNIYAKIEWENRFGSIKDRPAFFIMDYLKSKGVLEGKAIVEASSGNTGLAISTISSMLGLQSCIVLPENASQATKKIIVENGSQLILTPPDLGTEGSIEKARSLASSGSFYWINQHSNPLNSDVHYYSTAPELLDQEGMPEAIVAGVGTGGTITGIARYFKERDPSVKVIGVQPSLYSHIPGLRDIKKTSNKGLIDLYGSYIDDFLYVKESDAIAEVFDHYVNTGELIGISSGANLYASKQLSSKFKKIFTVFPDSGRKYLDILKPYDKNNVLNY

SEQ ID NO: 67024 - protein, 407 aa, Thermoplasma volcanium GSS1
MNIVTLISWDFKRNNESFQRAIINGYDYWSRILDDHGVEKYVILLTCNRVELYYRGDPFDVQEKGYNIISDDMAINHLFHVAAGLDSMSIGENEVLKQVKQAYEKSSSMGKSDKFLSLIFQRAISVGKLVRSKTGIGKGKVSIPSIVYDIVRKNGGNKILLVGNGMLASEIAPYFSYPQYKVTVAGRNIDHVRAFAEKYEYEYVLINDIDSLIKNNDVIITATSSKTPIVEERSLMPGKLFIDLGNPPNIERGNNVITLDEIYEISKKNEMLREEKINQAEILIENEMKATMNKIKDLMIDDIFSQFYRFASVVQTMEIQKFRKMHPEVNENDLEALAHSIINKILNVPVTTLKAVSRSQGNSDFNRLFESFSSNFNDIVSAALQSYEGLRDTQSLRDRTRQLLQKS

SEQ ID NO: 67025 - protein, 547 aa, Zea mays
  misc_feature (241)..(241): Xaa can be any naturally occurring amino acid
  misc_feature (243)..(243): Xaa can be any naturally occurring amino acid
MGHSPSSLSKSGPSSPPRRSRSFSPMAPPQQLLLTAPLQVAAGGSGSDSSSSFAPPARDYTQDLPDEILALVFASLSPTDRNACSLICSRWMEVDATTRHRLSLDARAALGNAATALFSRFTAVTKLALRCARDSGSDSLSDHGAAALAAALPSERLARLKLRGLRQLSDAGLASLAAGAPAIRKLSIASCTFGPRAFVAVLQSCPLLEDLSVKRLRSVADTSGAASSIAEEIKFPPALSXAXSFCVKDLYNALCFVPLVASSPNLRSLKILRCSGAWDLPLEVIAARAPGLVELHLEKLQVGDRGLAALSACANLEVLFLVKTPECTDSGIISVAEKCHKLRKLHVDGWRTNRIGDFGLMAVARGCPDLQELVLIGVNPTVLSLRMLGEHCRLLERLALCGCETVGDAEIICLAERWAALKKLCIKGCPVSDRGMEALNGGCPSLVKVKLKRCRGVSYECIENLKVTRGESFSISLDVVLEHDAGSTSENGAQENGQTQITELAGQMTGMDLLTNAAGTQSSIHTINRMRSVMSAIRRRFGNPLPP

SEQ ID NO: 67026 - protein, 310 aa, Bacillus sp. NK13
MPLDPHIQIFLNQYNEMPRPSLEDVTPPQLREMEKMSLTPSKEAVKKVYNKDIELNERTLTIRVYEPEGTGPFPALVYYHGGGWVLGSLDTHDSICRSYANGANCIVVSVDYRLAPEDKFPAAVNDAYEALDWISAHASQLNIDSNKIAVGGDSAGGNLAAVVSILAKERQGPSIVHQLLIYPSLGFKNQHPASMKENAEGYFLSKDLMDWFRLQYLNNKEEEQHPYNAPVLLEDLSSLPSATIITAQYDPLRDSGKDYADALKNHGVPVTYENYETMIHGFLGFHEFVPLAQQAINKSAAQLRQVFDSI

SEQ ID NO: 67027 - protein, 661 aa, Desulfovibrio desulfuricans G20
MHTACHVVCRFSGIAAVITGQKGMSQTGMTIDNVLDSIQHPTDVAKLDADQLRQLADELRERIIGTVSQNGGHLAPSLGVVELTLALLSVFNPDKDKFVWDVGHQAYAWKLLTGRRDEFSTLRQYQGISGFPKMAESPYDHFGVGHSSTSISAAAGMAMARDLAGDDNDVIAIIGDGSMTAGLAFEGLNQAGHQGRRLLVILNDNEMSISKNVGALSLFLSRNLSSRWVRRMKRDVETWLKSVPGIGEEMLNYAKRSEHSLKSFFTPGMLFEAFRFNYVGPVDGHDVRNLAKVMQMARALDEPVLLHVLTKKGKGYEPAESNPTYFHGVGRFELETGAACKFVDSDSLPSYTEVFGSTLCSLAEKDERVIAITAAMPEGTGVGEFSRRFPDRFVDVGICEQHAVTFAAGLAAQGFRPVVAIYSTFLQRSYDQIVHDVCLQKLPVTFCLDRGGLVGEDGPTHHGAFDLSYLRHIPNLTIIAPKDEAELQQAMKTALAGEGPVAIRYPRGIGVGACLSADPGVLEHGRGELLKKGADVAVIAVGSRVHPALAVAEEIERSTGKAVSVFNARFVKPLDAEQLVALARSHDSLLLLEENTTTGGFSSGVLELLADHDCLAGVHVRRLGLPDDFVTHGTQKQLRKLTGIDRAAIRRTLLEMLGLQE

SEQ ID NO: 67028 - protein, 304 aa, Desulfovibrio desulfuricans G20
MSHADEMTPQAMKQRLAAEALEVEAYLGGCLKGRGIPCDLLKAMDYSLLAGGKRLRPVLCLTTAGLFGLARDAVLPFAAAIELIHTYSLVHDDLPAMDDDDLRRGMPSNHKKFGEATAILAGDGLLTEAFCLMASAGAAVEASRVLSALSVVAAAAGAGGMVGGQMLDMEYTGRADVSLDMLRGMHAMKTGALIRCSCLAGALLAGAPHEDAERISHYGEAIGAAFQIVDDILDETGDEATLGKPVGSDSGQGKNTYPSLLGLERSRELAQQQVDAAVACLSGYEGENALFLRALAQYIADRAM

SEQ ID NO: 67029 - protein, 361 aa, Methylococcus capsulatus str. Bath
MRLNWLLVFVPIALGLDWRDAHPTLVFLASALAIVPLAALMGDATESLASYLGPTYGGLLSATLGNAPEIIVGLFALQQGLVEVVKASLTGSIIGNLLLGLGLSLFAGGMKHGEQQFDSKTARRNAASLMLAAIALIIPAVFHFSASSDEEISVHIAAVLFFVYCSSIVLTLRSQKAVFGVAAAAEELEEKGKAEPEPLGGELGWSRNRALAVLAVVTIALGVMSEIMTDAVQPAADAMGLTPLFAGVFLLAIVGNAAETFNSIRFARSNQVELALGVTVGASTQVALVVAPVLVFFSMLIGRDMDLLFSQFEIVAVMLAVVVTRDLVRDGQSTWFDGLLLIGVYCILAIGFFYIPVTPAS

SEQ ID NO: 67030 - protein, 347 aa, Physcomitrella patens subsp. patens
AGCNLYRGQWVYDESYPLYRSRNCPFVDRNFRCKENGRPDTDFTKYRWQPEDCDLPRFNPEDMLERLRDQRIVFVGDSLGRNQWESMLCMLAEGVQNKSRIYEVHGQSISKVVGELIFRFEDYNCTVEYYRDTFLVPQTRPPPDLPENVTSVLKIDHVSWSAGSWPGANVMIFNTGHWWSWEKIGRPGGRFYMEQKLTTHSNEDAFKIGMKTWASWMERNLHPTTTQVFFRSFAPVHFRGGSWNKAGHCHEEVKPFTDEEVQQLQQVPWTNKLIVEAIDQNIKTKRSAVEYVDITTSTNYRSDGHPGLYGNDVKVNGFPPKNRQDCSHFCLPGVPDTWNELLYAALL

SEQ ID NO: 67031 - protein, 388 aa, Neptuniibacter caesariensis
MNLHEYQGKQLFAEYGLPVSKGYAVDTPEAAAEAAEKIGGDKWVVKTQVHAGGRGKAGGVKLVDSPAEAQEFAANWLGKNLVTYQTDANGQPVSKILVEDCTDIANELYLGAVVDRSSRRIVFMASTEGGVEIEKVAEETPEKILKATVDPLTGAQPYQGRELAFKLGLEGDQIKQFVKIFLGLAQMFQEKDLALLEINPLVITEEGNLHCLDAKVAIDGNAVYRHKDLQAMEDPSQEDEREARAAEWDLNYVALDGSIGCMVNGAGLAMGTMDIVSLHGGFPANFLDVGGGATKERVTEAFKIILEDDKVKAVLVNIFGGIVRCDLIAEGIIGAVKEVGVEVPVVVRLEGNNAELGSQLLSESGLDIIAATSLTDAAVQAVKAAEGK

SEQ ID NO: 67032 - protein, 720 aa, Cryptococcus neoformans var. grubii
MGKGKNHDRKANPGFGKVKSKSGTSTGEFTLKRVKGENFYRDAKSASRVKMLNGGKAVRDRDGKIVEAAAFQKGEKEAEPGRVKPDRRWFGNTRVISQSALDHFRTALKEQKADPYSVLLKRNKLPMGLLQDDTKDGGRRPHIVETEPFGNTFGPKAQRKRPRLDIGSIEELGESSAASAAAAAAETATAESQGNGTADLADIYHPTTSTAREPIYAKGTSRRIWGELYKVLDSSDVVIHVLDARDPLGTRCKPVVEYLRKEKAHKHLVYVLNKVDLVPTWVTARWVKHLSLSAPTIAFHASINNSFGKGSLIQLLRQFSVLHSDKKQISVGFIGYPNTGKSSIINTLKKKKVCTVAPIPGETKVWQYITLMRRIYLIDCPGIVPVSAKDSDTDTVLKGVVRVENLATPAEHIPALLERVRPEYLERTYGLEHVEGGWHGEEGATFVLTAIAKKSGKLLKGGEPDQEAAAKMVLNDWIRGKVPFFVAPPTKPESGADAHVSSATTEKVQEQEQKELAEEKETKEMLEEQERSLGKVLGIKRVKGVEQPISKIVTMTKFLGDDARRYVEEEEVDVDDVDKEMAEEDEDEDEDDDDDVEESGEDQEEEELAWDDVFPEEAAGVDAADGEEVEEDDEEEEGDEDDEDVPSAKQLGKRKAIDSDEEEQTAIKAKRMTTNKQKASNFYTHANVKNRNRDRKVPKNPGKRSRGDDEPTGKKAKKRR

SEQ ID NO: 67033 - protein, 330 aa, Klebsiella pneumoniae subsp. pneumoniae MGH 78578
MSQSQPRLKTSAMIASIADEGQATVPAPFGVALSKLAAQRPEIVGMTADLSKYTDLHIFAQAFPDRFFQMGMAEQLLMAAAGGMAKEGFIPFATTYAAFATRRAYDFIHQVIAEEHLNVKICAALPGLTTGYGPSHQATEDLAIMRGIPGMVIVDPCDALEIEQAVPAIADHQGPVYMRLLRGKVPLVLDKYDYQFELGKAKLLEDGNDVLIISSGLMTMRALEAAEKLRADNIGVAVLHVPTIKPLDEKAIIEQASKPGRLVVTAENHTAVGGLGEAVAALLMRKGVRCELDSVGLPDAFLLAGALPTLHDRYGISTAKIVEKIKYRLR

SEQ ID NO: 67034 - protein, 285 aa, Populus tremula x Populus tremuloides
MGKDFEGGGELSAKDYHDPPPAPLIDAEEITQWSFYRAIIAEFVATLLFLYITVLTVIGYKNQTDVHKNGHECGGVGILGIAWAFGGMNFILVYCTAGISGRHINPAVTFGLFLARKVSLVRAILYMVAQCLWAICGCGLVKAFPKSYYTNHGGGTHGLAIRYSKGTGLGAEIIGTFVLVYTVFCATDPKRNARDSHVPVLAPLPIGFAVFMVHLATIPITGTGINPARSFGAAVIYNKEKAWDDHWIFWVGPFIGAAIAALYHQFILRAAAVKSLGSFRSSPNI

SEQ ID NO: 67035 - protein, 480 aa, Neptuniibacter caesariensis
MSDKFDVIVIGAGPGGYVAAIRAAQLGLKTACVEKWVDEKGGAVLGGTCLNVGCIPSKALLESTHQFHNAQHADVHGIQVSGDVTMDVKAMVARKDKIVGNLTMGVAGLFKANGVTLLQGMGKLHGGKKVEVTAADGSSATYEAENVILASGSVPVEIPPAPLTEGLILDNEGALNIDETPKRLGVIGAGVIGLEMGSVWARLGTEVTVLEAMDDFLAAADKDVAKEAAKLFKKQNLDIKLGARCTGTEVIGGKEVKVKYTDANGDQEIVVDKLIVAVGRKPQTQGLLADDSGVNLDERGFIFVNEQCQTGVPGVYAIGDSVRGPMLAHKASEEGIMVADIIAGHHAQMNYDVIPNIIYTHPELAWVGKTEQELKAEGAKIKVGKFPFAANGRAMAANETDGFVKMIACEETDRVLGVHIVSGIASELIGQAAIAMEFCSSAEDLQMTVFAHPTVSEAIHEAALAVDGHAIHMANRKKRK

SEQ ID NO: 67036 - protein, 451 aa, Klebsiella pneumoniae subsp. pneumoniae MGH 78578
MSFDSLGLNPDILRAVAEQGYVEPTPIQQQAIPAVLQGRDLMASAQTGTGKTAGFTLPLLQRLIQNEPHAKGRRPVRALILTPTRELAAQVGENVRDYSKYLNIRSLVVFGGVSINPQMMKLRGGVDILVATPGRLLDLEHQNAVSLDKVEILVLDEADRMLDMGFIHDIRRVLAKLPARRQNLLFSATFSDEIKGLAEKLLHNPLEVEVARRNTASEQITQHVHFVDKNRKRELLSQLIGEGNWQQVLVFTRTKHGANHLAEQLNKDGIRSAAIHGNKSQGARTRALADFKSGGIRVLVATDIAARGLDIEELPHVVNYELPNVPEDYVHRIGRTGRAAATGEALSLVCVDEHKLLRDIERLLKKEIPRIAIAGYEPDPSIKAEPIQNGRQQRGGGRGQGQGRGGQGQGRSGQPRSQNNAPRRQDGEAPKARTQDGKPPRRRRPRKPAGE

SEQ ID NO: 67037 - protein, 431 aa, Oryza sativa Japonica Group
MTTHVGKKNIREASLKLRRSIFFIDQENKASSSRSILQRPSTQLDGPTYLMFFDNSASAIASYIGSLIFSPLHRPAFSSMAHLSNLFLTPGDFIRAVTQAKVWVFAFSLIGLAPLAERVSFLSEHIANTVGPTAGGIMNATCGNVPELIIALFALHKNKMEILKWSLLGSILSNLLLVLGSSLLFGGIVNIGKERPLDKRQADVSIGLLLLGVLCHIATLVSKYTSSTGDSINSSSVMQLSRSCAIVMLIAYFGSLMFQLKTHRQIFELEEDSSDSSSSEDDATDKSVIGFASAMVWLIGMAVVTAMLSSYVVTTIEEASESMGIPVRFISIILLPIVGNAAEHAGAIIFAFKNKIDISLGITLGSATQISMLVVPVILIVSWVNAIPMDLDFNLLETGSLAMAVITTAFTLQVISVDLGNDLEVFVGWCF

SEQ ID NO: 67038 - protein, 403 aa, Neptuniibacter caesariensis
MSIEIKAPTFPESVADGTIATWHKQPGEACSADELIVDIETDKVVLEVVAPEDGVIAEVLKGEGDTVLSDEVIAKFEAGAAGSAAAPAAAEEAAPAGDADKVGPAARKLIEEHGLDASQIPGTGKNGGITKEDVQNFMKNGAPAAAPAAAPAPAAAPAATAAPVNVPAGERVEKRVPMTRLRATIAKRLVEAQQNAAMLTTYNEVNMKPVMELRKQYKDLFEKTHNGTRLGFMSFFVKAATEALKKFPAVNASIDGNDMVYHGYQDIGVAVSTDRGLMVPVLRDTDAMSLADVESTIADFGKRGREGKLGMDDMQGGTFTITNGGVFGSLMSTPILNPPQTAILGMHKIQERPMAVNGQVEILPMMYLALSYDHRMIDGKEAVQFLVTIKDLLEDPARMLLEV

SEQ ID NO: 67039 - protein, 411 aa, Glycine max
MNALAATNRNFRRAAHILGLDTKLENSLLIPFREIKVECTIPKDDGTLVSYVGFRIQHDNARGPMKGGIRYHPEVDPDEVNALAQLMTWKTAVADIPYGGAKGGIGCNPRDLSVSELERLTRVFTQKIHDLIGIQRDVPAPDMGTNSQTMAWILDEYSKFHGHSPAVVTGKPIDLGGSLGREAATGLGVIFATEALFAEYGKSISDMTFVIQGFGNVGTWAAKSIYERGGKVIAVSDISGAIRNPNGIDIPALLKHKEGNGNLKEFSGADIMDPDELLVHECDVLIPCALGGVLNKENAADVKAKFIIEAANHPTDPDADEILSKKGVIILPDIYANAGGVTVSYFEWVQNIQGFMWDEEKVNRELKKYMTKAFRNIKAMCQIHNCDLRMGAFSLGVNRVARATLLRGWEA

SEQ ID NO: 67040 - protein, 326 aa, Nocardia farcinica IFM 10152
MTRAPAEPGRRGFRRVPARRPPLWHGGLYESVADMKTILITGATSGIGSAAAEQLGARGEHLILVGRNPEKLAATEQRVRAAGAGAVDTLRCDVGSQAAIRELAEQVRQRYDRLDVLANNAGGHFPDRALTEDGVETTFAVNYLGPFLLTELLLDLLLDSAPARVVFTSSVLHFGARLDLDDLPFEHGYTGEKAYSRSKLALILYTRELARRLDGTGVTVNAFHPGAVATGIWDTMPWYGKPLAAIAKRIFMISPEQGAEALTYLATDPEVADTTGCYFQRNRPKQPGRRATDDELGARLVEVSARLCGLPTPLKAGDARGGTPPA

SEQ ID NO: 67041 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDGFKAETLSADDFWALECEFLIPAALEGQITGKNAPQIKAKIVVEGANGPTTPEADDILRDRGILVCPDVIANAGGVTVSY

SEQ ID NO: 67042 - protein, 567 aa, Physcomitrella patens
MGNSSGRPRDSRKGSGGGSQGGSSQGSYPRNEGSYPRGSGHGGSTQPRGCNQGGSTQPRGSNQGGSTQPRGGSHGNAGGYRQAPKYTPPVPKPKPVAPGFLGKPLSDILNSYTLGKELGRGEFGVTYTCTHKDTNEVYACKTIAKRKLTHKDDIEDVKREVQIMHHLSGTLNIVTLKAVFEDKHNIHLVMELCAGGELFDRIVAKKCYSERAASDLCRVIVNVVHRCHSLGVFHRDLKPENFLFTSMAEDAPLKATDFGLSTFFKPGERFQDLVGTAYYIAPEVLRKDYGPEADVWSAGVILYILLCGVPPFWAETEKGIFDAIMRGTLDFTSDPWPRISDDAKVLVKGMLNPDVNARLTAQQVLDHPWMKEDGASNAPLDNAVLTRLKNFSAANKMKKLALKVIAQNLSEEEIAGLRQLFKSIDVDNSGTVTLLELKEGLIKQGSKFSESDIAKLMESADLDGNGKIDFNEFISATMHMNKLEKEDHLFAAFHHFDRDNSGYITVFELQQALEEDGVGDYDTIQEIIDEVDTDNDGRIDYDEFVAMMRKGNPGAEEGEKHNHRHRY

SEQ ID NO: 67043 - protein, 300 aa, Chlamydomonas reinhardtii
QYRLERRVGEGTYGVVYRATELASGHTVAVKEMRPDDSEEGVPSSALREIALLLELRHDNVVRLREVTRDLAQLFLVFDFVDMDVHRLMQLYPALGANAQLVKYLTYQLLCGLDYCHRRRVLHRDLKPQNLLVDVRGGANSLKIADFGLSRAFGVPVRLLSPEVVTLWYRPPELLLGGRLYGSPVDLWSAACCVLEVSNRWPLFPGATEIDTLMKIFEKLGSPDEASWPGLADLPHWRPQMPKCPGRSWEEIAPRLEPAGRDLMRRMLTYDPAQRITAAAALRHPYFADIGPLLEHPPQL

SEQ ID NO: 67044 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFHDAGAKVIAVQDHKGIVFNGAGLDVDALIQHVDHNGSVAGFKAETVSADDFWGLECEFLIPAALEGQITGKNAPQIKAKIVVEGANGPTTPEADDILRDRGILVCPDVIANAGGVTVSY

SEQ ID NO: 67045 - protein, 578 aa, Physcomitrella patens
MGNISGRPRKNRGHGTKGMNLGRPTDPRQKNESERPMYEGSTQRSSAVASSYGGGTQHKQDGSTRPATTGSTHAEGGHAARPSSGATPSERPPGPMSAPMPRPRPTSYSANGVLGKPLVDIRQTYSLGRELGRGQFGVTYLCTHKTTGEILACKSIAKRKLTTKEDVEDVKREVQIMHHLSGTPNIVDLKGVYEDRHSVHLVMELCAGGELFDRIIAKGHYSERAAADLCRVIVNVVHRCHTLGVFHRDLKPENFLLSSEAEDAQLKATDFGLSTFFKPGEVFHDIVGSAYYVAPEVLRRNYGPEADVWSAGVIVYILLCGVPPFWAETEQGIFDAVLRGHIDFVSDPWPKISSGAKDLVRKMLNMNVKERLTAYQVLNHPWMEEGGDASDTPLDNAVLTRLKNFSTANKMKKLALKVIAKNLSEEEIVGLRELFKSMDTDNSGMVTFEELKDGLLRQGSKLRESDIRELMEAADVDGNGKIDFNEFISATMHMNKLEMEDHLFAAFSHFDTDGSGYITIDELQEAMEKNGMGDPQTIQEIINEVDTDRDGRIDYDEFVAMMRKGNPITEDGGKHRHR

SEQ ID NO: 67046 - protein, 483 aa, Bacillus cereus E33L
MDKKATFVNVEKKAMYINGEWITLQEQIEVNNPATKEIFATVPKGGVTEAKQAVDAAHEAFKSWSKLTAADRAAKLKKWFTLIDENKEEIAAIMTKEQGKPFAEALGEVNYANSFVEWYAEEGKRVYGEMIPASHPNKRILVMKQPVGVMAAITPWNFPAAMITRKVAPALAAGCTAVVKPASQTPLTALKLAELAHEADIPKGVINIVTGSAKAIADTWMEDGRVRKVSFTGSTEIGKELMASAAQTMKKVSLELGGHAPFIVMNDADLDKAVEAVIGSKFRNAGQTCICTNRVFVQEEVYEAFVEKFQKAVGQLKVGDGFGDGTTVGPLIDENAVSKVQEHIEDAIQKGGTVLYGGQKVAELDGHFMQPTVIGLANDTMLCMNEETFGPVAPVAKFKTVDEVIERANHTPYGLAAYIFTKDISQAFQISEALEYGIIGLNDGLPSVAQAPFGGFKESGIGREGGHFGIEEYLEIKYISLGL

SEQ ID NO: 67047 - protein, 454 aa, Bacillus cereus E33L
MNTKKFAKVNEQIPGPKAASLLERRQNIVPKGVSNGIPTFVQSANGALVTDVDGNQYIDFAGAIGTINVGHCHPAVKEALHKQVDQYIHTGFNVMMYEPYIELAEKLAALAPGSFDKQVLFLNSGAEAVENAVKIARKYTKRPGIIAFSKGFHGRTLMTMTMTSKVKPYKFGFGPFAPEVYKAPFPYEYRRPEGLTEEQYDDFIIEEFKNFFISEVAPETIAAVVMEPVQGEGGFIVPSKKFVQEVRNICSEHGILFVADEIQTGFSRTGKYFAIDHYDVVPDLITVSKSLGAGVPISGVIGRKEIMNESAPGELGGTYAGSPLGCAAALAVLDVIEKENLNDRAIELGKVVMNRFEEMKNKYNCIGDVRGLGAMCAFELVQDRKTKTPDKTLTANLCAEANKRGLLLLSAGTYGNVIRVLMPLVITDEQLEEGLTIIEESLQICYEKANTARV

SEQ ID NO: 67048 - protein, 483 aa, Physcomitrella patens subsp. patens
MGLVVPLQGMLGGRYGLALGCIIPLVSFYLIQLRPRKFLPLDPKPAQVKSLEKNEAVEVQPPISARAMSVISIQETPYYIGGKEMSENGYDSVLNPTGCIEFGTSENKLSLDLLQEWLSKWGDNLLDLNEAGGYVDFSGLKSLKSVLARFMGSVMGGRVELEPSQMVLTAGATPTLEILAFSLAQPGEAFLVPSPYYAGFDRDIKWRSQVELIPVPCSSDTDFKLTPDVLESTFRRMSRKGIKIRGVLISNPSNPVGNVLDRAALTSLLAFTQDKKIHLLVDEIYAACTHEEYAFTSITEILDTPKSHYNRSYVHIIYGLSKDLGIAGFRVGVLYSWHKQVLEAASRMARYCAVSTATQQLCTSLLSDEQFMSMFLFENRRRITKRYRKVVAELNKIGIQSKNSMGGLFCWIDLRHVLASPSKDEEMKLWKHLLYKVGLHLTPGTSCWCEEPGWFRLCFATVDNETLMVAFLRFQKFMQNSVY

SEQ ID NO: 67049 - protein, 146 aa, Arabidopsis thaliana
  misc_feature (15)..(15): Xaa can be any naturally occurring amino acid
  misc_feature (27)..(27): Xaa can be any naturally occurring amino acid
  misc_feature (64)..(64): Xaa can be any naturally occurring amino acid
  misc_feature (102)..(102): Xaa can be any naturally occurring amino acid
  misc_feature (115)..(115): Xaa can be any naturally occurring amino acid
  misc_feature (129)..(129): Xaa can be any naturally occurring amino acid
MAASMLSCAVEVTSXDEAPMVAPFTGXKIFAAYPVPRMTNQDITSIARNGGRVSCMKVWPTHRXKKFETVSYIADLRDVELTKDVDYLVRNKWIPCVEHESXHCSAYCEHGNTQXYYDGLDWTMWKLAXTGCTCSAQVLKEAEECT

SEQ ID NO: 67050 - protein, 547 aa, Physcomitrella patens subsp. patens
MVFTQWVRFAALAIPEDVRNALGVVLLAFVASAIVRVVFSLVKTYLYDPLSIGRIMAKQGIEGPPFHPIFGTTAELNAYVKSVPESLPLDEDHDSMRTVSPHFHMYFPKFGKRFLYWRGPHAKLVSKDPGLAKEVLLSQYEFFQRHPQDIKMLSNFVGMGLDNLTGEKWAIERRTLNPFFYHDPLKGMVEGMVKGAEPVLKSWEEEVARAGGTAEFNLEEDLHTISGNIIAHTAFGTDHEKAKEIYQTQREYVNLLFQNLHSGWYWIPGFTYLPTQTNVTMARLRSTIDSSLHELITERRKAAERGDTASYGNDLLGIMLAAASNSTDETATEFNLASVFNNAKLFFFAGQDTVATVLTFTLLQLARYPEWQDRARQEVLEEVGETEAYDSTTLNRLKIVGMIVNETMRLFPAVISVSKVATKDMQINELFIPKGLTVEIPIVSYNQDPEIWGDDAHKFKPDRFEHGVSKACKHPRAFLPFSMGPKMCIGKEFALMELKLVVAMVLRRFRLSVSPHYKHHPYSSLLTRPKYGMKLIFSSRQASKLEH

SEQ ID NO: 67051 - protein, 402 aa, Arabidopsis thaliana
MSSIGGEASFFDAVAAQIIPKAVTTSTPVRGETVAKLKVAINGFGRIGRNFLRCWHGRKDSPLEVVVLNDSGGVKNASHLLKYDSMLGTFKAEVKIVDNETISVDGKLIKVVSNRDPLKLPWAELGIDIVIEGTGVFVDGPGAGKHIQAGASKVIITAPAKGADIPTYVMGVNEQDYGHDVANIISNASCTTNCLAPFAKVLDEEFGIVKGTMTTTHSYTGDQRLLDASHRDLRRARAAALNIVPTSTGAAKAVSLVLPQLKGKLNGIALRVPTPNVSVVDLVINVEKKGLTAEDVNEAFRKAANGPMKGILDVCDAPLVSVDFRCSDVSTTIDSSLTMVMGDDMVKVVAWYDNEWGYSQRVVDLAHLVASKWPGAEAVGSGDPLEDFCKTNPADEECKVYD

SEQ ID NO: 67052 - protein, 152 aa, Oryza sativa
  misc_feature (58)..(58): Xaa can be any naturally occurring amino acid
  misc_feature (73)..(73): Xaa can be any naturally occurring amino acid
SQVLSAQAAVSYESARAKVADSVNATNMREIVFTRNATDAINLVTYTRGMLNLKQGDXIVVTIAKHDKTVDAXHFASHKTGATLKHDGLTKKGVADIEQLICLVSYKTKIVVVHHVSNVLGSMLPIEDIGTWSNRIGAKVLVHACQSVSHMP

SEQ ID NO: 67053 - protein, 562 aa, Physcomitrella patens subsp. patens
MAGAMPGQLNLDETPTWGSRSVDVYEKIEQIGEGTYGQVYMAKDKVTGEVVALKKVRMDNEKEGFPITAIREIKILKKLQHANVIKLKEIVTSKGPEKEDNIKPGDASKFKGSIYMVFEYMDHDLTGLADRPGMRFSIPQIKCYMKQLLTGLHYCHVNQVLHRDIKGSNLLIDNNGILKLADFGLARSFSNDQNGQPLTNRVITLWYRPPELLLGSTKYTPAVDMWSVGCIFAELLNGKPILPGRNESEQFQKICELCGSPDETNWPRVSQLPYYNQFKPERLMKRRVKDVFKHFDRHALELLERMLTLDPDHRISAKDALDAEYFWVEPFPCQPSSLPKYEASHEYQTKKKRQQQRQQQEEQAKRMKVLHHPAPHTRLPPIQQQPLRPGPHQPGHNLGPPIHANGMANQHNNYNRGQGGSNQGRAPGGGRPPHGGPNQNGGYGGPNRGGPGGAYGGPAQPGGFAAPNMGHQGGRGGAYGGPAGGVYPAGPYGGGRGPPVGGRGQQFGGMPGGPQPPAYGGQHYMQQPTAQYVDIDGAYARASHSGFQPPSPHRPDYRQQQR

SEQ ID NO: 67054 - protein, 169 aa, Thermoplasma volcanium GSS1
MRIGKNVYIAETAVVIGDVDIADGVSIFDSAVLRADLEKIIIGENTNIQDNVTIHTDVGYPTRIGKYVSIGHNAVVHGCTVEDEVLIGMGAIIMNGAQIGHGSIVGAGAVVTKGFKAPEYSVILGLPAKVMRLNQDQISYVKANAEDYIKLRDLYLSGKFERYRKNSDH

SEQ ID NO: 67055 - protein, 141 aa, Microcystis aeruginosa PCC 7941
NQELRDEITEPLAQIKEFVKKIHSGAIKPPNRSKFTDILCVGIGGSALGPQFVGSALAPDFPALEIAFIDNTDPKGIDRTLAHLPLATTLVIVTSKSGGTPEARNGMLEVRNAYEKQDLDFPQHAVAVTMPGSQLDKHAQD

SEQ ID NO: 67056 - protein, 151 aa, Populus tremula x Populus alba
PNPFFDMTVGGQPVGRIVMELFADVVPRTAENFRALCTGEKGVGRLGKPLHFKGSSFHRVIPNFMCQGGDFTAGNGTGGESIYGAKFADENFVRKHTGPGVLSMANAGPGTNGSQFFICTVKTEWLDGKHVVFGQVVEGMDVVKAIEKVGS

SEQ ID NO: 67057 - protein, 160 aa, Citrullus lanatus
IIAKGHYTERAAASLLRTIVQIVHTCHSMGVIHRDLKPENFLLLSKDEDSPLKATDFGLSVFYKQGEVFKDIVGSAYYIAPEVLKRRYGPEVDIWSVGVMLYILLCGVPPFWAESEHGIFNAILRGHIDFTSDPWPTISPAAKDLVRKMLNSDPKQRLTA

SEQ ID NO: 67058 - protein, 575 aa, Physcomitrella patens
MGNTCVGAAGYFQGFTSAIALGGRSSRSNSERSPTASKIDDSDRKVEVDTPATQQNPPRQNHIPSVDTADQQQFKEVIEAMKKGREIKSVSGQSLTHSVLQRKTENLRDLYILGKKLGQGQFGTTYLCIEKATNKEYACKSIAKRKLISKEDVEDVRRELQIMHHLSGHPNIVMIKGAYEDPASVHLVMELCAGGELFDRIIQRGQYSEAKAAVLTRTIVGVVETCHSLGVMHRDLKPENFLFSSTKEDAALKTTDFGLSVFFKPGEVFRDVVGSPYYVAPEVLRKNYGPEADVWSAGVILYILLSGVPPFWAETEQGIFEQVLKSELDFASDPWPKISDSAKDLIRKMLNPQASKRLKAHQVLCHPWICEDGVAPDRPIDSAVQSRLKHFSAMNKLKKIAIRVIAESLSEEEIAGLKEMFKMMDTDNSGSISYDELKAGLKKVGSILKEEDIRQLMDAADVDGNGTIDYGEFLAATLHLNKIERDENMLAAFSYLDKDNSGYLTIDELQHALAQFNMGDISVDELLHEVDQNNDGQIDYAEFVTMMRKGNPGAAGRSSFRNSQSLSLNDVLMMG

SEQ ID NO: 67059 - protein, 545 aa, Physcomitrella patens
MGNQCVGAIGGPYKQEKAHHHVGHGRDGGVRGVGHGQGQNQQHYRQQNVQERGVETTTTRTAPPVTMPKPRPVNVAAGTVLGKPLSDVRSVYTLGKELGRGQFGVTYACTNIKTGEHLACKSIAKRKLISKEDIEDVRREVQIMHHLSGTPNVVELKGVFEDKHHVHIVMELCAGGELFDRIIAKGHYSERAAAALCRTIVSVVHRCHSLNVFHRDLKPENFLLANKAENSSLKATDFGLSVFFKPGEVFHEIVGSAYYVAPEVLRRNYGPEADVWSAGVIVYILLCGVPPFWAESEQGIFDAVLKGYIDFKSDPWPKVSAAAKDLVSKMLKQDPKERLTAQEVLKHPWMKEDGDAPDEPLDNAVLTRLKNFSSANKMKKLALQVIAQSLSEDEIMGLKEMFKAMDTDNSGTITFDELKEGLHRQGSKLVESDVKKLMEAADVDGNGKIDFSEFISATMHMNKVEKEDHLAEAFQHFDTDGSGYITVEELQEAMAKNGMGDPETINEIIREVDTDNDGRIDYDEFVAMMRKGNEVPQMTTRRHRR

SEQ ID NO: 67060 - protein, 398 aa, Chlamydomonas reinhardtii
MLDTRDFFAEAVHAEANRYTIKEVIGKGSYGVVCSAVDNFTGEKVAIKKITNVFEHVSDATRIVREIKLLRLLKHPDIVDIKHIMLPPSPKDFKDIYVVFELLETDLHQVSAGQSLVWPCRQRIRRCKGLCVCMHTLKHVFHRDLKPKNILANSDCKLKICDFGLARPAFNDMPTTVFWTDYVATRWYRAPELCGSFFAKYSPAIDIWSVGCIFAEVLLGKPLFPGRNVVHQLELITDLLGTPSPEVIAKVRNEKARRFLLNMRPKPGIPFEQHFPRADRGALRLLRRLLAFDPAERPTAEEALADPYFAGLHCVAREPVAQPISKLAFEFDRRKLTLEDVRELIYREILEYHPQMLKDYLAGAARANFHYPSALESFKRQFAHLEAGGARGAARCRA

SEQ ID NO: 67061 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDIKGARIVVQGFGNVGSVAAKLFHDAGAKVIAVQDHKGIVFNGAGLDVDALIQHVEHNGSVAGFKAETVSADDFWGLECEFLIPAALEGQITGKNAPQIKAKIVVEGANGPTTPEADDILRDRGILVCPDVIANAGGVTVSY

SEQ ID NO: 67062 - protein, 560 aa, Zea mays
MGISRDSMHKRRATGGKQKAWRKKRKYELGRQPANTKLSSNKTVRRVRVRGGNVKWRALRLDTGNYSWGSEAITRKTRILDVVYNASNNELVRTQTLVKSAIVQVDAAPFKQWYLTHYGVDIGRKKKTPAAKKDNAEGQEVEAAAEETKKSNHVTRKLEKRKEGRTLDPHIEEQFGSGRLLACISSRPGQCGRADGYILEGKELEFYMKKLQRIVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAEISTVDVLTPKVFIGLIVGAMLPYWFSAMTMKSVGSAALKMVEEVRRQFNTIPGLMEGITKPDYATCVKISTDASIKEMIPPGALVMLTPLIVGIFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGILFKWL

SEQ ID NO: 67063 - protein, 423 aa, Geobacillus kaustophilus HTA426
MEQQLKRKQGAVYVEDILIAYHTLKDVVFHTPLQKNPLLSERYECNVYLKREDLQVVRSFKLRGAYNRMKHLTDEERRNGVVCASAGNHAQGVAYSCRALGVHGKIYMPATTPRQKVSQVQLFGKDMVEIVLVGDTFDDSYNEAVKCAEAEGRTFIHPFDDEYVIAGQGTIGVEVLNDCDEPIDFLFASIGGGGLMAGLGTYVKSISPSTKVIGVEPAGAPSMKAALERGHVVTLDEIDKFVDGAAVKTVGEKTFALCRGVLDDIVVVPEGKVCTTILELYNENAIVAEPAGALPIAALDFYKEQIRGKTVVCVISGGNNDIDRMQEIKERSMIYEGLQHYFIVNFPQRAGALREFLDEVLGPTDDITRFEYTKKNNKESGPALVGIELKRREDYAPLIERMKKKGFPFQEVNKDPNLFHLLI

SEQ ID NO: 67064 - protein, 658 aa, Physcomitrella patens subsp. patens
MVSVAGQDLEADRRALRIFSDYHDPKGTKFNWVDTTSPCNWAGITCAENRVTEFRLPGKGLRGIIPPGSLSLLSNLEIVSLRGNKLSDLFPGAELGKCKNLKALYLAGNGFYGPLPDVAELWPQLTQLSLEFNRLNGTIPESIGKLSQLYLLNLRNNSFSGSIPVLNLANLTIFDVGNNNLSGAVPALLSRFPVDSFVGNAGLCGPPLPSLCPFSSGQSATSSNGKKRLSTVVIVGIVLGSVTFLILALVALFCIFLRNSGQESSSEPELREISHAITPDISRDKLREKGPGDNGDEHAVSGAGEQGANRLISFSLVSFDLDDLLRASAEVLGKGTVGTAYKAILEDGTVMAVKRLKDVTTCKKDFETLIQVVGKLQHRNLVPLRAYYFSKDEKLLVSDYMPMGNLAALLHNNRGKNRTPVDWLTRVRIAIGAGKGLAYLHSQGGPSFVHGNIKSSNILLNRDLEACIADFGLAQLLSSSSSGSKMVGYRAPEVSATRKVTQKSDVYSFGVLLLELLTGKAPTPASSNDEPVDLPRWVQSIVREEWTAEVFDLELMRYQNIEGELVTMLQIAMKCVDPVPERRPKMHTVVSQLEEVHPFFIEDTAEPSRQSATISEEIIRNSDDDSRSSPRTPPTPPTPGTPTPPTPGTPTPPTSRTP

SEQ ID NO: 67065 - protein, 590 aa, Robiginitalea biformata HTCC2501
MQILEQINDPADLRALPEDRLPQLAAELREFIIDVVSVKEGHLGASLGVVELTLALHYVFNTPEDRLIWDVGHQAYGHKILTGRRESFHTNRQQGGISGFPKRDESPYDAFGTGHASTSLSALLGMALAARLQGKIARKHVAVIGDASIAGGMAFEALNHMGVADTDVLVVLNDNAIGIDPSVGALKEYLTRVKAGGAAGDNLFENLNLHYTGPVDGHDLPGLVATLRKLASRPGPKLLHVVTTKGKGLRQAEENQVVYHAPGRFDKYTGDLIRRENDPGRGPKYQDVFGHTLVELARENPRIVGITPAMPSGSSLKYLMEEFPERAFDVGIAEQHAVTLAAGMAADGAVPYCAIYSTFLQRAYDQVIHDVAIQQLPVVFCLDRAGLVGQDGATHHGIFDIAYLRCIPGLVVMSPMDNRELRDMLYTVQLEPRGPVAIRYPRGYSRQASWKHPFRRIPVGKARKLQQGIAVAVLTLGPLGQTIREVLGETENPEAFGHYDFRFAKPLDREALREIALAYGQVVTLEDGCREGGFGSAVLEALAEMGYSGKVHRLGIPDAFPGHATTQELYEELGLDKASLLRTLNNLTHE

SEQ ID NO: 67066 - protein, 662 aa, Physcomitrella patens subsp. patens
MVVLFFVCSAGQDLAADTRALITFRNVFDPRGTKLNWINTTSTCSWNGIICSRDRVTQVRLPGEGLTGIIPSSSLSLLSELRVVSLRNNQLTGPFPGELGNCNHVHALYLGRNDFYGPVPNLTGFWPRLTHLSLEYNRFNGTIPDAIGLFTRLHLLNLRNNSFSGRIPDFNQVNLTLFDVSNNNLSGPVPASIFRFGSDPLLGNPGLCGFPLATVCPLAIVPSPIPTTEPEAGTTVKQKLLSSTALTAIIVGGIVLLILLIIGLFLCFWKRIKNWRSSSEPAGPRKAREKARDKGVEEPGAEFSSSVVGDLERNKLVFFEGKRFSFDLEDLLRASAEVLGKGSAGTAYKAVLEEGTILAVKRLKDVSISRKDFEAQIEVVGKLQHRNLVPLRAYYFSKDEKLLVYDYMSMGSLSALLHGNRGSSRTPLDWVTRVRIALGAARGLAYLHAQGGSRFVHGNIKSSNILLNRDLEACISDFGLAQLLSSTSASSRIIGYRAPEISETRKVTQQSDVYSFGVLLLELLTGKAPAQVSMNEEGIDLPGWVQSVVREEWTAEVFDLELMRYQNIEEEMVGMLQIAMQCVDAVPDRRPKMADVHLLLEDVHPFSSDTGDEASRQSESVSEEKSKGSEKDQDSVENTPSFHQTPSAPSSDSHNPSERPDV

SEQ ID NO: 67067 - protein, 175 aa, Oryza sativa Indica Group
MGPTVMASSATSVAPFQGLKSTAGLPVSRRSTNSGFGNVSNGGRIKCMQVWPIEGIKKFETLSYLPPLTVEDLLKQIEYLLRSKWVPCLEFSKVGFVYRENHRSPGYYDGRYWTMWKLPMFGCTDATQVLKELEDAKKAYPDAFVRIIGFDNVRQVQLISLIANKPPGRAEFGGN

SEQ ID NO: 67068 - protein, 117 aa, Trichosporon mucoides
KINPVQKQTSAGQRTRFKAFVAVGDFDGHVGLGVKCAKEVATAIRGAIVLAKLNVVPVRRGYWGTHIAEPHTVPMKVSGKSGSVMCRLIPAPRGTGIVAAPASKRMLQMAGIQDCYT

SEQ ID NO: 67069 - protein, 784 aa, Geobacter metallireducens GS-15
MAEEQLETTGLRTLEDISTLILKSHDLPDTLDNIVHLVAKRIGTDVCSIYLLEDDGKTLRLAASKGLSKSSVGKITMQTSEGLAGLVIETKGLVTADNAPLHPRYKYFPETREERFNSFLGIPLMLRESPMGVIVIQTRESRTFQQEEVSTLTTIAYQISSIVINAKLLDSIRLKEAERERLERELEKFKAIGAPAGAEPSGDKRKREKRSLLLMGTPVSAGFSRGRAVIIDRRDEHDGMGVATVRSRPEERSRFQTALEKAKIETICMEKRVAELLSKEDAAIFHTHLMILEDRGFIAKVHDLIEEDYGAVRAVNEVVAHYVSAFSRMEDPYLKERSADMEDIRRRIIAFLDGSGHARLRLREKRILVAHEILPSDMATLDHEKLLGIVTEKGDLNSHAAIMAKSLGIPAVVGVEGILQKLGLRDEVIVDGNSGRIYINPSEKIKGEYERLEIDFGVRRRELEGLRDLPAVTRDGVDVALKANIGLLSDIRVALANGAEGVGLYRTEFPYMTRSAFPTRSELVGLYRKVLEGFAPHPVTIRTLDIGGDKTLPYFPMAAEDNPFMGWRSIRVSLEREDIFRVQLAGILLASLHGKARIMFPMVSSIAEIWQIKKILGEVREELAHEGQTFDPDISFGIMVELPAAVQTAHILVNEVDFFSIGTNDLIQYTMAADRNNPKVRRYYDSCQPAVLHSIKRVVDVALATGKPVSVCGEMAADPVMAILLVGMGIRELSLSAPSIPVVKQAIRSVDLRTAREMADRVLSLVSSGAVRTYLAETQNALGL

SEQ ID NO: 67070 - protein, 530 aa, Plantago major
MNSEHHNSGGLASFSVDAGKSQKPDAASVLDTLPKKPVTRNKYALAISILASMTSVLLGYDTGVMSGATLYIKDDLKISDVQVELLVGTINIYSLVGSAVAGRTSDWVGRRYTTVFASVVFFVGAILMGIATNYVFLMAGRFVAGIGVGYALMIAPVYAAEVAPASCRGFLTSFPEVFINFGVLLGFVSNYAFAKFPLKLGWRMMLGVGAIPAVFLAIGVIYMPESPRWLVLQGRLGDARRVLDKTSDSLEESKLRLADIKEAAGIPEDCNDDFVQVQKHSQGQGVWRELLLHPTKPVLHILICGVGIHFFQQGIGIDSVVLYSPRIYDRAGITDTSDKLLATIAVGISKTFFILITTFYVDRFGRRFLLLVSCAGVALSMFALGTVLTIIDRNPDAKQTGVLVLVVLLTMVIVGFFSMGLGPIAWVYSSEIFPLKLRAQGCGLGVAMNRFMSGVILMSFISLYKEITIGGSFFLFGGITTLGWIFFFTLFPETRGRTLEEMEGLFGTFFKWRTTMKELDAKKRSGTDGA

SEQ ID NO: 67071 - protein, 219 aa, Medicago truncatula
MEGGKKSHEQEQAGPSSAIDKTTEKPTHTFHVASEDEEDEGQVFVPSPLLSLKEQIEKDKEDESLRRWKEKLLGSLESDLDDQLEPEVKFHSIGILSEDFGEIVTPLPVEEHQNSRMLFTLREGSRYQLKLQFSVMHNLVSGLTYSNTVWKGGLQVDQSKGMLGTFAPQKGPYVYALKEDTTPAGALARGVYSAKLKFEDDDKRCHMELKYLFEIKKSG

SEQ ID NO: 67072 - protein, 158 aa, Brassica napus
MVKICCIGAGYVGGPTMAVIALKCPHIEVAVVDISVPRINAWNSDQLPIYEPGLEDIVKQCRGKNLFFSTDVEKHVREADIVFVSVNTPTKTTGLGAGKAADLTYWESAARMIADVSASDKIVVEKSTVPVKTAEAIEKILMHNSKGIKFQILSNPEF

SEQ ID NO: 67073 - protein, 557 aa, Shewanella sp. MR-4
MLSLASSQTEQAEAQSSQVQSSQVQSDKAQSGTSALEKSQLAQSYLQKILLSSVYDVAKVTPLSSLNKLSARLGCQVFLKREDMQPVHSFKLRGAYNRIAQLSQAECQRGVVCASAGNHAQGVAMSAASRGVDAVIVMPETTPDIKVDAVRRLGGNVVLHGQAFDQANGFAMEMAEQEGRVYIAPFDDEAVIAGQGTIAQEMLQQQRDLEVVFVPVGGGGLIAGIAAYYKAVMPQVKIVGVEPEDAACLKAAMEAGEPVTLPQVGLFADGVAVKRIGTEPFRLAKWFVDEVVTVTSDEICAAVKDIFEDTRAIAEPAGALSLAGLKKYVSTNATGESGKGEKVAAILSGANVNFHSLRYVSERCELGEQKEAVLAVKVPERPGSFLRFCELLEKRVMTEFNYRFSSRDMAVVFAGIRLTKGHGELEQIINTLEDNGFEVQDLSGDETAKLHVRYMVGGHPPEPLEERLFSFEFPEHPGALLKFLTTLQSKWNISLFHYRNHGAAFGRVLAGFEVPEGDALPFQQFLTELGFVYQEETQSPAYQLFLNAGKGKKSLPL

SEQ ID NO: 67074 - protein, 233 aa, Medicago truncatula
MGLDDDNVKSDKEEEKSSCVVEGSDNEGAGGGNDSRYMSESSVAATEEEDDDEDRKIELGPQCTLKEQLEKDKDDESLRRWKEQLLGSVDINAVGETLEPEVKILSLAIKAADRPDIVLPIPEDGNPKGLWFTLKEGSKYRLMFTFQVNHNIVSGLKYTNTVWKTGIKVDSSKEMIGTFSPQTETYTHEMPEETTPSGMFARGAYSARSKFVDDDNKCYLEINYTFDIRKDWQ

SEQ ID NO: 67075 - protein, 161 aa, Glycine max
VAIDHLLTGMMDKKIYLEHKVVSTIIEVNCSHCRPKGALLAFKYSVTMGISIERTGYLSLIGLLIRSNMFSKLVEIVEEMTRAGYSLGTYLASLLIIRLGCAKKHTLAMKIFNLLPDNHKCTATFTALISVYFSVRRVTKALEIYKIMCTKGFCPVLGTYD

SEQ ID NO: 67076 - protein, 643 aa, Oceanobacillus iheyensis HTE831
MILMQLNGISKSFGAEEILSNIKVEIKDQDRIAIVGRNGAGKSTLLKIMANELPHDEGEFFKPKDLTYGYLSQHMKLESGKTIWNEMEDVFSHLKQMEKKLREVEIKMADPTAVDETSYQAILKEYDELQIRYQSDGGYTYESDIKSVLTGLSFGDYDYETPINELSGGQKTRLALGKLLLQKPQLLILDEPTNHLDIDTLTWLEGYLVNYPGAIVIVSHDRYFLDKTVSIVYEISRHHSRKYHGTYSKYLEQKALDYEQEMKEYVKQQTDIKRMEEFIQKNIVRASTTKRAQSRRKQLEKMDKMDRPMGDESSASMSFQINRRSGNDVLKISNLGFRYEEQQEPTFRHVNLHANRGERIALVGPNGIGKTTLLKTIVEKEFPFDGDIQLGTNVQVGYYDQEQTELHSNKTVLQELWDEYPLVNEKDIRTILGNFLFSGDDVLKVVSALSGGEKSRLALSKLKMQKANLLILDEPTNHLDIDSKEVLEGALADFPGTIIFVSHDRYFINRIADQVAEMNPQGIKMYLGDYDYYLEKKAEEAELARLQMEKEVQSTTVSDKKRSFKEEKQKQSEERKRKRQIAELEKQIETTEEHIAHLEEQMTLPEVYEDHEKALELTEETNMYKQKLDDLLEHWTSLEELDN

SEQ ID NO: 67077 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDSFKAETLSADDFWALECEFLIPAALEGQITGKNAPHIRAKIVVEGANGPTTPEADDILRDRGILVCPDVIANAGGVTVSY

SEQ ID NO: 67078 - protein, 504 aa, Physcomitrella patens
MGNTCVGAAGYFQGFTSAIALGGRSSRSNSERSPTASKIDDSDRKVEVDTPATQQNPPRQNHIPSVDTADQQQFKEVIEAMKKGREIKSVSGQSLTHSVLQRKTENLRDLYILGKKLGQGQFGTTYLCIEKATNKEYACKSIAKRKLISKEDVEDVRRELQIMHHLSGHPNIVMIKGAYEDPASVHLVMELCAGGELFDRIIQRGQYSEAKAAVLTRTIVGVVETCHSLGVMHRDLKPENFLFSSTKEDAALKTTDFGLSVFFKPGEVFRDVVGSPYYVAPEVLRKNYGPEADVWSAGVILYILLSGVPPFWAETEQGIFEQVLKSELDFASDPWPKISDSAKDLIRKMLNPQASKRLKAHQVLCHPWICEDGVAPDRPIDSAVQSRLKHFSAMNKLKKIAIRVIAESLSEEEIAGLKEMFKMMDTDNSGSISYDELKAGLKKVGSILKEEDIRQLMDAADVDGNGTIDYGEFLAATLHLNKIERDENMLAAFSYLDKDNSGYL

SEQ ID NO: 67079 - protein, 695 aa, Oryza sativa
MAVAGAFRRSTSTALQALTALSVLAALLQVEGQMYGPEEAAQTAQCPPFSWGHLKNVSPPFRRHGDPPDCGYKSHELVCSDTKATIRINNATYYVTRIIHWSLFVVVDTDLLNSHNSSCPLPRRQHQPPHERISMAPTSDGVQVIELAPFTNRWAAFVNCSKEITRNVRYKPVACLSTSHSFVYVLTGSESETVYVESLEPSCGYLGMTPLDDRGASINASLSYADVLKYMRKGFAIGISSSSGTYHFDFRACLAESVSIFRQTMVPSSDIYIKNRLLAILLAYGPFWQCIMAPVKLPRVAYEFAIYGTGPAMSILTWIAVLCRFLLAPLVVLTFLSHKYWKARITIDAVEKFLRMQEMLSPMRYGYTDIIAITSHFRDRLGQGSYGTVYKGVLLPGNIHVAVKMLNGNSNCNGEEFISEVSTIGRIHHVNVVRLVGFCSEEMRRALVYEYMPRGSLDKYIFSSDKSFSRDKLNEIALGIARGINYLHQGCDLQILHFDIKPHNILLDKNFVPKVADFGLARLYPRDKSFVPVSAARGTVGYIAPEMISRSFGVISSKSDVYSFGMLLLEMAGGRRNADPNAENSSQAYYPSRVYRQLTRQETGEITAAADMHELEKKLCIVGLWCIQMRSCDRPMMSEVIEMLEGGVDCLQIPPRPFFCDDDYIPAMESLYLSSELELAAISEEKDEESITELN

SEQ ID NO: 67080 - protein, 511 aa, Nepeta racemosa
ILIALLCTLPFLFFLKKWRRSYSGKTPPPSPPKLPVLGNLHQLGTFPHRSLQSLSRRYGPVMQLHFGSVPVLVASSPEAAREIMKNQDLNFSNRPNLSIPRRLLYDNHDVAFAPYGEYWRQIRSICVLQLLSNKRVQSFRRVREEETSIMVEKIMQLQKTTPTAAVNLTDLLTCLTNDVFCRIALGKKYGGTTTGDGEYHVRSLKKNLAEFYVLLGISPLWEYIPWLEWTRRFDGVDRRIEEVSRTFDEFLGKVIQEHRVRDKREDTTVVGDTVGLDFVDLLLQFQRENERSSSPVDDLTIKAVILDMFLAGTDTTVTALEWALSELIKNPRAMKILQKEVRGVAGSKGEIEESDLEKMPYLKAVMKESLRLHAPVPLLVPRESTRDTKVLGYDVASGTRVLINCWAIGRDSSVWEESETFLPERFLETSIDYRGMHFELIPFGSGRRGCPGATFAAAIDELALATLVHKFDFKLPNGVRVEDLDMSEGSGFTIHKKFPLLVVPTPHACTS

SEQ ID NO: 67081 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGSTATGVVTGKPIALGGSLGRREATGRGVFVVGSEAARNLGIDIKGARIVVQGFGNVGSVAAKLFHDAGAKVIAVQDHKGIVFNGAGLDVDALIQHVDHNGSVAGFKAETLSADDFWALECEFLIPAALEGQITGKNAPNIGAKIVVEGANGPTTPEADDILRERGILVCPDVIANAGGVTVSY

SEQ ID NO: 67082 - protein, 502 aa, Mentha x piperita
MYSIAFMLVLRKMDEIISHTLAFQALVSLILLISITKWLSNSPKNKNSSPPSPRKLPILGNLLQLGSLPHHNLRSMARKHGPIMLLHLGSVRPVSSRRRPRGNHENSRSRLRRPRGSRSAALQLQGRVGGYGEYWRQLKTICVVQLLSNKRVQSFRSVREEETELLMKKIGDSSGNVNLSHMFTQLTNDVVCRSAIGRKYGAGDENGEKFLEILREFLELLGAISIGDFVPSLWWINRINGFDRRVDRIAKEMDEFLEKVIHERLENPAAKAEENFVDILLEIYRNNSAGVSIDRDSIKAIILDVFAAGTDTTAVVLEWAMTELLRHPEIMKKLQSEVRQVVKDKHNITDDDIEKMHYLKAVMKETMRFHTPIPLLVPRVARNDVEVMGYDVPVGTMVMINAWAIGRDPTSWDEPEKFRPERFLNSSVDFKGLDFELIPFGAGRRGCPGTTFPMATLEFTLANLMQKFDWELPHECRELDMSERPGVAIRRVIPLLAIGTKM

SEQ ID NO: 67083 - protein, 485 aa, Ostreococcus tauri
MMMRCASYKEKNERTGKANPVGKTARPSSVLGRETPDVNDLFEFHDELGRGQFGTTFLVTEKATGRKCACKAISKRQLQNAEDIEEVRNEVRILHHLSGDNRVVELVGAYEGNKHVYIVMELLSGGELFDRIVEKGKYSEKDASETLRTIVETVEYCHELSVMHRDLKPENFVLKTKDRDSPVCAIDFGLSTFFRDNQVFVDLVGSPYYVAPEVLRRRYGREADIWSCGVILYILLSGVPPFWAQTEQGIFDAILQGSLDLDSDPWPKISSEAKELISGMLQSDPSKRMTAAQVLKHPWVADPNVAPKTKLDNTVFKRFKNFAGMTKFKKMGLMAMAKTMTSDEVAGLKELFKSFDTDGSGTISIDELRQGLKLKSAGPAMEELRAIMKTIDIDGSGELDYEEFIAATLATSKQQSNDAVRRAFDYFDKDGDGSITVQEFEEAFKKMTDVERANLGDIGSLIKSADTDGDGCIDFNEFIAMMSSK

SEQ ID NO: 67084 - protein, 394 aa, Geobacillus kaustophilus HTA426
MKKAKRMNAFSASIFAELTAYRQKQRHLHDEWIDLSVGSPDLPPAPFVREAIARYANEPNAYGYTLKGIREFHEAVADYYRTAHGVVLDPETEVTYVIGSQDGLVHLPMVFADPGDVILLPDPGYPAYAAGVAMAEAMPYFLPLREENSFLPDLRAIPEDIAKRAAIMFLNFPGNPVPAVATESFYREVVEFAKRYDILVVSDFAYGELYYDGNKPVSFLSVPGAKDVGVEINSLSKSYNMAGCRVGYLCGNAEVIRAFAEFKSNLDYGIFWPLQKAAAEVLRHGAGFCAQSRMMYQARRDVLVDGLADIGWTVDRPQAGMFVWAKIPDGWTSLSFAKALIDQAGVVVTPGHAFGPSGEGYVRIALVQPEEVLRRAVAKLKATGLFASPAADRR

SEQ ID NO: 67085 - protein, 472 aa, Oryza sativa Japonica Group
MEPRVGNKFRLGRKIGSGSFGEIYLGTNIQTNEEVAIKLENVKTKHPQLLYESKIYRILQGGTGIPNVRWFGVEGDYNVLVMDLLGPSLEDLFNFCSRKLSLKTVLMLADQMINRVEFVHSKSFLHRDIKPDNFLMGLGRRANQVYIIDFGLAKKYRDTSTHQHIPYRENKNLTGTARYASVNTHLGIEQSRRDDLESLGYVLMYFLRGSLPWQGLKAGTKKQKYEKISEKKVATSIEALCRGYPTEFASYFHYCRSLRFDDKPDYSYLKRLFRDLFIREGFQFDYVFDWTILKYQQSQIASAPPRAVGHGAGPSGLAPPALQNDRQSGVDEGRTSGWSSMDRRRAPPPIASVGTLAKQKAPVGNDASFSKEPVISASNFLGRSSGSSRRPAVSSSRDVMPIDTSEPSRTRATDASPGAFRRTSGPQKSSPVNSAEPKHSSSARHSSNVKNYESALKGIEGLNFDGDERVQY

SEQ ID NO: 67086 - protein, 377 aa, Zea mays
MTGNGRMFPVTVSCFFPKENTFAVNFGFFISAYCNRITHGVLYARAQETSSAQYILQQYLAASGGQRLLSSIRNSYAMGKVRMVATEFEAGGRVVRNRMAAQRAEPGRFVLWQMAPEMWYMELAVGGSKVHAGCNGKLVWRHTPWLGAHSAKGPVRPLRRALQGLDPLTAASMFAGARCIGERKVNGEDCFILKLSADPETLRARSEGLAEIIRHVLFGYFSHKSGLLVHLEDSHLTRIQSATGGDAVYWETTISSSVEDYRAVDGVVVAHAGRSAVTLFRFGEAAVGLGHTKTRMEEAWTIEEVAFDVPGLSADCFIPPTDVGPGSVSEAAELPRGERSKAAAGLVLPCHRARVAALEKADDGGVAWSGALQLGCK

SEQ ID NO: 67087 - protein, 516 aa, Gentiana triflora
MSPIYTTLTLHLATALFLFFHVQKLVHYLHGKATGHRCRRLPPGPTGWPILGALPLLGNMPHVTFANMAKKYGSVMYLKVGSHGLAIASTPDAAKAFLKTLDLNFSNRPPNAGATHLAYNAQDMVFAHYGPKWKLLRKLSNLHMLGGKALENWADVRKTELGYMLKAMFESSQNNEPVMISEMLTYAMANMLSQVILSRRVFNKKGAKSNEFKDMVVELMTSAGYFNIGDFIPSIGWMDLQGIEGGMKRLHKKFDVLLTRLLDDHKRTSQERKQKPDFLDFVIANGDNSDGERLNTDNIKALLLNLFTAGTDTSSSIIEWALAELLKNRTLLTRAQDEMDRVIGRDRRLLESDIPNLPYLQAICKETFRKHPSTPLNLPRNCIRGHVDVNGYYIPKGTRLNVNIWAIGRDPSVWGDNPNEFDPERFLYGRNAKIDPRGNHFELIPFGAGRRICAGTRMGILLVEYILGTLVHSFDWKLGFSEDELNMDETFGLALQKAVPLAAMVIPRLPLHVYAP

SEQ ID NO: 67088 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDIKGARIVVQGFGNVGSVAAKLFHDAGAKVIAVQDHKGIVFNGAGLDVDALIQHVDHNGSVAGFKAETVSADDFWGLECEFLIPAALEGQITGKNAPQIKAKIVVEGANGPTTPEADDILRDRGILVCPDVIANAGGVTVSY

SEQ ID NO: 67089 - protein, 510 aa, Eustoma grandiflorum
MAVGNGVLLHIARSLMLFFHVQKLVQYLWMNSRRHRLPPGPIGWPVLGALPLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANRDNSEGERLHTVNIKALLLNMFTAGTDTSSSVIEWALAELLKNPIILKRAQEEMDGVIGRDRRFLEADISKLPYLQAICKEAFRKHPSTPLNLPRIASQACEVNGHYIPKGTRLSVNIWAIGRDPSLWENPNEFNPDRFLERKNAKIDPRGNDFELIPFGAGRRICAGTRLGILLVEYILGTLVHSFDWELPSSVIELNMDEPFGLALQKAVPLAAMVTPRLPLHIYCP

SEQ ID NO: 67090 - protein, 132 aa, Rickettsia sibirica 246
MIKPDAIKRNKIGQVNTYLENAGLKIVAQKMKFLTKYEAACFYDEHRARPFFNSLVEYITSGAVVLQVLKGEDAITLNRTVMGATNPAEAEAGTIRKDLGESIEANSIHGSDSENSAKREIEFFFNKSEIIE

SEQ ID NO: 67091 - protein, 523 aa, Campanula medium
MSIDISTLFYELVAAISLYLATYSFIRFLFKPSHHHHLPPGPTGWPIIGALPLLGTMPHVSLADMAVKYGPIMYLKLGSKGTVVASNPKAARAFLKTHDANFSNRPIDGGPTYLAYNAQDMVFAEYGPKWKLLRKLCSLHMLGPKALEDWAHVKVSEVGHMLKEMYEQSSKSVPVPVVVPEMLTYAMANMIGRIILSRRPFVITSKLDSSASASASVSEFQYMVMELMRMAGLFNIGDFIPYIAWMDLQGIQRDMKVIQKKFDVLLNKMIKEHTESAHDRKDNPDFLDILMAATQENTEGIQLNLVNVKALLLDLFTAGTDTSSSVIEWALAEMLNHRQILNRAHEEMDQVIGRNRRLEQSDIPNLPYFQAICKETFRKHPSTPLNLPRISTEACEVDGFHIPKNTRLIVNIWAIGRDPKVWENPLDFTPERFLSEKHAKIDPRGNHFELIPFGAGRRICAGARMGAASVEYILGTLVHSFDWKLPDGVVEVNMEESFGIALQKKVPLSAIVTPRLPPSSYTV

SEQ ID NO: 67092 - protein, 91 aa, Zea mays
MNFNITNPSTVCQKKLEIDDYQNLRAFYDRMISHEVSGDALGEEFKGYVFKIMGGCYKQGFPMKQGILTSGRVRLLLHMGTPCLRGYGKRN

SEQ ID NO: 67093 - protein, 241 aa, Staphylococcus aureus subsp. aureus MRSA252
MADNKANKEQVHRVFQNISKKYDRLNNIISFEQHKVWRKRVMKDMGVRKGMKALDVCCGTGDWTIALSKAVGSTGEVTGIDFSENMLEVGKEKTASMENVKLVHGDAMELPFEDNSFDYVTIGFGLRNVPDYLVALKEMNRVLKPGGMVVCLETSQPTLPVFKQMYALYFKFVMPIFGKLFAKSKEEYEWLQQSTFNFPGKEELKRMFEEADFINVRVRSFTGGVAAMHLGYKEKDNTKGD

SEQ ID NO: 67094 - protein, 377 aa, Shewanella sp. MR-4
MLPAPHFSAFNPPRRILMGPGPSDVYPEVLAAQARPTVGHLDPLFVGMMDELKSLIQYAFQTKNEMTMAVSAPGSAGMETCFVNLVEPGEKVIVCRNGVFGERMRQNVERVGAIAVLVDNEWGTPVDPAAVEAALKANPDAKFLAFVHAETSTGALSDAKILCALAKQYGCLSIVDAVTSLGGVELRVDEWGIDAIYSGSQKCLSCVPGLSPVSFSPNAVEKLKNRKTPVQSWFLDQSLVMAYWTSAGGKRSYHHTAPVNALYALHESLRLLAEEGLENAWKRHQDMHLVLRAGLEKLGLKFVVAEASCLPQLNAIYIPKGVDDAAVRARLLKDYNLEIGAGLGALAGKAWRIGLMGFGARRENVALCLRALEEVLN

SEQ ID NO: 67095 - protein, 268 aa, Physcomitrella patens subsp. patens
MRYAQLVIGPAGSGKSTYCTNVFEHCQSIGRTVHIVNLDPAADHFEYPVSVDIRELISLEDVMEELKLGPNGGLVYCMEYLEDNLDDWLSEQLEDYIEDDYLIFDCPGQIELYSHIPVLRTFVDQLKRWDFNVCAVYMTDSQFVSDVTKYISGCMASLSAMIQLELPHINVLTKVDLLPNKRDIDRFLDPDVRLLFDDLNAHMAPRFRKLNHALAELVDDYSMVNFIPLDIRNEESIQYLLSCVDNCIQYGEDLEPKLKDHEQDDADD

SEQ ID NO: 67096 - protein, 309 aa, Physcomitrella patens subsp. patens
GPREFTFRELAAATKNFSRTELLGRGGFGSVYRGTLRDKSLVAVKCIAKDSQQGESEFLAEVLIIGKIRHRNLVPLRGWCAQREKLLVVYDHMSNGSLDKWIIPSQDGKVKPALQWNTRYSILSGVSAALSYLHEEWQQCILHRDVKPSNILLDDKFNAYLGDFGMARLVDHNKIAHSTIVAGTMGYLAPELPHTHKATTKTDVFSFGVLALEVVCGRRAFDPKLPHDEVYLLDWVWSMHQCDQLRSCVDPRLDDDFDDMQTRVVLHIGLLACHPDPGSRPSMRFIRQVLDGDLSIPQIPGNRPVISYS

SEQ ID NO: 67097 - protein, 851 aa, Aspergillus nidulans FGSC A4
MESESVAPSFCIGQHESKRTIPITSEVVQLAHESNYDMLTTPITTPHFQSRVLSLLSSHLSNIQAVSHSDSGTLMTTENIRPLVMPQLGPADTHLTPNEAMSQLVGVTSSWIDLCSPDPLIADLSRQVFMLEVAYAAFCGIGYLLIPGPKLHHKGMHSDGVMYYARAIQDALSLGPYIQFHIWLDMVDNQDLELDEMGDLAPLAREEFFDTEIEQPKIDLFGTWDAWDAIRRTCKYHSRLFVALSLPKHLPPMAVQSRWHSEPVHLFTIDSNTFIKNQKGYPVLSKAHQALISRFMRLRTAPWILLCDVGPIPGVETDNASSLPGSEYPSLAQAAASIKKHHDPTPHLSYMRNLQSRQPPRTAIERFGTGYQDYLQAPLQPLTVNLESITYEVFEKDPIKYEWYERAIAKALSDWVEQKKPTSNPDGRVVVAVVGAGRGPLVTRALKASAQSGVEIDLWVVEKNPNAFVLLQRHNENLWGGKASLVHSDMRAWKGPRVRKSTTLSTEPVGQSLGIEGQFLYTPDPNQKTADSPSLDAIEFEDSKIDIVVSELLGSFGDNELSPECLDGVNHLLNPVHGISIPASYTAHLTPISAPKLHADVTNQSITNPAAPETPYVVMLHAIDYLSTNQSDASAGNPARSSVATVPYEPTTPFVQTAWSFSHPNRDIPPQPASTSMISNAHNVRRTRLTFPVPNRGVCHGLAGYFETVLYRDVELSTNPVTMDSKSANMISWFPIYFPLKTPLNVPDNGEIVATMYRQTDDRKVWYEWMVEVFALEGGSEPASASAPASERIAPVMSGARTISASADSAHNKDITADSYSRLAQKKARGPRRVRVGMSDLHSSIKDGCLM

SEQ ID NO: 67098 - protein, 254 aa, Desulfovibrio desulfuricans G20
MKKYRGIFLKNEKEIGFMREANRIVATILDVLGENVRPGVKTLYFEELAQDLCRKHNVRPAFQGYGGFPFALCCSVNEEVVHGFPSERVLKEGDIVSFDMGVIYEGFYGDSARTYAVGEVPDETARLLKVTQESLMKGIEKALSGNNLYDISAAVQQHVENAGFQVVRRFVGHGIGRKLHEKPEIPNFVPFGLPGVPLRPGMVLAIEPMVTAGTYEVEVLSDNWTAVTKDRKLSAHFEHSVAITSDGPVILSQA

SEQ ID NO: 67099 - protein, 364 aa, Nicotiana tabacum
MGSTSESQSNSLTHTEDEAFLFAMQLCSASVLPMVLKSAVELDLLELMAKAGPGAAISPSELAAQLSTQNPEAPVMLDRMLRLLASYSVLNCTLRTLPDSSVERLYSLAPVCKYLTKNADGVSVAPLLLMNQDKVLMESWYHLKDAVLDGGIPFNKAYGMTAFEYHGTDPRFNKVFNRGMSDHSTMSMKKILEDYKGFEGLNSIVDVGGGTGATVNMIVSKYPSIKGINFDLPHVIGDAPTYPGVEHVGGDMFASVPKADAIFMKWICHDWSDEHCLKFLKNCYEALPANGKVIIAECILPEAPDTSLATKNTVHVDIVMLAHNPGGKERTEKEFEALAKGAGFTGFARLVALTTLGSWNSTSN

SEQ ID NO: 67100 - protein, 120 aa, Methylococcus capsulatus str. Bath
MALTPMDLVAAAKQRIREIGPGEVRTMLGDTLILDVREPEEYAAGHLPGAINIPRGVVEFRIETHPVFQGKKDAAIVVYCQSGLRSTLATDILQQLGWRGTVSMAGGFKAWIEGGLPVSS

SEQ ID NO: 67101 - protein, 96 aa, Triticum aestivum
  misc_feature (34)..(34): Xaa can be any naturally occurring amino acid
  misc_feature (54)..(54): Xaa can be any naturally occurring amino acid
LTFLSETAEAAMAGAKAAAVATVAAAVPTVSRQXPFSSSMVHSMSHECTCSLLXFQLASVRMLPWAKANLNPTGQTLIISTVAGMAYFIVADKTIL

SEQ ID NO: 67102 - protein, 353 aa, Oceanobacillus iheyensis HTE831
MKNFKIANIPGDGIGKEVVPAAANVLKAIAAIHGGLRFEFTEFPWSCEYYMEHGKMMPEDGLEIIKDYNAIFLGAVGNIELVPDHISLWGLLIKFRREFEQVINYRPAKVLPGVKSKIVNPKDFDLIVVRENSEGEYSEVGGRIFRGEDEIAIQNSIFSRRGTERVMRFAFELAAKRKKHVTSATKSNGIFHSMPFWDEVFKDVSRDYSTIETDSQHIDALAAFFVTNPERFDVIVASNLFGDVLSDLGAAIMGSVGVAPAANINVNGKYPSMFEPVHGSAPDIIGKNIANPIGQIWTAKLMLDHFGEEELGSLLLDVIENTTNKGILTPDIGGKHTTSEVTEEIIEGLKARF

SEQ ID NO: 67103 - protein, 510 aa, Eustoma grandiflorum
MAVGNGVLLHIAASLMLFFHVQKLVQYLWMNSRRHRLPPGPIGWPVLGALRLLGTMPHVALANMAKKYGPVMYLKVGSCGLAVASTPEAAKAFLKTLDMNFSNRPPNAGATHLAYNAQDMVFADYGPRWKLLRKLSNIHILGGKALQGWEEVRKKELGYMLYAMAESGRHGQPVVVSEMLTYAMANMLGQVMLSKRVFGSQGSESNEFKDMVVELMTVAGYFNIGDFIPSIAWMDLQGIQGGMKRLHKKFDALLTRLLEEHTASAHERKGSPDFLDFVVANGDNSEGERLQTVNIKALLLNMFTAGTDTSSSVIEWALAELLKNPIILRRAQEEMDGVIGRDRRFLEADISKLPYLQAICKEAFRKHPSTPLNLPRIASQACEVNGHYIPKGTRLSVNIWAIGRDPSVWENPNEFNPDRFLERKNAKIDPRGNDFELIPFGAGRRICAGTRLGILLVEYILGTLVHSFVWELPSSVIELNMDESFGLALQKAVPLAAMVTPRLPLHIYSP

SEQ ID NO: 67104 - protein, 501 aa, Rickettsia sibirica 246
MNTPKNDNYLSELSKVIWPIERYENKKFLPMAFMMFCILLNYSTLRSIKDGFVVTDIGAEAISFLKTYIVLPSAVIAMVIYVKLCDILKQENVFYVITSFFLGYFALFAFVLYPYPDLVHPDPETIESWSVAYPNFKWFIRIVGKWSFASFYTMAELWGTMMLSLLFWQFANQITKTDEAKRFYSMFGLLANLALPVTSVIIGYCLHEKTQIVAEHLKFVPLFVIMITSSFLVILTYRWMNKNVLTDPRLYDPALVKEKKAKAKMSLIDSFKMIFTSKYVGYIALLLIAYGVSVNLVEGVWKSKVKELYPTKEAYTIYMGKFQFYQGWVAIAFMLIGSNILRKVSWLTAAMITPLMMLITGAAFFAFIFFDSVIAMHLTGILASSPLALAVMIGMIQNVLSKGVKYSLFDATKNMAYIPLDKDLRVKGQAAVEVIGGRFGKSGGAIIQSTFFILFPAFGFVEATPYFASIFFVIVILWMYAVKGLNKEYKVLVNKTENRIC

SEQ ID NO: 67105 - protein, 354 aa, Salmonella enterica subsp. enterica serovar Paratyphi B str.
MCTTFCLTASEKRRRPAVFLSVENQYQAPQLRGFFLPRRQEINMANPLYQKHIISINDLSRDDLNLVLATAAKLKANPQPELLKHKVIASCFFEASTRTRLSFETSMHRLGASVVGFSDSANTSLGKKGETLADTISVISTYVDAIVMRHPQEGAARLATEFSGQVPVLNAGDGSNQHPTQTLLDLFTIQETQGRLDNLHIAMVGDLKYGRTVHSLTQALAKFSGNRFYFIAPDALAMPQYILDMLDEKGMAWSLHGSIEEVMADVDILYMTRVQKERLDPSEYANVKAQFVLRASDLNGARENMKVLHPLPRIDEITTDVDKTPHAWYFQQAGNGIFARQALLALVLNSELSL

SEQ ID NO: 67106 - protein, 811 aa, Oryza sativa Japonica Group
MEQREDHTKSSEPAFIPSKRTHQMRNIWAWGGPSSTTVNGSSDAVLFSSSLPSVLQFGKLPGKEREYNAQPKDDMFPMMKQPGTNARVADPMDDVAQHLIGNLLPDDEELLAGVIEDFDHVKLRTQVEESEEYDVFRNSGGMELDIDPLESITFGTAKASLVNGTGSSTNQYSIQNGAGTVTGEHPYGEHPSRTLFVRNINSNVEDSELRSLFEPFGDIRSMYTATKHRGFVMISYYDIRHARNAKTALQSKPLRRRKLDIHYSIPKENPSDKDMNQGTLVIFNLEPAVSNEELLQIFGAFGEVREIRETPHKRHHRFIEFYDVRAAESALRSLNKSDIAGKRVKLEPSRPGGARRSFIQHFNHEFEQDETKHNSFQIGSPSANSPPSLWSQLGSPTDENKLNALNETAFNGGMSPLGSNHLSGFSSGYPPMKSPVGKSSYWNNRADNIFHGSPTLHNSHSFPEHHGGIISASPLVSSAASSASTASGFTALTGTSFLWGNNNNLRDHGQPSSIQSQALSNSLFPNNQPQRQSNLYQNLRGSFGASEHFSQFNVGSAPSVFPFESNFGYFSDSPDTSYMRQGKFGGTGPTRVSGSLMTNFGAYPRINVASMQNGSVGFEGLLDRGRNQTVGNSGCQEDSRVQYQLDLEKIIAGKDTRTTLMIKNIPNKYTSNMLLEVIDETHEGTYDFFYLPIDFKNKCNVGYAFINMASPGYIVSFFKAFAGRKWEKFNSEKVVSLAYARIQGKAALVNHFQNSSLMNEDKRCRPMLFDPKHTENNNQILLNGIFISMAQQDATQERHDLPENPREDNFS

SEQ ID NO: 67107 - protein, 558 aa, Sorghum bicolor
MATMEVEAAAATVLAAPLLSSSAILKLLLFVVTLSYLARALRRPRKSTTKCSSTTCASPPAGVGNPPLPPGPVPWPVVGNLPEMLLNKPAFRWIHQMMREMGTDIACVKLGGVHVVSITCPEIAREVLRKQDANFISRPLTFASETFSGGYRNAVLSPYGDQWKKMRRVLTSEIICPSRHAWLHDKRTDEADNLTRYVYNLATKAATGDVAVDVRHVARHYCGNVIRRLMFNRRYFGEPQADGGPGPMEVLHMDAVFTSLGLLYAFCVSDYLPWLRGLDLDGHEKIVKEANVAVNRLHDTVIDDRWRQWKSGERQEMEDFLDVLITLKDAQGNPLLTIEEVKAQSQDITFAAVDNPSNAVEWALAEMVNNPEVMAKAMEELDRVVGRERLVQESDIPKLNYVKACIREAFRLHPVAPFNVPHVALADTTIAGYRVPKGSHVILSRTGLGRNPRVWDEPLRFYPDRHLATAASDVALTENDLRFISFSTGRRGCIAASLGTAMSVMLFGRLLQGFTWSKPAGVEAVDLSESKSDTFMATPLVLHAEPRLPAHLYPSISI

SEQ ID NO: 67108 - protein, 542 aa, Sinapis alba
MNTFTSNSSDLTSTTKQTLSFSNMYLLTTLQAFVAITLVMLLKKVLVNDTNKKKLSLPPGPTGWPIIGMVPTMLKSRPVFRWLHSIMKQLNTEIACVRLGSTHVITVTCPKIAREVLKQQDALFASRPMTYAQNVLSNGYKTCVITPFGEQFKKMRKVVMTELVCPARHRWLHQKRAEENDHLTAWVYNMVNNSDSVDFRFVTRHYCGNAIKKLMFGTRTFSQNTAPNGGPTAEDIEHMEAMFEALGFTFSFCISDYLPILTGLDLNGHEKIMRDSSAIMDKYHDPIIDARIKMWREGKKTQIEDFLDIFISIKDEEGNPLLTADEIKPTIKELVMAAPDNPSNAVEWAMAEMVNKPEILRKAMEEIDRVVGKERLVQESDIPKLNYVKAILREAFRLHPVAAFNLPHVALSDATVAGYHIPKGSQVLLSRYGLGRNPKVWADPLSFKPERHLNECSEVTLTENDLRFISFSTGKRGCAAPALGTALTTMLLARLLQGFTWKLPENETRVELMESSHDMFLAKPLVMVGELRLPEHLYPTVK

SEQ ID NO: 67109 - protein, 77 aa, Arabidopsis thaliana
MVDLERTITNTTSKRLADRKIEKFDKNILKRGFVPETTTKKGKDYPVGPILLGFFVFVVIGSSLFQIIRTATSGGMA

SEQ ID NO: 67110 - protein, 515 aa, Rhodococcus sp. RHA1
MTRTTAELLADLEDRLEQSLNAGSPRAIARRKQKGLPGPRERIRMLLDSGSFIEVGQMAKNPGAPDNPYGDGVVTGHGTVDGRPVAVFSHDHTVFGGSVGEMFGRKVASIIEFAGRIGCPCVGINDSGGARVQDAVTSLAWYAEMGRRQIPLSGVCPQVSILLGKCAGGAAYAPINTDLVVAVDEQAYMFVTGPGVIKSVTGEDVTLDELGGARAQAENGNVHHVAPSEEAAFAWVRDYLGFLPSSRHEEAPIVNPGLEPEITDNDLALNEFMPDADNAAYDMHDLLLNIFDDGDFHELAAQTAPNVITGFSRVDGRSVGVVANQPQFLSGALDQVGADKAARFVRICDAYEIPLVFVVDTPGFLPGLEQERNGVLRSGGRFLQAFAAATVPKVTVVVRKSYGGGYAVMGCKQLGADVNFAWPTARIAVMGAEAAISLLYHRELEAAGEEQEAMRQQLVDAYNENVATPYSAAERGYIDAVIEPSATRLEIRRALTLLRDKRSARGEQKHHLIPL

SEQ ID NO: 67111 - protein, 181 aa, Rickettsia sibirica 246
MRIDKNLPNYLTIARIMVIPVIILVFYINNSLARTLGALLFVLASITDFFDGYIARKYNLVTSFGKMFDPIADKLLVGCVIIMLLKKDNVDEIPCLLILAREFLVSGLREFLTLVKVSVPVSRLAKVKTFLQMFALSILILGSKGSGIIYLDIVGEIILWIAAFLTIITGYSYFKAYKKYF

SEQ ID NO: 67112 - protein, 332 aa, Staphylococcus aureus subsp. aureus MRSA252
MTKITVFGMGSFGTALANVLAENGHDVLMWGKNQEAVDELNTCHTNKKYLKYAKLDVNIIATSDMTKAIQYADIYLMALPTKAMREVATQINDKLTSKKTFIHVAKGIENGTFKRVSEMIEDSISPEYNAGIGVLSGPSHAEEVVVKQPTTVAASSKDKNVSKLTQDLFMNDYLRVYTNDDLVGVELGGALKNIIAVASGIVAGIGYGDNAKAALMTRGLAEISRLGEKLGADPMTFLGLGGIGDLIVTCTSTHSRNFTLGYKLGQGESMDQALSEMNMVVEGIYTTKSVYHLAKEKNVDMPITNALYRVLFENISVKECVKDLMERDKKSE

SEQ ID NO: 67113 - protein, 293 aa, Triticum aestivum
  misc_feature (225)..(225): Xaa can be any naturally occurring amino acid
  misc_feature (276)..(276): Xaa can be any naturally occurring amino acid
NICDDEAIKAVSFVGSIQQVCIYIGMHIYSRASASGKRVQCNMGAKNHAIILPDADRDATLNALIAAGFGAAGQRCMALSTAVFVGGSEPWEDELVKRASNLVVNSGTANDADLGPVISTQAKDRICKLVQSGADSGARLVLDGREIVVPQFEDGNFIGPTVLADVKSDMECYQEEIFGPVLLLMKAESLDDAIQIVNRNKYGNGASIFTTSGVSARKFQTDMKXGQVGINVPIPVPLPFFSFTGSKASFAGDLNFYGKAGVQFFTQIKTITQQWXEGVSPQRVSLSMPTSQK

SEQ ID NO: 67114 - protein, 364 aa, Nicotiana tabacum
MGSTSQSQSKSLTHTEDEAFLFAMQLASASVLPMVLKSALELDLLELMAKAGPGAAISPSELAAQLSTQNPEAPVILDRMLRLLATYSVLNCTLRTLSDGSVERLYSLAPVCKFLTKNADGVSVAPLLLMNQDKVLMESWYHLKDAVLDGGIPFNKAYGMTAFEYHGTDPRFNKVFNRGMSDHSTMSMKKILEDYKGFEGLNSIVDVGGGTGATVNMIVSKHPSIKGINFDLPHVIGDAPAYPGVEHVGGDMFASVPKADAIFMKWICHDWSDEHCLKFLKNCYEALPANGKVIIAECILPEAPDTSLATKNTVHVDIVMLAHNPGGKERTEKEFEALAKGAGFTGFARLVALTTLGSWNSTNN

SEQ ID NO: 67115 - protein, 322 aa, Staphylococcus aureus subsp. aureus MRSA252
MKHLLVIHTGGTISMSQDQSNKVVTNDINPISLHQDVINQYAQIDELNPFNVPSPHMTIQHVKQLKDIILEAVTNKYYDGFVITHGTDTLEETAFLLDLILGIEQPVVITGAMRSSNEIGSDGLYNYISAIRVASDEKARHKGVMVVFNDEIHTARNVTKTHTSNTNTFQSPNHGPLGVLTKDRVQFHHMPYRQQALENVNEKLNVPLVKAYMGMPGDIFSFYSREGIDGMVIEALGQGNMPPSALEGIQQLVSLNIPIVLVSRSFNGIVSPTYAYDGGGYQLAQQGFIFSNGLNGPKARLKLLVALSNNLDKAEIKSYFEL

SEQ ID NO: 67116 - protein, 537 aa, Oryza sativa Japonica Group
MMASTTSATAAGGAFAAAKTRAGSSAAGGGACARVAAGGRRRSGVVVRCDAGVEAQAQAQAVAKAASVAALEQFKISADRYMKERSSIAVIGLSVHTAPVEMREKLAVAEELWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRSGQNSGGLGKNIDRMFKDAITAGKRVRCETNISSGAVSVSSAAVELALMKLPKSECLSARMLLIGAGKMGKLVVKHLIAKGCKKVVVVNRSVERVDAIREEMKDIEIVYRPLTEMYEAAAEADVVFTSTASETPLFTKEHAEALPAISDAMGGVRLFVDISVPRNVSACVSEVGHARVYNVDDLKEVVEANKEDRLRKAMEAQTIITQELKRFEAWRDSLETVPTIKKLRSYADRIRASELEKCLQKIGEDALTKKMRRSIEELSTGIVNKLLHGPLQHLRCDGSDSRTLDETLENMHALNRMFSLDTEKAIIEQKIKAKVEKSQN

SEQ ID NO: 67117 - protein, 163 aa, Desulfovibrio desulfuricans G20
MEQNEFGLIEKIVDLNRVAKVVKGGRRFSFSALVVVGDGNGSVGFGMGKAQEVPEALRKATERAKKGMVQVPLVDGTLPYEVLGAFGAGRVLLKPASKGTGIIAGGAVRAIMEAVGIHDVLAKAIGTNNPHNVLRATMAGLTSLRSAEYVSQLRGKKLEAPRK

SEQ ID NO: 67118 - protein, 176 aa, Camellia sinensis
MAASIISSAVVAPAQASMAAPFTGLKSTSAFPVTRKLDTDITSLASNGGRVQCMKVWPPLGLKKFETLSYLPPLTQAQLGKEVDYLIRLGWIPCLEFSVQGGFVYREHNKSPGYYDGRYWTMWKLPMFGCTDSSQVLKEVEECKKEYPQSFIRIIGFDNKRQVQCISFICYKPPGF

SEQ ID NO: 67119 - protein, 192 aa, Enterococcus faecalis V583
MNLPNKLTVLRIFMIPIFIIIVSVPMDWGTISFGDTTLAVTQLVGAIIFAVASFTDWLDGKIARAQGLVTNFGKFADPLADKMLVMTAFIVLVGQGKVPAWIVAIIVCRELAVTGLRLLLVEHGEVMAAAWPGKVKTATQMVAIILLFINNIPFSALHLPLDQIMLYACLIFTIYSGVDYFAKNKDVFKGSM

SEQ ID NO: 67120 - protein, 582 aa, Helicobacter pylori J99
MQVLALKYRPKHFSELVGQESVAKTLSLALDNQRLANAYLFSGLRGSGKTSSSRIFARALMCKTGPKAVPCDTCIQCQSALNNHHIDIIEMDGASNRGIDDVRNLIEQTRYKPSFGRYKIFIIDEVHMFTTEAFNALLKTLEEPPSHVKFLLATTDALKLPATILSRTQHFRFKKIPENSVISHLKTILEKEQVSYESSALEKLAHSGQGSLRDTITLLEQAINYCDNAITESKVAEMLGAIDRSVLEDFFQSLINQDEARLQERYAILENYETEGVLEEMMLFLKAKLLSPDSYSILLIERFFKIIMSSLSLLKEGANASFVLLLLKMKFKEALKLKALDDAIVELEQTPFNQSPSISYNAPKQEPKSTERIEGREKLEKRERIETPQTPMLSAKDRIFHNLFKQVQTLVYERNYELGAVFEKNIRFIDFDSQTKTLTWESLATDKDKELLRERFKIVKSIVDGVFGKGENIKIALKHHLENKSAPEETKEVKEFKFPPLKPKLTTETTAEMQEKETKEAVGKALQTKENDTKEVQENETKETKEAQPKEAPTALQEFMANHSNLIEEIKSEFEIKSVELL

SEQ ID NO: 67121 - protein, 335 aa, Marinobacter sp. ELB17
MKILVTGSAGFIGFHLAQRLLDRGDEVIGVDNLNDYYDVNLKEARLARLTGKAGFTEVRQDIADRDLMAALFEEHKPERVVHLAAQAGVRYSIENPQAYVDANLVGFMNILEGCRRNDVQHLVYASSSSVYGANEAMPFSVHDNVDHPLSLYAASKKANELMAHTYSHLYNLPTTGLRFFTVYGPWGRPDMAPFIFTKKILAGEPIDVFNHGHHKRDFTYIDDIVEGVVRTLDQVAQPNPQWSAAQPDPSTSRGPYRIYNIGSNNPVELARFIETIEQCTGKKAEKNLLPMQPGDVVATYANVDGLINDVGYKPETQLEQGIEQFVQWYRDFYSV

SEQ ID NO: 67122 - protein, 332 aa, Helicobacter pylori J99
MAQNLPTIALLATGGTIAGSGVDASLGSYKSGELGVKELLKAIPSLNKIARIQGEQVSNIGSQDMNEEIWFKLAQRAQELLDDSRIQGVVITHGTDTLEESAYFLNLVLHSTKPVVLVGAMRNASSLSADGALNLYYAVSVAVNEKSANKGVLVVMDDTIFRVREVVKTHTTHISTFKALNSGAIGSVYYGKTRYYMQPLRKHTTESEFSLSQLKTPLPKVDIIYTHAGMTPDLFQASLNSHAKGVVIAGVGNGNVSAGFLKAMQEASQMGVVIVRSSRVGSGGVTSGEIDDKAYGFITSDNLNPQKARVLLQLALTKTNDKAKIQEMFEEY

SEQ ID NO: 67123 - protein, 254 aa, Mycobacterium sp. MCS
MSTVVTTRESELAASLAALRERLARAADAAGRDVAEIALLPVTKFFPASDIRILYGLGCREFAESREQEASKKAAELAGEFAGDPVRWHMVGRIQRNKARAVARWAYAAHSVDSAKLIAALDRGAGDALGDGVRTAPLRVYLQLSLDGDVERGGVDVDQPELIDQLCAAVDSAEALEFVGLMGIPPLGADAESAFARLQSEWRRVRQRRKEIGRGQRFELSAGMSGDLEMAVRHGSTCVRVGTALMGPRPLTSP

SEQ ID NO: 67124 - protein, 518 aa, Oryza sativa Japonica Group
MEEGVVGGGGAAVLVALLVTVVLAVMRSAGSRSSKRGRLPPSPMALPIIGHLHLIRPPPHRAFDRILARHGPLVYLRLGPSTHCVVIGSADVARDFLKFEASIPERPPTAVTRQLAYGKAGFAFAPYGAYWRFVKRLCMSELLGPRTVELLRPVRAAELADVLRAAQSAAERGEGVDMSHELVRMANNSIMRMVASALPGEMAEAARDCAKQVAELVGAFNAEDFVAVCRGWDLQGIGRRTNEVHARFDALLETIIEAKEEARRRSLRLGRRESSSKDLLDMLMDAAEDDTAEVKLTRDNIKAFVLDIFTAGSDTTATTVEWMLAELVNHPECMAKLRGELDAVVGRSRLVGEQDVARLPYLQAVLKETLRLRPPAVFAQRVTVEPVQVRGYTIPTDTQVFFNIFSIGRDATYWDQPLHFRPDRFLPDGAGATVDPKGQHPQLMPFGSGRRACPGMGLAMQAVPAFLAALVQCFDWAPPPSQPLPLDMEEAAGLVSARKHPLLLLPTPRIQPLPSFYS

SEQ ID NO: 67125 - protein, 223 aa, Arabidopsis thaliana
MATEDVQDPRIAKIASSIRVIPDFPKPGIMFQDITTLLLDTEAFKDTIALFVDRYKDKGISVVAGVEARGFIFGPPIALAIGAKFVPMRKPKKLPVTRNVLSHLETYEQCQIIVAFLVYPWTLISKLPLHLVPLTGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 67126 - protein, 425 aa, Mycobacterium avium subsp. paratuberculosis K-10
MFDYPHFLIRLWESRSTLAQRTQGSLKGNWYLLGPAFVAAIAYVDPGNVAANVSAGSQYGYLLLWVIVAANVLAGLVQYLSAKLGLVTGRSLPATIGKRMSRPARLVYWVQAELVAIATDAAEVVGGAIALHILFGLPLLAGGLITGVVALLLLGIQDRRGQILFERVITGLLLVIAIGFAASFFVKTAPPEAVLSGLLPRFRGTESVLLAAAILGATVMPHAVYMHSGLVLDRHGHPDEGPHRRLLLRVTRWDVVLAMAVAGTVNAAMLLIAATNLQHRDVSASIEGAYAAIHNTLGATIAVMFAVGLLASGLASSSVGAYAGAMIMQGLLHRSIPMVVRRLITLCPALLILAVGYDTTRALVLSQVVLSFGIPFAVLPLIKLTSDRELMGSDANHRITTILGWGVGILISLLNMVLIWLTVTG

SEQ ID NO: 67127 - protein, 345 aa, Bacillus anthracis str. Ames
MKAVVVNKNSKANIEVVEKELRPLHSGEALVDVEYCGVCHTDLHVANHDFGNTDGRILGHEGVGIVTKIADDVTSLKVGDRVSIAWMFQSCGRCEYCVTGRETFCREVKNAGYSVDGGMAEQCIVTADYAVKVPEGLDPAQASSITCAGVTTYKAIKVSDIKPGQPIVIYGCGGLGNLAIQYAKNVFGAKVIAVDINDDKLALAKEVGADMTINPISQGPADKIIQEEFGGAYAAVVTAVSKVAFNSAVDAVRACGKVVAVGLPVETMDLNIPRLVLDGIEVVGSLVGTRKDLEEAFMFGAEGKVVPVVQTCSLDKVQNVFEEMEQGRIQGRMVIDFKQNNCDCK

SEQ ID NO: 67128 - protein, 300 aa, Solanum tuberosum
RIGRLVARVALQRDDVELVAVNDPFISTDYMTYMFKYDSVHGQWKHHELKVKDEKTLLFGEKAVTVFGIRNPEDIPWAEAGADFVVESTGVFTDKDKAAAHLKGGAKKVAISAPSKDAPMFVVGVNENEYKPELDIVSNASCTTNCLAPLAKVINDRFGIVEGLMTTVHAMTATQKTVDRPSMKDWRGGRAASFNIIPSSTGAAKAVGKVLPSLNGKLTGMAFRVPTADVSVVDLTVRLEKEASYEDIQAAIKEESEGKLKGILGYTEDDVVSTDFVGDSRSSIFDAKAGLALSKNFVKL

SEQ ID NO: 67129 - protein, 259 aa, Arabidopsis thaliana
MASQVRSVKVGNLSSGATEHDIKEFFSFSGEVESIDIQSNEHSAYVTFKETQGAETAVLLSGPSIADQSVIIELAPNYSPPAAPHAETQSSGAESVVQKAEDVVSSMLAKGFILGKDAVGKAKAFDEKHGFTSTATAGVASLDQKIGLSQKLTAGTSLVNEKIKAVDQNFQVTERTKSVYAAAEQTVSSAGSAVMKNRYVLTGVSWAAGAFNRVAQAAGEVGQKTKEKVEAEQPSQPAQSQQQLPEGYSPIHSSEYSKN

SEQ ID NO: 67130 - protein, 501 aa, Solanum chacoense
MQLISIFLFICFLFLLRKWKKYSKNSQTKKLPPGPWKLPFIGSMHHLAGGRPHRVLRDLAKKYGPLMHLQLGEVSAVVVTSPDMAKEVLKTHDIAFASRPKLLAMDIICYDRCDIAFSPYGEYWKQMRKICVTEVLSAKSVRSFSSIRCDEVVRLIDSIQSSSSSGELVNFKERVIWFTSSMTCRSAFGQLPKEQDMFIKLIREVIRLAEGFDVADIFPSYKFLHVFGRAKRKLLNVHRKVDAIVEDVINEHKKNFATRKNDDHALGGENLIDVLLKLMNDKSLQFPINNDNIKAIIIDMFAAGTETSSTTTVWAMVEMLKNPRVLAKAQAEVREAFRNKVTFDENDVEDLKYLKLVIKETMRLHAPIPLLVPRECRKETEINGYTIPVKTKVMVNVWALGRDPKYWDDVECFKPERFEQCSIDFIGNNFEYLPFGGGRRICPGTSFGLANDYLPLAQLLCHFDWKLPTGMEPKDLDLTELAGMSAASKDDLYLIATPYQP

SEQ ID NO: 67131 - protein, 500 aa, Solanum chacoense
MQLVSIFLFISFLFLLRKWKKYLNNSQTKKLPPGPWKLPFIGGMHHLAGGLPHRVLRDLAEKYGPLMHLQLGEVSAVVVTSPEMAKQVLKTHDIAFASRPKLLAMDIICYNRRDIAFSPYGDYWRQMRKICIMEVLSAKSVRSFSSIRHDEVVRLIDSIQPCFTSGELVNFTERIIWFTSSMTCRSAFGQVLKEQEVFIKLIREVISLAEGFDVADIFPSYKFLHGFGGAKQKLLNAHRKVDSIVEDVIKEHKKNLATRKSDDAIGGEDLVDALVRLMNDKSLQFPINNDNIKAVIIDLFAAGTETSSTTTVWAMAEMLKNPSVFAKAQAKVREAFRDKVTFDENDVEELKYLKLVIKETMRLHAPVPLLVPRECREETEINGYTIPVKTKVMVNVWALGRDPKYWDDAESFKPERFEQCSIDFIGNNFEYLPFGGGRRICPGISFGLANVYLPLAQLLYHFDWKLPTGMEPKDLDLTESAGITAARKGDLYLIATPHQP

SEQ ID NO: 67132 - protein, 338 aa, Neurospora crassa
MVVKVGINGFGRIGRIVFRNAIEHDDIHIVAVNDPFIEPKYAAYMLRYDTTHGNFKGTIEVDGADLVVNGKKVKFYTERDPAAIPWSETGADYIVESTGVFTTTEKASAHLKGGAKKVIISAPSADAPMYVMGVNNETYDGSADVISNASCTTNCLAPLAKVIHDNFTIVEGLMTTVHSYTATQKTVDGPSAKDWRGGRTAAQNIIPSSTGSAKAVGKVIPDLNGKLTGMAMRVPTANVSVVDLTARIEKGATYDEIKEVIKKASEGPLAGILAYTEDEVVSSDMNGNPASSIFDAKAGISLNKNFVKLVSWYDNEWGYSRRVLDLISYISKVDAKKA

SEQ ID NO: 67133 - protein, 579 aa, Gibberella zeae PH-1
MTSKEEKVDIGTHTPPSHEVAPGHQKDVFTGDIEGVREDFREDDFMTRNGLNLKSFQRRDYGTGVVELDRSMKKRHLHMIAIGGSIGAGFFVGSGGAFTKGGPGAVLICFMIAGVMIFNVVHALGELAVMYPVSGGFYTYSTRFIDPSWGFAMGWNYVFQWVIVLPLELTVASFTVQYWNPNINEGIWITVFWLFIIFINVFGTLGYAEEEFWSSCFKLAAIIIFMIVAVVLICGGGPSRGNFSTYQGAKLWYDPGAFQNGSRGFCAVFVTAAFSFAGTELVGLAAAESRNPAKALPGAIKQVFWRITLFYIVGLTLVGMLVSSTDDRLLNSANPYKDGVSPFVLAALDAGLNGYDDFMNLVICVSVVSIGVSCVYGGSRTLTALAEQDYAPKCFTYIDRSGRPLMSVIFNLAWGALAYIVLASSGGLVFDWLLAVSALAALFTWGSICACHIRFRSAWKRQGRTLDQIPFHAAGGVYGSWLGLTLCFVILGCQLYVAVCPPFKEGYGNAEDFFMACLAIPVVLVFWIIGYIWKRPQWLTIDKIDLDTGLREHDWDEINAYRAKVASWPAWRRALNKFM

SEQ ID NO: 67134 - protein, 394 aa, Zea mays
MKAVGYSPYDSSGTDDDLPPAQNRGLRGRSFSGNVVASAGAFPYMRANNDLESEIHRVEQDAYTGILRAFKVQSDAISWEKESLITELRKELRVSDEEHRELLNKVNEDGTIRRMRELRQAGGSPSGLHHGNMVLYGAEPGSTTKRQRASHSIPLQSAGLQSPMMPSHSVSSAKWGPLQARGTKARTPIPLALPSVDPSSLINHKVYTRWPEDNNFYEATITRYNPVTGEHGLVYDMGTQAESWESVRLCDMAPEDIRWGFDGHLSNRDVWSPSGPMLMRHMTNNGAMAGSIKGRGRLSINETIKDYAPPENGTNRNFDHVDIPNTGSVVMEVKRVLFNPNMPEIEKARKLLKDQEQSLLDAIARLDEASDSDNEDMAMEGRMGSAGERNGITT

SEQ ID NO: 67135 - protein, 275 aa, Candida albicans SC5314
MKELDHENIVTLYDVIHTENKLTLVFEYMDKDLKKYMEVHGQQSALDLKVVKSFMFQLLKGIMFCHDNRVLHRDLKPQNLLINNKGELKLGDFGLARAFGIPFNTFSNEVVTLWYRAPDVLLGSRAYTTSIDIWSAGCIFAEMCTGKPLFPGTANEDQLIKIFRLMGTPNERTWPGISQYTNYKNNWQIFVPQDLRLIVPNLDSMGLNLLQSLLQMRPESRITARQALQHPWFHEITMPNAVPQHLSDPYQQQQQQQQQQQQQQHPHQPIIDQQY

SEQ ID NO: 67136 - protein, 206 aa, Dichelobacter nodosus
IQHIDDGAIYRALSAGKVVIVAGFQGVDEAGDITTLGRGGSDTTAVALAAVLKADECQIYTDVDGVYTTDPRIEPRARKLEQISFVEMLEMASLGSKVLQIRSVEFAGKYHVPVRVLSSFSDDETGTLISSVEGAIIEATHVTGIAFTRDEVMIQLMHLPDDMNTLYQILRPIGCADISLDMVRKRAMMMVQLILVLLCLIKKKIG

SEQ ID NO: 67137 - protein, 469 aa, Desulfovibrio vulgaris subsp. vulgaris str. Hildenborough
MRTKIIATIGPASRSHEVLSRLVNAGVGIFRLNFSHGDASMFVELIGLLRELERESGRPLTILQDLSGPKIRIGEIAKGALSVSKGDRLLLGPAPAPADNRPFIPFDHPAVLAEFEIGDRVVLSDGGLQFRVVDKGPNGTFELEANNNGMITSRKGLALPGKSVKLAALTAKDRKDLADGLALGVDAVALSYVQTPDDIRDAKEIIRAAGRNIPVIAKLERQNAVDRLDEILAETDIVMVARGDLGVECPLPELPAMQKRIIRACNRAAKPVIVATQMLLSMVNSPSPTRAETTDVANAVLDGADCVMLSEETAMGSFPVETVNFMKEIAMKAEELHFELQRLREPDVGRGSADFLAYSACLLAEKANADAIVSHSLSGSSARLISSRRPQQPVYAITPDPAAQRWLNFSWGVFPEGGDEGISGHLERAEAFIERCPDIPDGADVVITAGQPKPGDTPRGTNLVKIYRK

SEQ ID NO: 67138 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDVCQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 67139 - protein, 572 aa, Aspergillus nidulans FGSC A4
MPTKKHPNDSTHLPTKIKNFFRINSSSSTSSHQSSNHVNSSDRDTGSSTPVKHEPKSTFRQSRFLPMIGRNRSATVASEGNPLDEAISPTATANPYFVHQGQPALQHRNDGSIPSSPPDTPELQVDGVSAAEQATTANKEELARKLRRVASAPNAQGLFTATDSDGRPQTAELGKEPLVHSGAAGSPVGLVEVSSNTDQDGNLTVPQPGSGKLPAVTQVRTSSGGFRRTYSSNSIKVRNVEVGPASFDKIKLIGKGDVGKVYLVREKKSTRLYAMKVLSKKEMIKRNKIKRALAEQEILATSNHPFIVTLYHSFQSEDYLYLCMEYCSGGEFFRALQTRPGKCISEDAARFYAAEVTAALEYLHLMGFIYRDLKPENILLHQSGHIMLSDFDLSKQSGPGGAPTMIPARSGNSNTSLPTIDTKSCIADFRTNSFVGTEEYIAPEVIKGCGHTSAVDWWTLGILIYEMLYGTTPFKGKNRNATFGNILRDEVPFPEQGGAQQISKYVITEFCRGNETVNFRNVKESASVDIGEKNPSKMKGVPLNSGLATPNGEIADPFEEFNSVTLHHDGDF

SEQ ID NO: 67140 - protein, 323 aa, Enterococcus faecalis V583
MSKHYFDPRLKIFSLNSNRPLAEKIADAVGVELGKCSVTQFSDGEIQVNIEESIRGAHVYVIQSTSSPVNDNLMELLIMIDALKRASAKTINVVMPYYGYARQDRKARAREPITAKLVANMIEKAGATRMLTLDLHAVQIQGFFDIPVDHLMGAPLIADYFIEHGIQGDDVVVVSPDHGGVTRARKLAEFLKAPIAIIDKRRPKANVAEVMNIIGHVEGKTCVLIDDMIDTAGTISLAANALKEAGAKDVYASCTHPVLSGPALQRIEDSAIERLVVTDSIYLSDDRKIVKIDEVSVGELIGDAIKRIHENKPVSPLFETKNK

SEQ ID NO: 67141 - protein, 145 aa, Enterococcus faecalis V583
MTKPTEEELKQTLTDLQYAVTQENATERPFSGEYDDFYQDGIYVDIVSGEPLFSSLDKYDAGCGWPSFTKPIEKRGVKEKADFSHGMHRVEVRSQEADSHLGHVFTDGPLQEGGLRYCINAAALRFVPVADLEKEGYGEYLSLFK

SEQ ID NO: 67142 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEERVRAAFAFSAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVKA

SEQ ID NO: 67143 - protein, 145 aa, Zea mays
MAFPWCLSAPAAVPPVAPAPAPAPGAFGVSASVTALARVPVLAGRRRRWSTLVVCAAPDEEKITKRSPLDFPIEWERPKPGRRPDIFPKFSPMKTPLPHPLPADDPLDDDQEEEEEEQPPPQEEPQEDDPDKEEPEEDDPDKPTE

SEQ ID NO: 67144 - protein, 107 aa, Glycine max
MIAIRNYKVGLVIKEEGRERKVLAALPIGFAVFMVHLATIPVTGTGINPARSFGAAVMYNQKKAWDDQWIFWVGPFIGAAIAAFYHQFILRASAAKAVGSFRSNPTI

SEQ ID NO: 67145 - protein, 490 aa, Lotus japonicus
VALMILRKNLKKPDSIPNIPPGPWKLPIIGSIPHLVGSPPHRKLRDLAKKYGPLMHLQLGEVIFIIVSSAEYAKEVMKTHDVTFASRPRSLFTDIVFYGSTDIGFSPYGDYWRQVRKICNVELLSMKRVQSLWPIREEEVKNLIQRIASEEGSVVNLSQAIDSLIFTITSRSAFGKRYMEQEEFISCVREVMKLAGGFNIADLFPSAKWLENLTRMRSKFEYLHQKMDRILETIIDDHKANSRTKEGQVEGGEEDLIDVLLKYENSSTDQDFHLTIRNIKAILFDIFIAGSETSATTINWTMAEMMKDPILLKKAQDEVREIFQRRGKVDETCIYELKYLKAFINEVLRLHPPGPLVFRECRQACEINGYHIPAKSTVLVNTFAIGTDSKYWAEPERFCPERFIDSSIDYKGTNFEHLPFGAGRRICPGINYGMANVELVLALLLYHFDWTLPKGIKNEDLDLTEEFGVTVSKKEDLCLIPSISHPLPST

SEQ ID NO: 67146 - protein, 348 aa, Clostridium difficile 630
MVANKIKATPAARSQARKDNIKLDRLIGSGENGRIHLVDVLNYLKDNKANTTPLARRIAEDLNIDLETIVGTGYNGKIRKCDVEKLTAKETIVSTNTSKSSEKKELKIENENSSMFNTVEGIFEKPNPMRATVAKRMSESYFSAPVFTFNIEVDATELKVLRAKLIDTVKESTGVKLTMTDLIVMAVSKILPNHQALNSAWTDEGIFRYKDVNIAIAVGLDEGLYVPVVKNANKKSLKEIAKESKELAEKVKTGKLMPADQEGNTFTISNVGMYGITTFTPIINMPSSAILGVGATQDKFVPVNGEAKIKPIMNLSLTSDHRVIDGTVAAKFLKDLKELLENPLSMLV

SEQ ID NO: 67147 - protein, 506 aa, Vibrio cholerae O1 biovar eltor str. N16961
MIYAQPGSDNAVITFKSHYDNFIGGQWVKPVSGEYFGNISPVNGQVYCQVARSTQADIDLALDAAHQVREAWAKTSVTERSNLLLKIADRIEANIEQLAVAECWENGKPVRETLAADLPLVVDHFRYFAGCIRAQEGSAAELDSHTASYHFPEPIGVVGQIIPWNFPMLMAAWKLAPALAAGCCVVLKPAEQTPTSILVLIEKIADLIPAGVLNVVNGFGSEAGQALATSQRIAKLAFTGSTQVGQHILKCAAQSLIPSTVELGGKSPNIYFPDIFDHEDTYLEKCIEGTLLGFFNQGEVCTCPSRVLVHESIYDRFVAKVAERAKGIKQGNPLDTATQVGAQASQEQFDKILSYLDIGRQEGAKVLFGGGVAKQEGELGQGYYIQPTLLQGHNKMRVFQEEIFGPVIAITSFKDEAEALALANDTEYGLGAGIWTRDQNLAYRMGRNIQAGRIWINCYHAYPAHAAFGGYKKSGIGRETHKMMLNHYQNTKNLLISYDVNPLGFF

SEQ ID NO: 67148 - protein, 302 aa, Mycobacterium avium subsp. paratuberculosis K-10
MTRGLVIGESLIDIVEDAEYVGGSPLNVAVGLGRLGRDVDFLTYLADDDHGRRIAAYLKDAGVQLVSESRAAERTATARSTIAADGSADYEFDLDWRLSGTPPVAPPLFVHTGSIAAVRDPGCLAVAALIDTYRVSATVTFDPNVRPSLIADRELAVSRIEHLVERSDIVKVSAEDLHWIDPDRSPEQLAQTWLGLGPAIVAVTMADRGAVGYCAAGTARVPTRAVRVVDTVGAGDSFMAGLLDALWEAGLLGGDRRGALRDIGIDTLTSALDAASLSSALTIARAGADLPDRAAVQAALRR

SEQ ID NO: 67149 - protein, 531 aa, Sorghum bicolor
MATTATPQLLGGSVPQQWQTCLLVLLPVLLVSYYLLTSRSRNRSRSGKLGGAPRLPPGPAQLPILGNLHLLGPLPHKNLRELARRYGPVMQLRLGTVPTVVVSSAEAAREVLKVHDVDCCSRPASPGPKRLSYDLKNVGFAPYGEYWREMRKLFALELLSMRRVKAACYAREQEMDRLVADLDRAAASKASIVLNDHVFALTDGIIGTVAFGNIYASKQFAHKERFQHVLDDAMDMMASFSAEDFFPNAAGRLADRLSGFLARRERIFNELDVFFEKVIDQHMDPARPVPDNGGDLVDVLINLCKEHDGTLRFTRDHVKAIVLDTFIGAIDTSSVTILWAMSELMRKPQVLRKAQAEVRAAVGDDKPRVNSEDAAKIPYLKMVVKETLRLHPPATLLVPRETMRDTTICGYDVPANTRVFVNAWAIGRDPASWPAPDEFNPDRFVGSDVDYYGSHFELIPFGAGRRICPGLTMGETNVTFTLANLLYCYDWALPGAMKPEDVSMEETGALTFHRKTPLVVVPTKYKNRRAA

SEQ ID NO: 67150 - protein, 576 aa, Clostridium difficile 630
MSVEVIMPKAGVAMEEGTIVSWLKQEGEEVKIGEPILEITTDKVNMEIESEGEGTLAVIIHKEEGEVLPVFTVIGVIAEKGENQEEVKAKYLSGNVSKEDTVKENQNIEVKEEKINKKECNHDYDVVVIGGGPGGYLSALKAALLGGRVALVEENILGGTCLNRGCIPTKTYIKTAEILEEIDQLSKRGVKVTVDKEQDIKKAIKYKNRVVKKLTAGVGGLLKSRDVDVFNLKASVKEEHKVILSDGKVLDTENIIIATGSKVRILPIKGIESNLIITSTEALDLETVPEELVIIGGGVIGCEFAEIFNSRGSKVTIVEMEDRVIPRMDKELSESLKYSLSKKGINVLTKKKVSEFKEEGNNILVCIEGEEPIKADLCLYAIGREANLSGIEDLDIKIDKGSIVVNSKMETSIPSIYAVGDVTGGVMLAHAAFKMGEVAASNALGVNKEVDLGALPSCVYTIPEVASVGITEEDARKKYNVKVGKFNFAGNGRALASGQEQGYVKVVADAKYGEILGIHMFGCGVAELINHAASFKALEIPTDEASELIFGHPCTSEALMEALADVNGECLHLPKK

SEQ ID NO: 67151 - protein, 478 aa, Glycine max
  misc_feature (165)..(165): Xaa can be any naturally occurring amino acid
MDAKSAVELMESSSEVHFSGFHMDGFEQRKASIEQPTTSETDMYKQPFVIGVAGGAASGKTTVCDMIIQQLHDQRVVLVNQDSFYNNLTEEELTRVQDYNFDHPDAFDTKQLLHVMDKLKHGEAVDIPKYDFKSYKSDDVLRRVNPSDVIILEGILVFHDPRVRXELMNMKIFVDTDADVRLARRIRRDTTEKGRDIGAVLDQYSKFVKPAFDDFILPTKKYADIIIPRGGDNHVAIDLIVQHIRTKLGQHDLCKIYPNLYVIQSTFQIRGMHTLIRDAKTTKHDFVFYSDRLIRLVVEHGLGHLPFTEKQVITPTGSVYTGVDFCKRLCGVSVIRSGESMENALRACCKGIKIGKILIHREGDNGQQLIYEKLPNDISDRHVLLLDPILGTGNSAVQAISLLIKKGVPESNIIFLNLISAPKGVHVVCKSFPRIKIVTSEIEIGLNEDFRVIPGMGEFGDRYFGTDDDDEQVVVSSQ

SEQ ID NO: 67152 - protein, 499 aa, Glycyrrhiza echinata
MEILSLLSYSVFYLALFFIFNIVIRARKFKNLPPGPPSLPIIGNLHHLKRPLHRTFKGLSEKYGHVFSLWFGSRLVVVVSSASEFQQCFTKNDVVLANRPRFLSGKYIFYNYTTLGSTSYGEHWRNLRRITALDVLSNHRINSFSGIRRDETQRLITRLADDSSTNFAEMELSSRLYDMTFNNIMRMISGKRYYGEDCDTSDLQEASQFRDMVSELLQLSGANNKTDFMPLLRFLDFENLEKRLKDISGKTDAFLRGLIEEHRTKKERANTMIDHLLNLQDSQPEYYTDQIIKGLALAMLLAGTDSSAVTLEWSMSNLLNHPEVLKKVKDELDTHVGQDRLVDESDLPKLTYLKNVINETLRLYTPAPLLLPHSTSDECNIGGYKVPQDTIVLINAWAIHRDPELWTEATTFKPERFEKKGELEKLIAFGMGRRACPGEGLAIRAISMTLALLIQCFDWKLINGDKIDLAERDGFTLTKLVPLKAMCKSRPVINKVFKQ

SEQ ID NO: 67153 - protein, 254 aa, Brassica napus
MARKFFVGGNWKCNGTAEEVKKIVNTLNEAQVPSQDVVEVVVSPPYVFLPLVKSILRPDFYVAAQNCWVKKGGAFTGEVSAEMLVNLDIPWVILGLSERRALLNETNEFVGDKVAYALAQGLKVIACVGETLEQRESGSTMDVVAAQTKAIADRVSNWSNVVIAYEPVWAIGTGKVASPAQAQEVHDELRKWLAKNVSADVAATTRIIYGGSVNGGNCKELGGQADVDGFLVGGASLKPEFIDIIKAAEVKKSA

SEQ ID NO: 67154 - protein, 345 aa, Bacteroides thetaiotaomicron VPI-5482
MTNSQLSTFNFQLNMKLPGKIAIMGGGSWATAIAKMCLAQEDSINWYMRRDDRIADFKRLGHNPAYLTGVKFDTKRITFSSNINDVVKESDTLIFVTPSPYLKAHLKKLKTKIKDKFIITAIKGIVPDDNVIVSEYFTKEYGVPPENIAVLAGPCHAEEVALERLSYLTIACPDKDKARIFARRLGSSFIKTSVSDDVAGIEYSSVLKNVYAIAAGICSGLKYGDNFQAVLISNAIQEMNRFLNTVHPLNRNVDDSVYLGDLLVTGYSNFSRNRTFGSMIGKGYSVKSAQIEMEMIAEGYYGTKCIKEINKHHHVNMPILDAVYNILYERISPMIEIKLLTDSFR

SEQ ID NO: 67155 - protein, 261 aa, Xylella fastidiosa Dixon
MTALSVKHATDPIRGLQTLTVEDIRSNLTKVYSRIIAACQRVNRDPSSVTLLPVSKTVDEVHIRLSYEAGCRKLGENKAQDAYHKWEAMSDLTDLHWSVIGHLQTNKAKLVARFASEFQALDSLRVAEALERRLQIEGRSLDVLIQVNTSGETNKYGLPPEEVVRFVQALSAYPALRVRGLMTLALLSGDTSRVRQCFTQLRILRDRIQQASPQGHHITELSMGMSGDLEIAIEEGATAVRVGQAIYGARALPNLHLHHAV

SEQ ID NO: 67156 - protein, 487 aa, Eschscholzia californica
GTSTVALIAVIISSILYLLFGGSGHKNLPPGPKPWPIVGNLLQLGEKPHAQFAELAQTYGDIFTLKMGTETVVVASTSSAASEILKTHDRILSARYVFQSFRVKGHVENSIVWSDCTETWKNLRKVCRTELFTQKMIESQAHVREKKCEEMVEYLMKKQGEEVKIVEVIFGTLVNIFGNLIFSQNIFELGDPNSGSSEFKEYLWRMLELGNSTNPADYFPMLGKFDLFGQRKEVAECLKGIYAIWGAMLQERKLAKKVDGYKSKNDFVDVCLDSGLNDYQINALLMELFGAGTETSASTIEWAMTELTKNPKITAKIRSEIQTVVGERSVKESDFPNLPYLEATVKETLRLHPPTPLLLPRRALETCTILNYTIPKDCQIMVNAWGIGRDPKTWTDPLTFSPERFLNSSVDFRGNDFSLIPFGAGRRICPGLPIANQFIALLVATFVQNLDWCLPNGMSVDHLIVEEKFGLTLQKEPPLFIVPKSRV

SEQ ID NO: 67157 - protein, 277 aa, Saccharophagus degradans 2-40
MHKTTPISTLADQKSQELDPVWQTIRQETREQVEEEPALASFLHATILNHDTLESALSFHLAHKLANPAISALQIREIIEESMSHDSCISEAVRADIRAVFDRDSACNSYALPFLYFKGFHALQAFRVAHCLYKRGRKSLAYFLQSHIALTFGVDIHPAARIGKGIMMDHATGIVIGETTVVEDDVSLMQGVTLGGTGKEASDRHPKVRKGVLVGAGAKILGNIEIGEGAKVGAGSVVLEAVPPHTTVVGVPARVVGVPQSQSPALDMNHGIQCDCE

SEQ ID NO: 67158 - protein, 159 aa, Zea mays
MYQAIPYSSARPWLMPAGEAAAVVAVKPEPEPAAAATVAEERARADAAGGTDDDGDGGRAEVGRAVAESPVLVVGRRGCCLSHVVKRLLQGLGVNPAVHEVADEAALAGVVPAGAEAAAAALPAVFVGGKLLGGLDRLMAVHISGELVPILKKAGALWL

SEQ ID NO: 67159 - protein, 115 aa, Chlamydomonas reinhardtii
MQALSARAPRVAAKPVSRSGARSAVTVVCKATTVRSEVAKKVAMLSTLPATLAAHPAFALVDERMNGDGTGRPFGVNDPVLGWVLLGVFGTMWAIWFIGQKDLGDFEDADDGLKL

SEQ ID NO: 67160 - protein, 178 aa, Triticum aestivum
MAAERGSREGRWTLAAARALITGGSKGIGYAIVEELAGFGARVHACSRNAAELEECRRRWEEKGLHVTVSACDVSVRADRERLMDTVRQTFNGKLDILVNNAGQLLVKPTAECTAEEYSKVMATNLESSFHLCQLARPLLVHAGGGSIINMSSMGGSIGFVGSAIYAITKRAKNQLTR

SEQ ID NO: 67161 - protein, 410 aa, Marinobacter sp. ELB17
MALYVQKFGGTSVGTTERIEAVAEKVFSFRKAGHDIVVVVSAMSGETNRLIGLASNITDEPGQREMDVLLSTGEQVTIALLSMALQKLGCEARSYTGSQVRILTDRAHTKARIQHIDEQHVREDLNAGRVVVVAGFQGVDDLGDITTLGRGGSDTTAVALAAALKADECQIYTDVDGVYTTDPRVVDSARRLTHITFEEMLEMASLGSKVLQIRAVEFAGKYNVPLRVLSSFQEGEGTLITIEDDSTMEQPIVSGIAFNRDEAKLTISGVPDTPGSALRILKPISDANIEVDMIVQNVGEDDRTAFTFTVLRHDFKRAGDVLRSVAAELGAREVIGNEKIVKVSIVGVGMRSHAGVATKMFEALSNEGINIQMISTSEIKISVVIDEKYLELAVRALHSAFELDKPLVEA

SEQ ID NO: 67162 - protein, 397 aa, Neisseria meningitidis FAM18
MFFKHIEAAPADPILGLGEAFKAETRPEKVNLGIGVYKDASGATPLVKAVKEAEKRLLESETTKNYLTIDGVADYNAQTQILLFGKDHEIIASRRAKTAQSLGGTGALRIAAEFAKRQLNAQTIWISNPTWPNHNAIAKAVGIQDKPYRYYDAAKHGLDWDGMIEDLSQAQKGDIVLLHGCCHNPTGIDPTPEQWETLAKLSAEKGWLPLFDFAYQGFGNGLEEDAYGLRVFLKHNTELLIASSYSKNFGMYNERVGAFTLVAEDEATAARAHSQVKTIIRTLYSNPASHGANTIALVLKNDDLKAQWIAELDEMRGRIKAMRQKFVELLKAKGASQDFDFIIEQNGMFSFSGLTPEQVDRLKNEFAIYAVRSGRINVAGITDDNIDYLCESIVKVL

SEQ ID NO: 67163 - protein, 369 aa, Helicobacter pylori J99
MLLFTPGPVAINEEMRSSFSQPMPHHRTKDFEKIFQSVRENLKKMTGLEEVLLLSSSGTGAMEASVISLCQKELLFVNAGKFGERFGKIAKAHSIKAHELVYEWDTPAQVDGILNALKANPNIDAFCIQACESSGGLRHPVEKIAQAIKETNPNVFVIVDAITALGVEPLEITHVDALIGGSQKAFMLPPAMSLIALSQKAIDRIEERNVGFYFNLKSELKNQKNNTTSYTAPILHTLGLQRYFELVQNLGGFEALYQETKRVALASQKAVLALGLKIFPKSPSLSMTTIVSEHAKELKNLLKEKYQVQFAGGQEPYKDTLIRINHMGIIPVYKSAYALNALELALNDLDLREFDGMANTTFLKQYYEI

SEQ ID NO: 67164 - protein, 182 aa, Physcomitrella patens subsp. patens
MATVVAASSAVAPAAAFGAASSGVSTSEATSVKAFSGLKSATLFSGNAQTLSSVQNGSRVQCMQVWNPIGMTKFETFSYLPPLSDDAIAKQVEYMIQQKLIPCLEFDNSNGVSRVNNSSPGYYDGRYWTMWKLPMFGCQDSAQVLREIEECKTTFPGCYVRVLGFDNVKQVQICGFLVARPN

SEQ ID NO: 67165 - protein, 318 aa, Helicobacter pylori J99
MKARGFKTKMRGFKIFSGSAHPAFGKEVSKHLGFPLSKAVIGKFSDGEINIQISESVRGKDIFIIQPTCVPVNDNLMELLVMVDALRRSSANSITAVLPYFGYARQDRKAAPRVPITAKMVANLMQEVGIERIITMDLHAGQIQGFFDVPVDNLYGSIVFRDYIRSKALKNPIIASPDVGGVTRARYFANQMGLDLIIVDKRREKANESEVMNIIGSAKERDVILVDDMIDTAGTICKAALALKEQGATSVMALGTHAVLSGNAIKRIKESALDEVVVTNSIPLVQKCDKITTLSVASLFAEVIRRIYHNESVQSLFT

SEQ ID NO: 67166 - protein, 406 aa, Oryza sativa Indica Group
MTTDLLLLLLLLSSSRLALAAAFGVWINGAASSSPQSQEYEALQALKAAVVEDPRGALASWQGPNVCAYRGVYCSAPPDDAAASGAVVAGIDLNRANLRGTLPAAVSLLAHLTFLHLNSNRLAGQPPDSLRDLQYLTELDLSNNLFSGPFPAAALLIPSLVYLDLRFNAFSGGIPAEAFAKSSLDALFLNNNQFDGEIPETLWSSPATVITLANNRLTGPVPSAYGYGGRVREVLFLNNKLTGCIPEELGFLPTIEVLDLSYNSLSGHLPPTLSCLAGIEVLNIAHNQFTGELPDLVCDLKRITNLSVSFNFFSGISQHCDRLAGRSVFDFVGNCVPGRGLQRPPPECDGGQGDGGLSCLRSIPVTRPVPCAQASVSVGVGVGVGVIVRGAMPSFGAGGVVTVTVP

SEQ ID NO: 67167 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEERVRAAFVFPAPVANVESDVGCLELFHGPTLAFKDFGGRFMAQMLTYIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQETRHQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLHPGEYGLFLGTAHPAKFKESVEA

SEQ ID NO: 67168 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLHPGEYGLFLGTAHPAKFKESVEA

SEQ ID NO: 67169 - protein, 251 aa, Zea mays
MKFNIANPSTGCQKKLEIDDDQKLRAFYDRRISQEVSGDALGEEFKGYVFKIMGGCDKQGFPMKQGVLTSGRVRLLLHRGTPCFRGYGRRNGERRRKSVRGCIVSQDLSVINLVIVKKGDNDLPGLTDTEKPRMRGPKRASKIRKLFNLNKDDDVRKYVNTYRRTFTTKNGKKVSKAPKIQRLVTPLTLQRKRARIADKKKRITKKKSEAAEYQKLLAQRLKEQRDRRSESLAKRRSKLSAAAKASAATSA

SEQ ID NO: 67170 - protein, 498 aa, Lentisphaera araneosa HTCC2155
MSIKEYDVLIVGGGINGATSVANLSYQGLKLALVEQRDYASMTSQASSNMIWGGIKYLQSAEFSLVRALCESRNRLLQAYPSRVREIAYFTSFYKGNPYSSKLIYAGAWFYWLMGGCQTFKPRYVKANQVRHEAPLLKQEGLNGAVSYADAYLPDNDARFVYQFIRDGQKRGAKCFNYTRLETASYVDGWWLVDLLDLRTSQKSQIRARSLVNACGPQLKSLSGDIPVESQVAFSKGVHLIVPKIGPSDRVLTFFSKDGRLFFVLPMGNRSCIGTTDTRVRSHECEVTQGDREFILENINSYLNDYKDLSLKDIISERCGVRTLIVDGDDQGEDWIKLTRKHKIEVDKSKKSLTIVGGKITDCLNVGEEVGEAICEMLQERYREGVWYGESSEKEKFIKSAQQLNLGQHFDGLSMIEDHLWRRYGSEAFTILDLIKDDQSLANEVHPGSGYIKAEFVYMAKFEQITCLEDVLRRRTTLAMEYKEEEMDLEMMKDLLGL

SEQ ID NO: 67171 - protein, 360 aa, Pseudomonas fluorescens Pf-5
MSKQILILPGDGIGPEIMAEAVKVLELANDKYSLGFELSHDVIGGAAIDKHGVPLADETLDRARAADAVLLGAVGGPKWDKIERDIRPERGLLKIRAQLGLFGNLRPAILYPQLADASSLKPEIVSGLDILIVRELTGGIYFGAPRGTRELENGERQSYDTLPYSESEIRRIARVGFDMARVRGKKLCSVDKANVLASSQLWREVVEQVAKDYPDVELSHMYVDNAAMQLVRAPKQFDVIVTDNMFGDILSDEASMLTGSIGMLPSASLDANNKGMYEPCHGSAPDIAGQGIANPLATILSVSMMLRYSFNLTEAADAIEQAVSRVLDQGLRTGDIWSAGCTKVGTQEMGDAVVAALRNL

SEQ ID NO: 67172 - protein, 161 aa, Clostridium difficile 630
MRIGLGYDVHKLTEDRKLIIGGVEIPHDKGLLGHSDADVLIHAIMDSILGALALGDIGKHFPDTDEEYKGADSMKLLEHVYNLITSKGYKIGNIDSTIIAQSPKMAPYIESMRSNISKVLNTDIDNINIKATTEEGLGFTGAKQGIASQSICLLLLTSQNN

SEQ ID NO: 67173 - protein, 488 aa, Eschscholzia californica
  misc_feature (192)..(192): Xaa can be any naturally occurring amino acid
MEVVTVALIAVIISSILYLLFGSSGHKNLPPGPKPWPIVGNLLQLGEKPHAQFAELAQTYGDIFTLKMGTETVVVASTSSAASEILKTHDRILSARYVFQSFRVKGHVENSIVWSDCTETWKNLRKVCRTELFTQKMIESQAHVREKKCEEMVEYLMKKQGEEVKIVEVIFGTLVNIFGNLIFSQNIFELGXPNSGSSEFKEYLWRMLELGNSTNPADYFPMLGKFDLFGQRKEVAECLKGIYAIWGAMLQERKLAKKVDGYQSKNDFVDVCLDSGLNDYQINALLMELFGAGTETSASTIEWAMTELTKNPKITAKLRSELQTVVGERSVKESDFPNLPYLEATVKETLRLHPPTPLLLPRRALETCTILNYTIPKDCQIMVNAWGIGRDPKTWIDPLTFSPERFLNSSVDFRGNDFSLIPFGAGRRICPGLPIANQFIALLVATFVQNLDWCLPNGMSVDHLIVEEKFGLTLQKEPPLFIVPKSRV

SEQ ID NO: 67174 - protein, 474 aa, Bacillus anthracis str. Ames
MKKHLYINGDWKSVNTYKPLYAPYSEETLAEIAQGTEEDVKEAVAAAKNAMKEMNTLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALIELFEEAGLPKGALNIISGPGSTVGEAIVTNDDVASITFTGSPKVGIGIKAKAGLKRVTLELGSNAAVIIDEDVELTDELIERVKWGAFVNNGQVCISVQRVFVHEERRDDFLSKLRKAMETVVVGDPLIEETDVSALISKKDVERIDNWVQEAVKEGANVLYGGNKRDERVFEPTVLTNVPEHVSVQCQEVFGPLMTVNTFKEFDEAIEQVNNSRYGLQAGVFTNNLFKAMRAIDELEVGGVMINDIPTFRVDHMPYGGVKESGTGREGIKYAIEEMTEMKLVCIKK

SEQ ID NO: 67175 - protein, 473 aa, Rhodococcus sp. RHA1
MGSTADATSSNAPDSNSPEQPSLKRVMGPGLLLLFIVGDILGTGIYALTGKVANQVGGAVWLPFLVAFVVAIITAFSYLELVTKFPKAAGAALYTHKAFGVHFLTYMVAFAVMCSGITSASTASRAFAANFVEAFDLDFSTGIGITLLGLGFMTLVGLVNFRGVSESVKTNVVLTCVELSGLLIIIMIGLWALGVGDGDFSRVATFDTGDRSALGAVVAGTALAFFAMVGFEDSVNMAEECKEPSRIFPKVLLTGLIITGCIYVFVSITAIALVPVSELGEGDTPLLKVVEAGAPGFPIGIFAFITMFAVANTALINMLMASRLLYGMSREGVLPPPLGKVHATRRTPYVAIVFTTILAFGLITFVGEVPELGGTTALLLLGVFTIVNITVLVLRKQPVEHKHFRVPTILPIIGALTCGFLVTPFADRPAVQYQIAGVLLGIGVVLWAGTVLVNKRLGKGGPQIDPEKLAEHE

SEQ ID NO: 67176 - protein, 242 aa, Triticum aestivum
  misc_feature (177)..(177): Xaa can be any naturally occurring amino acid
MEYVNPLTGFRVDGRRPNEMRQLKGEVGVVSRADGSALFEMGNTRVIAAVYGPREIQNRSQQQNSKEALVRCEYRMAEFSTGDRRRKPKGDRRSTEISLVIRQTMEASILTHLMPHSQIDIFVQVLQADGGTRSACINAATLALADAGIPMRDIVTSCSAGYLCSTPLLDLNYIEDXAGGADVTVGILAKMDKVTLLQMDAKLPMDTFETVMDLATEGCKAIATYIREVLLENTKQLECQRG

SEQ ID NO: 67177 - protein, 554 aa, Mycobacterium avium subsp. paratuberculosis K-10
MTSVHTLPDITATPAWDALRKHHDRIGDTHLRQFFEEDPDRGRELTVTVGDLYIDYSKHRVTRETLRLLVDLARTAKLEERRDQMFAGVHINTSEDRAVLHTALRLPRDAELIVDGRNVVADVHEVLDAMGEFTDRLRSGEWTGATGKRISTVVNIGIGGSDLGPVMVYQALRHYADAGISARFVSNVDPADLIATLADLDPATTLFIVASKTFSTLETLTNATAARRWITDALGDAAVAHHFVAVSTNKRLVDDFGINTDNMFGFWDWVGGRYSVDSAIGLSVMAVIGREAFADFLSGFHIVDRHFQTAPLESNAPVLLGLIGLWYSNFMGAQSRAVLPYSNDLARFAAYLQQLTMESNGKSTRADGSPVTTDTGEIFWGEPGTNGQHAFYQLLHQGTRLVPADFIGFSQPIDDLPTAEGSGSMHDLLMSNFFAQTQVLAFGKTAEEIAAEGTPADIVPHKVMPGNRPSTSILANRLTPSVLGQLIALYEHQVFTEGVIWGIDSFDQWGVELGKTQAKALLPVITANNSPAPQSDSSTDALVRRYRSERGRTS

SEQ ID NO: 67178 - protein, 79 aa, Parvularcula bermudensis HTCC2503
MADIAERVKKITTEHLDVDASKVEPSASFIDDLGADSLDIVELVMAFEEEFGIEIPDDAAETIQTVGDAIKFIEEKNAG

SEQ ID NO: 67179 - protein, 658 aa, Bacillus cereus E33L
MIEKYKHGKVKKLFEVKTLILLQVNALSKLYGAETILANIKLEVQTKDRIALVGRNGAGKSTLLKIIAGELSHDGGEIIKPKDVSIGYLAQNTGLETSLTIWDEMLTVFTHLQQMETKLRRLEQEMGKEENFSNEATYERLLADYDQLQLDYKDQGGYQYEADIRSILSGLGFPVETHQTTISTLSGGQKTRLALGKLLLTKPDLLILDEPTNHLDIETLTWLEQYLQGYPGAILIVSHDRYFLDKLVTQVYEISNKESRRFVGNYSKYLDLKSALYEQEMKRYEKQQDEIAKLEDFVQKNIARASTTKRAQSRRKQLDRMELLTRPLGDSKSASFHFDIEKQSGNDVLQVKDATIGYDKDPIIEHVTMRLTRGDSVALVGPNGIGKSTLLKSIVNKLPLLHGDVSFGSNVSVGYYDQEQANLTSSKRVLNELWDEYPLQPEKEIRTILGNFLFTGDDVLKPVSSLSGGQKARLALAKLMMQKSNLLILDEPTNHLDLNSKEILENALIDYPGTLLFVSHDRYFINRVTTTVIELSIEGAQEYLGDYDYYVEKKNEMIERAELEQEDETPVQKTVAQEKLNYLEEKERKKLERQRTRKIEELEQNIVQFEEEIATLEDQLCLPEIYADYEKASEITTKKQTLQEQLDACMAEWEELHL

SEQ ID NO: 67180 - protein, 335 aa, Ostreococcus tauri
MSDEEYSEDEYVSSEGEGAEGRDVEPQAQQAAPVLGPKEWVGLSSMPAATQQALLETLGKLRERNVNEMTVIFIGKQGVGKSSTVNTLLNERVAPSSPFQPENARPLLAGRVAAGFTLNVLDTPGLLDGDSISARGLMALRAALNGRKVDAFIFTDRLDTWRVDNSDRAIFTALAENFGAELWERTVLGFSHAQTTPPDGKPYEEFVNARVEQYRKAIRQTLGMPNLTLPFALIENGSRCKANAAGEKVVNERPWLTDMVGTMVEMACAKESYEYDHKKAGKKLDPNNKYKIWMLPLFLFQAFVLRPLMIGQIRRDIRKSDEDKKKKSARPAPKK

SEQ ID NO: 67181 - protein, 348 aa, Neisseria meningitidis FAM18
MKMQAVVVNKNVAGDVEIVEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSSVRPGQWIAIYGAGGLGNLGVQYAKKVFGAHVVAIDINDEKLAFAKESGADLVINAAKEDAAKVIQEKTGGAHVAIVTAVSAAAFNSAVNCVRAGGRVVAIGLPPESMDLSIPRLVLDGIEVVGSLVGTRKDLEEAFQFGAESLVVPKVQLRALDEAPAIFQEMREGKITGRMVIDMKKECGCGHHH

SEQ ID NO: 67182 - protein, 140 aa, Thermoplasma volcanium GSS1
MVLYASDIMRKYTKTFRPDTTAYEAAVVMAQDHVGFLIVEDETGIRGMVTEWDYINKIISKDLNPKNVRVEEIMNSPIISITPDTPTFKVAEIMSKNGIRRLPVMEKNKLVGVVTSRDILRAFKDYMDSISDIISRFGNL

SEQ ID NO: 67183 - protein, 393 aa, Desulfovibrio vulgaris subsp. vulgaris str. Hildenborough
MAVIKMTDLDLKGKRVLLREDLNVPLKEGRITSDKRIRAALPSIRMAMEAGARVLIVSHLGRPVEGEFDEAFSLAPVAAHLSRELGRDVRLVKDYIDGVDVAEGDCVLCENVRFLKGEKKNTEELGRRLAALCDIFVMDAFGAAHRAQASTHAVARFAPVACAGPLLAAELDALERALDAPKHPLVGIIGGSKVSTKLTLLDNLSHRVDRLIVGGGIANNFIKAAGYEVGKSLYEPELVEEAARLMAAARAAGGEIPVPLDVVVGPELADGAPATVRKVSEVGPDEMILDIGPATATRYREILLAAGTIVWNGPVGAFEWEQFGAGTRALCEAVADSPAFSIAGGGDTVAAVEKYGVASRVGYISTGGGAFLEFLEGKELPAVAILQERAAQS

SEQ ID NO: 67184 - protein, 158 aa, Oryza sativa Japonica Group
MAKARKAAAAGPVRRRAAAGRGRSRGGADHRGGGGGGGGRGGLEIGGGGWGGGKHKVGGLSRAFADGRQVAASAPVQVPAWPGRYADPDQAAFAEEEKRREEEDDAGDGDGDGWVPPHVYLARRQARSSVVEGVGRTLKGRDASRVRDAVWSRTGFDG

SEQ ID NO: 67185 - protein, 222 aa, Desulfovibrio vulgaris subsp. vulgaris str. Hildenborough
MILSPSLLSSDFGRLTEELAALEAAGVKWVHWDVMDGRFVPNITYGQPVISHLRKKSGLFFDVHLMVHEPERYLADFAKAGADMLVVHAEATNHLQRTLAEIRRLGCKAGVALNPHTPLSVLDYVLEDVDMVLIMSVNPGFGGQKFLPATYRKIRDLRAMLDARGLSAHIQVDGGVDPSNTAALVESGADVLVSGSAFFGFPPYDQRLRAFEDAAAAARPAN

SEQ ID NO: 67186 - protein, 316 aa, Thermoplasma volcanium GSS1
MKTESLRDTYGKELVELGRKDPDIVVLDADLSSSTKTGYFAKEFPERFFNMGISEQSMVTTAAGLAISGKKPFVSTFAIFLMRTYEQIRQSICYNDVPVRFVVTHGGITVGEDGATHQIVEDVGIMSGLPNMSVIVPSDSVETKSVIDYLENIKHPHYVRLSREKFPVINDLSYEFKIGRGYVVKDGSDATVIANGIMVSKALEAANALKDKGIDLRIINMPSVKPIDKDIIIKAARETGRIITAEEHSIYNGLGSRVSEVVSENYPVIVKRIGMRDTFGKSGKAMELFSYFHMDVKDIIDYVIQSLEEKSYENIS

SEQ ID NO: 67187 - protein, 437 aa, Saccharomyces cerevisiae
MLEHQLTQEDLEFDKKHIWHPYTSITTPLKVYPITKAEGSYLYLDNGTKVVDGMASWWCVQQGYNNHRLNAAAISQINKMSHVMFGGITHKAGIDFCKKLLALLPDTLECALLADSGSISVDIAMKMALRYHHSLGNTTKKRFLTIKKGYHGDAFGAVSVCDPVNSRHNTYNGFLAENIFCKAPEVRFDCREKDVEKLVEELDVKPFAEIIDKHHSEISGVVMESIVQGAGGLRMYHPYFLKRVRALCNDFNILLILDEVAVGLGRTGMLFGFEHAGIVPDIVCLGKTLTAGYLTLSATVTTREIGDQISSGPEGCFMHGQTYMANPLACAVASENLSILMEGKWKSQVRQIEVQLKKELVPLLEHPIVADVRILGAIGVVEVTKRVNVEVLQEKFIKAGAWIRPFGNIIYILPPYIITSEELTVLTEAIRSVLDFI

SEQ ID NO: 67188 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQILTHIAGDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSLGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 67189 - protein, 506 aa, Saccharomyces cerevisiae
MASMFRPPESNRSHQKTPKLTLPVNLVQNAKSTNDGQHLNRSPYSSVNESPYSNNSTSATSTTSSMASNSTLLYNRSSTTTIKNRPVPPPLPPLVLTQKKDGIEYRVAGDSQLSERFSNLHVDITYKELLSSAPISTKLSNIDTTFIKKDLDTPEGEDSYPSTLLSAYDFSSSGSNSAPLSANNIISCSNLIQGKDVDQLEEEAWRFGHLKDEITTLGILGEGAGGSVAKCRLKNGKKVFALKTINTMNTDSEYQKQIFRELQFNKSFKSDYIVQYYGMFTDEQSSSIYIAMEYMGGKSLEATYKNLLKRGGRISERVIGKIAESVLRGLSYLHERKVIHRDIKPQNILLNEKGEIKLCDFGVSGEAVNSLAMTFTGTSFYMAPERIQGQPYSVTCDVWSLGLTLLEVAGGRFPFESDKITQNVAPIELLTMILTFSPQLKDEPELDISWSKTFRSFIDYCLKKDARERPSPRQMLKHPWIVGQMKKKVNMERFVKKCWEKEKDGI

SEQ ID NO: 67190 - protein, 308 aa, Sulfolobus tokodaii str. 7
MRHFIIDCDTAEDDIMSLFMLLRNNIDVQGITIVEGNISYEQEINNALWSLEFVGKDIPVYPGSDRPLVKQFRSVPEVHGKGGIGDEVVKPSKLKPQNKKAVDAIVEIADRYAGELEFLAISPLTNLALAYLKDKSVVEKIKKVWIMGGTVWGRGNITPVAEYNIWVDPDSAKIVFNSGFDITMVPWDVIVNYPITDEEWEQIKTMKTKMAQFYVKIYTHYRKYSMEKEKIKGTPHPDLITTSVALNRNVVLKSERQYVDIENCDCLTRGMTVIDYLGIWGKEPNAEIIYEINKKEFYSMLIDLLNWF

SEQ ID NO: 67191 - protein, 437 aa, Saccharomyces cerevisiae
MCEHQLTQEDLEFDKKHIWHPYTSITTPLKVYPVTKAEGSYLYLDNGTKVVDGMASWWCVQQGYNNHRLNAAAISQINKMSHVMFGGITHKAGIDFCKKLLALLPDTLECALLADSGSISVDIAMKMALRYHHSLGNTTKKRFLTIKKGYHGDAFGAVSVCDPVNSRHNTYNGFLAENIFCKAPEVRFDCREKDVEKLVEELDVKPFAEIIDKHHSEISGVVMESIVQGAGGLRMYHPYFLKRVRALCNDFNILLILDEVAVGLGRTGMLFGFEHAGIVPDIVCLGKTLTAGYLTLSATVTTREIGDQISSGPEGCFMHGQTYMANPLACAVASENLSILMEGKWKSQVRQIEVQLKKELVPLLEHPIVADVRILGAIGVVEVTKRVNVEVLQEQFIKAGAWIRPFGNIIYILPPYIITSEELTVLTEAIRSVLDFI

SEQ ID NO: 67192 - protein, 168 aa, Glycine max
  misc_feature (54)..(54): Xaa can be any naturally occurring amino acid
  misc_feature (68)..(68): Xaa can be any naturally occurring amino acid
MRTKKKEVAYSMISCPVVTTRQRAHGDRYWTVPFTGLKSMAGFPTRKTNNDITXIASNGGRVQCMQVXWPPIGKKKIETLSYLPDLDDAQLAKEVEYLIRKGWIPCLEFELEHRFEYREHNGSPGYYDGHYWTMWKLPMFGCTDASQVLKEHQEAKTAYPNGFIRIIG

SEQ ID NO: 67193 - protein, 235 aa, Helicobacter pylori J99
MSEPIDRFTRIRWLFKNDFEKIRQQRVLICGVGGVGGFALDSLYRVGIGQITIIDKDMFDVTNQNRQIGSERIGESKVLVLQDLYKGIQALNCRIDEAFLNSFNFRDYDYILDCMDDLPIKTSLAIKCQNFAYGKFISSMGSAKRLNPKHIQVGSVWESYGDKFGRKFRDFLKKRRFKGDFKVVFSPEVPHCIELGSFNAVTASFGLQIASEVVQDIIKNERQWNERLRRRIGRF

SEQ ID NO: 67194 - protein, 542 aa, Zea mays
MQDWRVREFEGKFTDEFAHSSSNEHKGGVEASGVISSKKLKHAVANEKIQGVIPGTNSSGSLKRNSENIQHANGVLSQNISCAGDYKNGSIAFPLREENTITETRCPDDNWNSCQFALNNGSSILNNHSAPQDSLTYGDNDLNYIEWPGIDNFEDVDTLFRSSDSTYGQQQLENADGLSWIPSSDAVYSTDVALQQGLDSSYSDYGILDDLSAFQCAEDKSLPLVDPSSALCDNQFNDTYLFSEQKNVNAYGEQIYQEDLMELLPTDQICSGHENIDMLQVGNQYPSENAIQGTEDKKFSIASTSQLSSQNLLNQRHHLDSSSPSNITSESYPGKFGPSSCSSAQRNSKAGVTLKCANAVQKKTVNIQPRQPANDNVMNTSRASYPCENYETERRGLGKRTLGDPQVTMGSSMVVDGSFVSSMSSDNSVEESSFQQLQDAVSQLDVQTKLCIRDGLYRLARSAQHRQVFPNTMNSNGGSEDGKELENAETSCKFMDPRSIETQTNPIDRSIALLLFRESSGGHVHVAVAADDASSLKSPPGI

SEQ ID NO: 67195 - protein, 457 aa, Arabidopsis thaliana
MFNYVIILPLALFLLAYKFFFTSKKQRYYLPPSPSYSLPILGHHLLIKPPVHRLFHRLSNIHGPIFYLRLGSRRAVVISSSSLARECFTGQNDVIVSNRPRFLTSKYIAYNYTTIATTSYGDHWRNLRRICSLEIVSSKRLANFLHIRKEEIQRMLTRLSRDARVGKEVELESILYDLTFNNIVRMVTGKIYYGDDVSDKEEAELFKKLFTFITTNSGARHPGEYLPFMKIFGGSFEKEVKAAAKVIDEMLQRLLDECKSDKDGNTMVNHLLSLQQDDPEYYTDIIIKGLMLGIMVASSETSALTIEWAMASLLNHPKVLDKVKLEIDEIIGQDRLIEESDIANLPYLQNVVSETLRLHPAAPVLVPRSTAEDIKIGGYDVPRDTMVMVNAWAIHRDPDLWTEPERFNPERFNGGEGEKDDVRMLIAFGSGRRICPGVGLAHKIVTLALGSLIQCFD

SEQ ID NO: 67196 - protein, 335 aa, Lentisphaera araneosa HTCC2155
MSTNIAINGFGRMGRLAFREAYDRGELNIVHINELHGDAECAAHLLEFDSVHGRWDRNISFTEKAIVIDGKEITFSNAASPSECQWAGKNIDIVLECTGVHKSVASLQPYFENGAQKVVVSAPVKEEGALNIVYGINDELYDGSQNIITSASCTTNCLAPVVKVINEKLGIKHGCMTTIHDITNTQTIIDAPHKDLRRARACGESLIPTTTGSATAITVIYPELKGKLNGLAVRVPLLNGSLTDCVFELERPTTKEEVNQFFKEASESYLKGILGYEEKPLVSVDYKDEKRSSVIDAPSTMVINGTQVKILAWYDNEIGYINRMVDLLDKVEKSL

SEQ ID NO: 67197 - protein, 211 aa, Prochlorococcus marinus str. MIT 9215
MNPANYLKIKNKIPSNVNILAVSKGFKSQEIKTIQNIGQNDFGESKFQEAYEKQLILKDLKQINWHFIGRIQSNKIRKIVQNFKYIHSVDSFEKLQKISNISREEEKYPSIMLQVKFSDDPTKGGFNPEFLILKWREIQELENISLTGLMTINPKGLSSKENSGLFKKCRTLADTLQLPDCSMGMSSDWEEAIDAGSTWLRLGSLIFGGRY

SEQ ID NO: 67198 - protein, 204 aa, Oceanobacillus iheyensis HTE831
MLLIIDNYDSFTYNLVHYLEKLSIELMVIKNDQITIKEIAELDPDYILLSPGPHNPDQAGITLDVITFFHDKIPILGVCLGHQAIGQAFGANIIKTTPMHGKRSTISHDVKTVFKDIPSPYLVTRYHSLVIERTSLPEELVITSVSEDGEIMGVRHTTFPIEGVQFHPESIWTEYGEILLHNFLTHYANYKERRNDATRRKIDI

SEQ ID NO: 67199 - protein, 270 aa, Prochlorococcus marinus str. MIT 9215
MTDKIAIIGFGNIASAIVTPLLENKLIQPEHVFCVVNSEKSLENIKKNYKHNINVYRSGSKESKIIWDCQYKLLSIKPQQFNDISEAHSIKNKDNLLVSILAGVSINRLTQKFPNHKCVRVVTNVPITIGKGLTGISWGEEITADQKKFTKNLFQNTSKIYEFTEDYLDIFLALTSSGPAIIALIIEALSDGGLSGGLPKIISEELVMEMILGTICLIKENKLTTSELKNLVTSPGGTTISALRVLEKKSVRSALIESIVSASNRSKEFR

SEQ ID NO: 67200 - protein, 406 aa, Mycobacterium avium subsp. paratuberculosis K-10
MRHRPPRGLVVESSEDRESMDLFEYQAKELFAKHNVPTTPGRVTDTAEGARDIAAEIGRPVMVKAQVKTGGRGKAGGVKYAATPEDAYTHAKNILGLDIKGHVVKKLLVSEASDIAEEYYISFLLDRANRTYLAMCSVEGGMEIEEVAATEPERLAKVPVDAVTGVDLATARSIAEKGHLPAEVLDAAAVTINKLWELFVAEDATLVEVNPLVRTPDNQILALDGKVTLDANADFRQPGHAAFEDRDATDPLELKAKEHDLNYVKLDGQVGIIGNGAGLAMSTLDVVAYAGEKHGGVKPANFLDIGGGASAEVMAAGLDVILHDKQVKSVFVNVFGGITSCDAVANGIVTALNMLGDEANKPLVVRLDGNNVDQGRRILAEANHPLVIQAETMDSGADKAAELANK

SEQ ID NO: 67201 - protein, 389 aa, Staphylococcus xylosus
MKTATLNRGKETKYLNEYPLIDEDDIYSHDHLKEGDLFYLVNNKEQYIATAYVGKQHKGIGWVLSYDKNEVINTQFLKNYLKQQNLKERIFIISTGTNAFRVFNGEGDGVGGLTIDNYDGHFLIQWYSKGIYKFRYNVLSALKAVFPYTSVYEKMRFKDTEIKGGFVDGDAPELPIVIEENFTFYNVHLDDGPMTGIFLDQKKVRKKLKDQYAENKEVLNVFSYTGAFSVVAAEKAEMTTSVDLANRSRALTEENLGLNSIDPKSQYIYVMDTFDFYNYARRHDLFYDTIVIDPPSFSRNKKKTFSVQKDYDKLILGALDILGPDGTLLLCTNNSAFSLKAFKNVVNTTLKAENVDYEIIDVMGLPKDFKTHPHYKPSKYLKAIFVKIK

SEQ ID NO: 67202 - protein, 381 aa, Ostreococcus tauri
MSTATARSCARTTRGGERGWEAKRRVKASGERMSTRVTTTDDDVVVCTGGLGFIGSHLCEGLVTRARVVAVDSVDARGPYPERHKRANARRLEALGVEVREMDVASDATAFETLVRDLGGGGRRRVAIAHLAARSGVGSANENPAGATRANVETTAVVMRAASSAGVARVVLASSGSVYGEASMTAEGAPRASAVGDSTEHPKSAYAATKRGAELLAKVYADGYGHVPVVVARIFTVFGPRGRPDMAVWRFIKALEEGKRLTRFGDGKSTWRDYVFIDDVVDALTRALMNDIEVPFSIVNVSGGAPVYLCEVIKACERACEKHGAVDESPPRPGDVGGTFGDISCAERTLDGWRPTTSLADGLARTVKWWRSADADDYREP

SEQ ID NO: 67203 - protein, 523 aa, Glycyrrhiza echinata
MEPQLVAVSVLVSALICYFFFRPYFHRYGKNLPPSPFFRLPIIGHMHMLGPLLHQSFHNLSHRYGPLFSLNFGSVLCVVASTPHFAKQLLQTNELAFNCRIESTAVKKLTYESSLAFAPYGDYWRFIKKLSMNELLGSRSINNFQHLRAQETHQLLRLLSNRARAFEAVNITEELLKLTNNVISIMMVGEAEEARDVVRDVTEIFGEFNVSDFIWLFKKMDLQGFGKRIEDLFQRFDTLVERIISKREQTRKDRRRNGKKGEQGSGDGIRDFLDILLDCTEDENSEIKIQRVHIKALIMDFFTAGTDTTAISTEWALVELVKKPSVLQKVREEIDNVVGKDRLVEESDCPNLPYLQAILKETFRLHPPVPMVTRRCVAECTVENYVIPEDSLLFVNVWSIGRNPKFWDNPLEFRPERFLKLEGDSSGVVDVRGSHFQLLPFGSGRRMCPGVSLAMQEVPALLGAIIQCFDFHVVGPKGEILKGDDIVINVDERPGLTAPRAHNLVCVPVDRTSGGGPLKIIEC

SEQ ID NO: 67204 - protein, 236 aa, Rhodococcus sp. RHA1
MRVASKIAAQALQEAGKAVAPGVTTDELDRIAHEYMIDHGAYPSTLGYKGFPKSCCTSLNEVICHGIPDSTVIQDGDIVNIDVTAYIGGVHGDTNATFLAGDVAEENRLLVERTHEATMRAIKAVKPGRALNVIGRVIESYAHRFGYGVVRDFTGHGIGTTFHNGLVILHYDEPSVDTVIEPGMVFTIEPMINLGDIGWEIWDDDWTVVTKDRKWTAQFEHTIVVTETGNEILTLP

SEQ ID NO: 67205 - protein, 517 aa, Nostoc sp. PCC 7120
MNITELIKISIILLLVATGVALLSRRLRVPYVTGLVLAGLPITELLSRPIGLDPALVLNLFLPILIFEAGINTDISRLRSTFKPIALLAGPGAILSSAIIAILLKFGLGLNWIPAFLVGVILANTDTVSMIAVFKEIPVPSRLSTIVEGETLFNDAAALVSFNLILQVYSTGSLTLIEGIQQLLFISVGGCLVGLVLGYLSIPVFNRLDDPLSSLLLTVAVALGTFQVGQFLGVSGAVAVVVAGLIFGNFGLSGNTSASSRITLLSFWEYASFTANTFIFLLIGVEINLVTLWQTLPAILLAVLAYQVGRVLTIYPLLAGVRWFDRPIPLRWQHLLFLGNIKGSLSMALALSLPTTLPGRESLIAIVFGCVLVSLVGQGLSLPFLVKRLKLSKFSHSQQQVEELQAQLITAKAAQDELDALLKTGVLPKAVYEEMRSAYQVQVAGAEKALREFYNRRPDEFDHKSGAFSKLDAIRRRLLLAEKGALTEAMRKRILSQDIGQNRIQTINEKLLQLDDD

SEQ ID NO: 67206 - protein, 571 aa, Staphylococcus xylosus
MSNHINGIAASDGVAIAKAYLLVEPDLSLDNEKVTDTDAEIAKFNHAIETSKVELTKIRNNAEENLGADKAAIFDAHLLVLDDPELIQPIEDKIKNEQVNAPTALSDVTGQFITIFESMDNEYMKERAADIRDVSKRVLAHILGVELPNPSMIDESVVIIGNDLTPSDTAQLNKEFVRGFVTNIGGRTSHSAIMSRSLEIAAVVGTKSITKEVKQGDMIIVDGLTGEVIIDPTEDEVIAYQNKRERFFEDKQALQQLRDEPSTTADGTHVELAANIGTPDDLKGVIENGAEGIGLYRTEFLYMGRDEMPTEDKQFEAYKKVLETMEDKRVVVRTLDIGGDKELPYLNLPEEMNPFLGYRAIRLCLDQPDIFRPQLRALLRASTYGKLNIMFPMVATIKEFRDAKALLLEEKENLTNEGIEVSDDIELGIMVEIPSTAALADVFAKEVDFFSIGTNDLIQYTMAADRMSERVSYLYQPYNPSILRLVKQVIKASHNEGKWTGMCGEMAGDETAIPLLLGLGLDEFSMSATSILKARRQIKGLSQNEMEELADRAINCATSEEVQELVEQYAK

SEQ ID NO: 67207 - protein, 461 aa, Rhodococcus sp. RHA1
MTHFDLAIIGSGSGNSLPDERFADKTIAILEEGTFGGTCLNVGCIPTKMFVYAAEVARTVGNSAKYGVDAELEGVRWPDIVKRVFGRIDPISAGGERYRAEDSPNTTLFRGHATFVGPRTLDTGTGEVITADQVVIAAGSRPIIPDVVRESGVRYYTNDDIMRLPELPERMVIIGAGYIAAEFAHVFSALGTRVSLIARSSHLLRHLDEDVSRRFTDLAQKKWDVHRGSTVAAVRRDGDGVVVELEDGTVVSGDVLLVATGRQSNGDAIGAAAGGIDLDDEGRVVVDDYQRTSAEGVFALGDVSSPYQLKHVANHEARVVQHNLLQDAWTDTSGLRVSDHRFVPAAVFTDPQIAHVGLTEAEAREAGWDITVKVQAYGDVAYGWAMEDDEGLCKVIAERGTGRLLGAHVIGAQAPTVIQPLIQAMSFGLTAQQMARGQYWIHPALPEVVENALLGLDLPAE

SEQ ID NO: 67208 - protein, 64 aa, Triticum aestivum
FLYKKGKKVGKAPQIQGFVTPLPPPRKGARIAAKKKRIAQKKSQGSGYPKLVAPRFKDPRAPRS

SEQ ID NO: 67209 - protein, 476 aa, Chlamydomonas reinhardtii
MPPRITCARTQVLNPATGAVIATLPRMRADETRAAIAAAHSVLPQWRATPARERAAILRRWHDLILQHQSDIAALMTAECGKPTAEALAEIAGGAASVDWFAGEAVRVAGDVLEPPSRDRRMVVLKQPVGVVGAITPWNFPMSMITRKVAPALAAGCTALVRPATTTPHIRLPPPAHTPKRAGLPDGVLNLVLGDAAAIGHELVHSDTVRKIGFTGSTAVGKMLAAGAGAGVKRVSLELGGNAPVLVFEDADLELAARGIVASALRNAGQTCICANRVFVHTAVYDKLAEAVVGRVRKLKVGDGAEPGVHVGPLITPAALDKAIVTAHVHDAVAKGGKLLLAGGGGGGGGGAAAAAAGNFYLPTVIGEATIDMRCFKEETFGPLIPLFRFTSDEEAVLLANTTEYGLAAYFYTRDLGRAWRVAEELEFGMVGASMGWVGGEVAPFGGVKQSGLGREQSKYGIAEFMDIKYVCMGLG

SEQ ID NO: 67210 - protein, 529 aa, Geobacter metallireducens GS-15
MDNTLLWNRYQSHLFHDPESGLMLDISRMNFADGFLASMESATQKAFAEMGELEGGAIANPDEGRMVGHYWLRSPDLSPTDEIAAEIGETVQRIREFAAAVHGGSIAAPDGRPFRKLLVVGIGGSALGPQFVADALGDVDNPLTPHFFDNTDPDGMDRVLAQIGPDLAGTLTVVISKSGGTKETRNGMLEAEIAYRRAGLHFPRYAVAVTGEGSELDRTATSAGWLARFPMWDWVGGRTSVTSAVGLLPAALQGLDIAGMLEGARLCDQLTRRPDTARNPAALLALMWHHATGGKGARDMVVLPYKDRLLLFSRYLQQLIMESIGKELDREGNVVCQGISVYGNKGSTDQHAYVQQLREGVNNFFVTFIEVLRDRRGASLPVEPGVTSGDYLSGFLQGTRTALGEKGRESLTITIPEVSPRTVGMLIALFERAVGLYASLVNINAYHQPGVEAGKKAAGTVLAHQADIIAHLRGTGSSLTADEIAAALGRPDAAETVFRTLLHAAANPDHGIRMEPAESLTASRFSVRD

SEQ ID NO: 67211 - protein, 249 aa, Geobacillus kaustophilus HTA426
MIHVKTEREIQLMREAGKLLAACHQEIAKRIGPGVTTMEIDRFVETFLAKYGAKPEQKGYRGYPYATCASINDEICHGFPRNEPLKEGDIVTIDFVVNLRGALADSAWTYAIGDVGEDVEKLLDVTEQSLYKGIEQAVLGNRIGDIGHAIQTYVEAHGFSVVRDFTGHGIGPTIHEEPYVPHFGEKGKGMRLKEGMVITIEPMVNMGAWQSKMDPNGWTARTIDGSYSAQYEHTIAITKNGPLILTTPA

SEQ ID NO: 67212 - protein, 244 aa, Pectobacterium carotovorum
MKGKLSIALMLSVCFSASATDSVHWGYEGNGDPAHWGKLSPDFSLCETGKNQSPINIRQALNAQHDPLQLAFQSGTQQIINNGHTIQVNVSPGNTLLLDNETFTLQQFHFHAPSENEIDGKQFPLEGHFVYKNADGALTVIALMFQEGAANPQLATAWQQIPARVDQAEDVRTPVAIQALLPTSLNYYRFSGSLTTPPCSEGIRWLVLDHPVTASAEQISQFSSVMHHANNRPIQPLNGRIIIH

SEQ ID NO: 67213 - protein, 246 aa, Klebsiella pneumoniae
MKTSLGKAALLALSMMPVTVFASHWSYEGEGSPEHWGALNEEYKTCQNGMNQSPINIDATFKTHLSPLDTHYIDGPITLINNGHTIQAALKTTTADTITIDGTPFILQQFHFHAPSENTVHGKHYAMEMHLVHKNAKGAVAVVAVMFEQGAENTELNKLWATMPEQAEQTAKIVTQMDLNALLPIDKTYWRFSGSLTTPPCSEGVTRIVLKHPLTLSSAQLAKFSHAMHHDNNRPVQPLNGRVVIE

SEQ ID NO: 67214 - protein, 122 aa, Bacteroides thetaiotaomicron VPI-5482
MKINNSYILLKDICCFAYHGVAPQENIIGNEYIINLKLKVDISQAIQTDDVVDTVNYAEIHEAVKAEMSIPSKLLEHVCGRIAKRLLAEFPAIEEIELRLSKRNPPMGADIDSAGVELHCSR

SEQ ID NO: 67215 - protein, 404 aa, Robiginitalea biformata HTCC2501
MFDVARIRNDFPILSRQVNGEPLVYLDNAATSQTPRQVIDAITDYYSRYNANIHRGVHTLSQEATDAYEQARIKIQKHFNAAHPHEIIMTSGTTHGINLVAQGFTGFLQQGDEVWVSAMEHHSNIVPWQMLCERTGARLRVIPMNKNGELELDTFREGLSDKTRLVFVNHVSNALGTVNPIEEIISLAHDAGAAVLVDGAQAAPHIRADLQALDADFYTVSAHKLCGPTGVGALYGKESWLEKLPPYQGGGEMIEEVTFEKTTYAGLPHKFEAGTPNICGGIAFGAALDYLNGIGMKAIAEYEAELLAYATKNLKTIPGLKIYGEAARKTSVISFNLEGIHPYDVGTILDKLGIAVRTGHHCAQPVMDFYGIPGTVRASFSFYNTREEADRLVAAVEKARQMLA

SEQ ID NO: 67216 - protein, 156 aa, uncultured archaeon GZfos26G2
MVEDNPGVLTRMSGMFTMRGINIMSLTVSPCEKDGLSRMTVAINGTESELEKVRKQISNLIEVVKVVDLMEEEPIIRDLSLLKVHVKDSKARSEVMQLAESYNAKIVDATLDSVTLELTETPKRIDRFVDLMNHFGLKQLFRTGITAIGTGSETEK

SEQ ID NO: 67217 - protein, 469 aa, Oryza sativa Japonica Group
MDLSPSAAASPSLAKAVETYRKAVATAATVTAYAMLARGMARELVPHDLRAALIWAASLVRARVEPRPAECRTAIIRSIEGNGHGHAQCIESRFFVDAHAYLATKIDPRSMSRFFLGGGGGGRRGRNVLSMVPGDSMTDVFEGVEFKWTSVPAEGRFADTEVSLELSFDAAHTDMALRRYVPFITEEVEQARRRDRELMIFMNEGSSWRGIAHHHPATFDTLAMDPELKQSIVADLDRFLKRKEYYRRIGKAWKRGYLLHGPPGTGKSSLVAAMANHLRFNLYDLDLSEVHSNSALQRLLIGMTNRCILIVEDIDCCFSARSREDGKERKKPTLTNNDVQRLTLSGLLNFIDGLWSTSGEERVIVFTTNYKDRLDAALLRPGRMDMHVYMGYCGWDAFKTLAHNYFLVDDHPLFPEIRALLAGVEATPAEVSEMLLRSEDADAALSGLVEFLEEKKEKKKKQAMCEAGK

SEQ ID NO: 67218 - protein, 764 aa, Oryza sativa Indica Group
MNSQKKRSPKIEPFRHRVDADPKSFDKSWKKLEDAIREIYNHNASGLSFEELYRTAYNLVLHKHGLKLYDKLTENLKGHLKEMCRSIGDAQGSLFLEELQRRWADHNKALQMIRDILMYMDRTFITTNKKTPVFDLGLELWRDIVVRAPKIHGRLLDTLLELIHRERMGEMINRGLMRSTTKMLMDLGSSVYHDDFEKPFLEVSASFYSGESQQFIECCDCGEYLKKAERRLAEELERVSQYMDAKTADKITSVVDTEMLANHMQRLILMENSGLVNMLVDDKHEDLSRMYNLFKRVPDGHSTIRSVMASHVKESGKALVSDPEKIKDPVEFVQRLLNEKDKYDEIISISFSNDKAFQNALNSSFENFINLNNRSPEFISLFVDDKLRKGVKGANEEDVETVLDKVMMLFRYLQEKDVFEKYYKQHLAKRLLSGKTTSDEAERSMLVKLKTECGYQFTSKLEGMFNDLKTSHDTMQSFYANLSGDTDSPTISVQILTTGSWPTQPCTPCKLPPEIVDISEKFRAFYLGTHNGRRLTWQTNMGNADIKATFGGRRHELNVSTYQMCVLMLFNSADGLTYGDIEQATGIPHADLKRCLQSLACVKGKNVLRKEPMSKDISEDDTFYYNDKFTSKLVKVKIGTVVAQKETEPEKLETRQRVEEDRKPQIEAAIVRIMKSRRVLDHNSIITEVTKQLQSRFLPNPVVIKKRIESLIEREFLERDKLHFALDIGQFFWPTCSCSKMWYSVWRAFAAVSFRMGTGNVEGK

SEQ ID NO: 67219 - protein, 338 aa, Xylella fastidiosa Dixon
MSVALSIDLSKKKTILCFGEALIDMLAQPPVKKGMPRAFLQCAGGAPANVAVAVARLGGAVQFVGMLGSDMFGDFLFDSFAEAGVVTDGIVRTSTAKTALAFVALDAHGERSFSFYRPPAADLLFRAEHFQDASFSDALIFHACSNSMTDADIAEVTFEGMRRAQAAGAIVSFDLNFRPMLWPNGENPASRLWKGLSLADVVKLSSEELDYLANTLAADANAVIQQLWQGRAQLLLVTDAAGPVHWYTRTAGGQVPTFRVQVQDSNAAGDAFVGGMLYTFAQQFDDAAALIDFCHDPESIVSTLRFAAAVGALAVTRQGAFTAMPMLSEVLSLIQEQS

SEQ ID NO: 67220 - protein, 332 aa, Aspergillus nidulans FGSC A4
MPPLSTMKAIVTEKTGGPEVLEVRTHHPVPTASEGQLLVKNQIIGINYIDTYFRTGLYPSSKPEILGREAVGEVVAVGPGANPYNFQIGDRVAWLSTGSYAEYTAVPQAFAVKVPEGISNEDVMGSFLSGLTVLTLAKETYPVQRGDWVLLHAAAGGAGFLMTQVLKSIGAIVIGTAGGPEKVELVKSLGADYVIDYRSEEGKDWVKKVKEITNGRGVDVVYDSVGKDTWEGSLEAVKRKGMIVWFGNASGPVPPLPLAKLSPKCVKVARPQLFGYIQAREEFEFYVNELFNMLKSGNLKVKIHKVYPLEQVAEAHSDLEGRKTTGKLLLKA

SEQ ID NO: 67221 - protein, 715 aa, Zea mays
MEAALSFSKDSPPISIICAAKIVGLPLTINHSLAAGSAPTLQFASGESLHGVNPIILYIARGASIASLSGKNDIEFGHVVEWLEYAPTFLSGSEFENACLFVDGFLASRTFLVGHGLTIADIAVWSNLAGIGQRWESLRKSKKYQNLVRWFNSIDSEYKEALNEVVAAFVGKRGIGKSPAPSLKEKVHDSKDPSAPEVDLPGAKVGKVCVRFAPEPSGYLHIGHAKAALLNKYFAERYQGRLIVRFDDTNPSKESNEFVENLLKDIETLGIKYDAVTYTSDYFPKLMEMAESLIKQGKAYIDDTPKEQMRKERMDGIESRCRNNTVEENLSLWKEMVNGTERGMQCCVRGKLDMQDPNKSLRDPVYYRCNTDPHHRVGSKYKVYPTYDFACPFVDALEGVTHALRSSEYHDRNAQYYRILQDMGLRRVEIYEFSRLNMVYTLLSKRKLLWFVQNKKVEDWTDPRFPTVQGIVRRGLKVEALIQFILQQGASKNLNLMEWDKLWTINKKIIDPVCARHTAVLKDQRVIFTLTNGPEEPFVRILPRHKKFEGAGKKATTFANRIWLDYADAAAISKGEEVTLMDWGNAIVKEIKVESGVITELVGELHLEGSVKTTKLKITWLADIEELVPLSLVEFDYLISKKKLEEDEDFLDNLNPCTRREIPALGDANMRNIKRGEVIQLERKGYYRCDAPFIRSSKPVVLFAIPDGRQQASLS

SEQ ID NO: 67222 - protein, 330 aa, Glycine max
MMGDSEMTKFGLKVGKNGFPRGLDPAISKFFVQLQIVVKSQLSRLAKQDGMSLMRSVQRKGGSFSYSEAELNEQLQAWRENPSWVDKPPLIKVTVPKGSLCNLDVEVDVGLPPDAVYNIVIDPDNRRVFKNIKEVVSRKVLVDQGHRQVVDLDQAAIWKFLWWSGTISINVLVDQNRKDHSMKFKQTKAGFMKKFEGCWRVEPLFVDEAMCHPFKPVTKEDYNACTRGKGRIGSKVSLEQILQPSIVPPPPLSWYLRGITARTTEMLINDMLAETARIRGGYEAEKSKAEELQVKPGENVDLVSNTSDIKESWKLRRKNAKQSHRSLLTK

SEQ ID NO: 67223 - protein, 476 aa, Physcomitrella patens subsp. patens
METLAIRSAVGAIRLTTTVASQASFRNCTVSSAFVGKNLGLKTFLSTSAVPVQQKLRCVRAEVGAKTVPVVAKAANRKASIKDVPESEFQGKVVFVRADLNVPLDDARIITDDTRIRASLPTIQHLVKAGAKVVVASHLGRPKKGPEDKFSLKPVAGRLSNLLGQTVELAPDSVGPEVESKIAALKEGQVLLLENVRFYKEEEKNDVEFSKKLAKNVDIFVNDAFGTAHRAHSSTAGIAEFVPKSVAGFLLEKELAYLSGAIKSPAKPFVAIVGGSKVSSKITVIESLMNVCDKVILGGGMIFTFFKADGKSIGSSLVEEDKIGLAKNLVALAKEKGVELILPVDVLVADKYAPDANTQECSSSHIPDGWMGLDIGPKAIEQFKEALKGSKTVLWNGPMGVFEFDAFAKGTYAVAESLAGLTKEGAITIIGGGDSVAAVEKAGLADQMSHVSTGGGASLELLEGKVLPGVAALDGA

SEQ ID NO: 67224 - protein, 444 aa, Mannheimia succiniciproducens MBEL55E
MSVYAYICFLFSISIFLAFFTRKISARIQSTIAITASAMIGSLVLILFGYFGWFKVEDIAIHIMERVDFKNFLLNGMLGFLLFAGSLGIKLPLMKEQRREIAVFALFSTLASTFFIGILIYYAAMLVGLRIDFVYCLVFGSLISPTDPIAVLAIIKNLKAPKRLSMQVEGESLFNDGVGLVIFTTLFAVAFNGQEPTFSGVFGLFLKEAVGGILFGFVMGFAIHLLITFTKEVSLEILLTLTIPTAGFMLANLLHISGALAMVTSGIIIGNWTRRQGFSERNRYFLDHFWEMIDHSLNSLLFFLIGLALLLVEFTFESSMLMLLAIPVCLIGRYVSLWIPYQIMSRFRRYNPYTLRILTWGGLRGGLALAMALSIPSNVVNISGNGMNLDLRDVIILMTYAVVMFSILVQGTTIEKMIETSKVIDPKRDAYVKLGGSRDYPPHI

SEQ ID NO: 67225 - protein, 296 aa, Physcomitrella patens subsp. patens
MSIRPERQAPPEIFYNDTEARKYTTSSRIVNIQAKLSERALELLALPDDGVSRLLLDIGCGSGLSGETLSENGHHWIGMDISEAMLDVALERETEGDLLLSDIGQGMPFRPGTLDGAISISAVQWLCNADKSCNNPRLRLKAFFGTLYKCLARGARAVLQIYPESPQQLEMISSAAMKSGFSGGLVVDYPHSTRAKKYFLVLSCGPPSTATALPRAKEGNEMSEDEESGSECDEDGGTTVNVSERQRPSKKQRKDSKKSGKGRSWILKKKEQRRHRGYTNVPDDSKYTGRKRKAHF

SEQ ID NO: 67226 - protein, 268 aa, uncultured archaeon GZfos26G2
MNGQSALDSSVQLNTRFIGKVVVVTGGGSGIGFQIAKDIYAEGATVYILGRNKEKLELAKGKIAPDDDSRMFYHQCDVSQYGSVVEVFHVIKDASGNVYGLVNNAAINPSRNDIIHTDVNDWIETLNVNLTGAFNCSKAAIGQMLELGKGSIVNISSVGGLNALRTRTSYNASKFGMIGLAKSLALDYADKNIRVNAICPGYVRTELTSLFFDRMEREKYEQLVNAHATRRLGRPDEISKAVLFLLSEDASFVTGVALPVDGGYLLKR

SEQ ID NO: 67227 - protein, 642 aa, Mannheimia succiniciproducens MBEL55E
MIFFSNLTLKRGLNLLLEEANATINPKQKVGLVGKNGCGKSSLFSLLKKENQPEGGEINYPADWAVSWVNQETPALNISALDYVIEGDRTYCRLQKELKLANEHNDGNAIARIHGQLDIIDAWTVQSRASALLHGLGFSQEELGRPVKSFSGGWRMRLNLAQALLCPSDLLLLDEPTNHLDLDAVIWLERWLVQYQGTLVLISHDRDFLDPIVNKIIHIEDKKLNEYTGDYSSFELQRAEKLAQQNALFRQQQDKIAHLQKYIDRFKAKATKAKQAQSRMKALERMERIAPAHVDNPFTFEFREPLSLPNPLVMIDKASAGYGEGESAVEILQKIKLNLVPGSRIGLLGKNGAGKSTLIKLLAGELTARSGVLQLAKGVQLGYFAQHQLDTLRADESALWHLQKLAPQQTEQELRNYLGGFAFHGDKVKDPVKQFSGGEKARLVLALIVWQRPNLLLLDEPTNHLDLDMRQALTEALVDYQGSLVVVSHDRHLLRNTVEEFYLVHDKQVEEFNGDLEDYAKWLNDLNVQEKSAVKNTEVSKESNNENSGQNRKEQKRREAELRQQTAPIRKQIAKFETEMDKLTAQLTEIEVRLADSGLYQTENKEKLTALLTQQVQTRKALEEAEAHWLTAQEELETLLAE

SEQ ID NO: 67228 - protein, 132 aa, Triticum aestivum
MAAAPSPAVAAVSSSTPSSGLLPPRRSAVPLPSMGSSRAAAPGGRMATVARAVGDVAAEGNTYLIAGAVAVALVGTAFPIFFSRKDTCPECDGAGFVRKSGATLRANAARKDQAQIVCANCNGLGKLGQIDK

SEQ ID NO: 67229 - protein, 437 aa, Lentisphaera araneosa HTCC2155
MSFENLGLRTEILTGIKFQGYTQPTPIQEQAIPIILKGGDILAGAQTGTGKTAAFTLPILHLLSTADNRGGHRPRALVLTPTRELAAQVGESVELYGKGLDIRSTVIFGGVGINPQKQKLRKGVDIVVGTPGRLLDLAGQKALDLSRIEYLILDEADRMLDMGFIHDIKKIIKLVPEKRQTLFFSATYSKDIKALSESILRNPSLVEVARQNTSAETVDQSVYHVGKNKKRNLLSSLIRDGEWNQVLVFTRTKHGANKLTNMLIADGITAAAIHGNKSQNARTRALADFKAIKVRVLVATDIAARGIDIDRLPHVVNYELPEIAEDYVHRIGRTGRAGCSGEAISLVAKEEASLLFAIEKLINKKVNVKEIPGITEKAPSQSQAREAEKELKKRRNDNRQNRSQQRKPGSGGPKKKDFSKDKKHKPRRRPRKQNPDK

SEQ ID NO: 67230 - protein, 262 aa, Clostridium difficile 630
MEKLQGKIAVVTAATKGIGLASAEILAKNGATVYLAARSEELAHEVINKISAEGGCAKFVYFNAREEETFTSMIEEVVKKEGKIDILVNNFGSTNPSLDKDLVTGDTDNFFDTVNTNLKSVYLPCKAAIPHMIKNGKGSIVNISSIGSVLPDLSRIAYCVSKAAINSLTQNIATQYAKDNVRCNAVLPGLIATKAALDNMSPEFIKEFLKHVPLNRIGEPDDIAKAVLFYASDDSSFITGDLLEVAGGFGLPTPQFADNILG

SEQ ID NO: 67231 - protein, 380 aa, Novosphingobium aromaticivorans DSM 12444
MTEVSPIETIIEDARNGRPYILVDAPDRENEGDVIIPAQFATPNAINFMAMHARGLICLAISSERASHLDLPMMEARNQSSLSTAFTVSIEARDGVTTGISAHDRAHTIAVAVDPSKGPEDLVSPGHVFPLVARDGGVLVRAGHTEAAVDISRLAGLAPAGVICEIMNPDGSMARLPELIEFARKHEMNIGTIADLIEYRRRSESLVERVVEAPFDSWHGDFRIIVYRNVIDSGEHVALVRGDPHQDMPTLVRVHQLDLTADVLGWRAAHRDYVPAALEVLAAHDGPAVAVFVRDNSPTSISERVKGNRKAYADTHGYRDYGIGAQILRDVGVREMVLLSSSAGKLAALEGFGLSVVNRVPLVEDERGKPSRSDQPFASA

SEQ ID NO: 67232 - protein, 235 aa, Zea mays
MAAGGELQLLSSWYSPYVIRAKVALGLKGLIYEFIEEDLFSKSDLLLKLNPVHKKVPVLVHGGRPVCESLVIVQYVDETWAAGTGTPLLPADAHDRATARFWAAYVDDKFCKEWIKLYRSTTAEKAAEALGGVVPVVETLEQAFRECSRGKPFFGGDAVGLVDIALGSFVVWIRVVDEAAGVKLLDEAKFPALTAWAERFLAVDAVREVMPDAGRLLEHYKGFLAKRAPPSPAGY

SEQ ID NO: 67233 - protein, 360 aa, Novosphingobium aromaticivorans DSM 12444
MLGRASVLVKPNQLETWDVKVADPEPGGALVSIVLGGVCGSDVHILTGEAGVMPFPIILGHEGVGRIEKLGHGVSTDYAGEELKPGDLVYWSPIALCHRCYSCNVLDETPCENTQFFEDASKPNWGSYADYAWLPNGMPFYKLPAQAQPEAVAALGCALPTALRGFDRCGSVRVGETVVVQGAGPVGLSAVLVAAQAGARDVIVIDGSPLRREAATALGASLTIGLDVAPEERRRMIYDRVGRNGPNVVIEAAGVLPAFPEGVDLTGNHGRYIVLGLWGAIGTQPISPRDLTIKNLTIAGATFPKPKHYYQALHLATALQDRVPLAGLVSHRFGVSQAGEALSLTKSGTAIKAVIDPTIT

SEQ ID NO: 67234 - protein, 348 aa, Ostreococcus tauri
MRADSCSLKKSLRQPRVRHLAACDLRPQLRGTITGARAMKLKIVSRSGRPVVADGIVVPNDAKVSDLKRSLHALKKKLYPSRQRFTTSPAPGESRGIVLVDDKSLNDYGLEDGDTIVFKDLGPQVSYKAVFFFEYLGPLLAYLPFYFMRREIYGGIFGIKNAGKAPLEAQTLAMYFHTAHYVKRILETFFVHKFSHATMPIFNLVRNCSYYWTFGAFMSYFINHPAYTPVGRTQMLAGFAFSAVMQLSNLRCHVILANLRKDGQKGYVIPSGFLFNYVTCANYATEIYQWLGFNIATQSVMGYTFMCCGAAQMMQWAIAKHARLRKLFDGKDGRPKFRRAFILLPPFF

SEQ ID NO: 67235 - protein, 395 aa, Syncephalastrum racemosum
MKFSLALLATVALATISQAAPVEKQVAGKPFQLVKNPHYQANATRAIFRAEKKYARHTAIPEQGKTIVKSAASGTGSVPMTDVDYDVEYYATVSVGTPAQSIKLDFDTGSSDLWFSSTLCTSCGSKSFDPTKSSTYKKVGKSWQISYGDGSSASGITATDNVELGGLKITGQTIELATRESSSFSSGAIDGILGLGFDTISTVAGTKTPVDNLISQNLISKPIFGVWLGKQSEGGGGEYVFGGYNTDHIDGSLTTVKVDNSQGWYGVTVSGLKVGSKSVASSFDGILDTGTTLLIFDQATGSKVAAAYGAKDNGDGTYTISCDQSKLQPLALTMGGKDFFVPADSLIYVKQGSQCIAGFGYSSMDFAIIGDTFLKNNYVVFNQGVPEVQIAPSKA

SEQ ID NO: 67236 - protein, 1241 aa, Amycolatopsis orientalis
MGRRERPLDPDAGSLQRFAFELRQLRSVAGQPGYRELSRRAHYSITALAEAAGGQTLPSLAVTLAYVQACGGDRQVWETRWRELAEELALANGDSADPDASPYLGLAAFQPDDADRYFGRDSLVEHVVHKVAQTPVVAVFGASGSGKSSLIRAGLIPATRTHSAFSGNQWTCVLLTPTSQPLRELAHAVTELCGTEPDRSEPGWLGRALHHAHHPRVLLVVDQFEELFTLCPNPDERVEFIDALLDAARSPDGMVHVVLGVRADFYGHCATHPGLLKTLGEGAQVLVGPMTKDELRSAITGPAAMAGLTVERELVATMIADIADEPGGLPLLSHALLETWRHRRNSTMTKAGYHVCGGVHGALAQTAERLYAEFDAAEQEVAHRIFLRLTALGDGTEDTRRRARHGELATVGDSSTVTRVLDKLAAARLVVIGTDSVEVAHEALIRAWPRLRRWLTDDREGVLLHRRITDATQLWQSSGRDPGLLYQATQLDQAIAWADQTHRASALNADEREFLDAATLLRDKQIRSRKQRTLRLRVATAAVVAVLAAASVITWQQRNEARDQHRVAVARQLVAEATALREIDPLRAAQLSLIAWQIAPDVPATRDSLLSVQAYPLPTRLLGHTGEVRDVAFSPDGRVLATAAGDSSVRLWDIASRQPLGNPLTGHTGMVNGLAFSPDGTTLATASADRTVRLWDVARHRPIGEPMSGHTNTVTSIAFSSDGRLLVTGSADGTVRTWDITSRTPIGEPMVGHKGPITAVALSPDGVTAATSSNDKTVRLWNVATRAPIGDPLTGHTSVTNGVAFSPDGQILASTSGDKTVRLWNVATRAPIGDPLTGHTNVTYGVAFSPDGRTLATSSWDKTVRIWDTTSRRQQGTALIGSTSSVFNIAFSPDGSALAGGDSDSSTLVWSLRGTLVPAHADAVYAVALSPEGRVLGTGADDRKVRLWETSTHRELVAPLTGHTAEVRSMAFSPQGGILATGSWDGTLRLWDAANRAPIGSPLTGHVDWVRGLAFSPDGHFVATAGMDMTVRLWNVATRAPFGPPLTGHTNSVTGIAFSPDGRSLATAANDKTIRLWDVPSRSPIGEPLTGHTSVVRDVVFSPDGKLLASAGDDKTVRLWDVASRTLIATLEGHTGEVLKLAISPDGRELASTSLDKTVRLWDTANRSTTTVLSASTGLAGVAYTPDGLVTGGVTGNVLLWTTDVTRLAGQVCAATGSELSDDEWRRYLPTWPRMKVCAGT

SEQ ID NO: 67237 - protein, 156 aa, Pisum sativum
GPFGGLKFMTGFPVKKVNTDITSITSNGGRVKCMQVWPPIGKKKFETLSYLPPLTRDQLLKEVEYLLRKGWVPCLEFELEKGFVYREHNKSPRYYDGRYWTMWKLPMFGTTDASQVLKELDEVVAAYPQAFVRIIGFDNVRQVQCISFIAHTPESY

SEQ ID NO: 67238 - protein, 362 aa, Pseudomonas fluorescens Pf-5
MKSAFKSFAPGALALLLLLPAALQAKEAETQQKLSNVVVLATGGTIAGAGASAANSATYQAAKVGIEQLIAGIPELSQLANVRGEQVMQIASESITNENLLQLGRRVAELADSKDVDGIVITHGTDTLEETAYFLNLVEKTDKPIVVVGSMRPGTAMSADGMLNLYNAVAVAGSKNARGKGVLVTMNDEIQSGRDVSKMINIKTEAFKSPWGPLGMVVEGKSYWFRLPAKRHTMDSEFDIKNIKSLPDVEIAYGYGNVSDTAYKALAQGGAKAIIHAGTGNGSVSSRVVPALQELRKNGVQIIRSSHVNAGGFVLRNAEQPDDKYDWVVAHDLNPQKARILAMVALTKTQDSKELQRMFWEY

SEQ ID NO: 67239 - protein, 227 aa, Brassica napus
  misc_feature (174)..(174): Xaa can be any naturally occurring amino acid
MYRTAALRAKALTGCLSRSFRASRYASSTAAAATASPVFSGSSLPSLNIPLDGISLPPSLPDNVGPSKVQTTTLPNGLKIASEMSPNPAASVGLYVDCGSIYETPLSRGATHLLERMAFKSTLNRSHVRLVREIESMGASTSASASREQMGYTIDALKTYVPQMVEVLVDSVRXNPAFVDWQVNEELRKVKMEIGELAKNPMGYLLEAVHSAGYSGAMANPFYAPES

SEQ ID NO: 67240 - protein, 450 aa, Xylella fastidiosa Dixon
MRVAIFGTGYVGLVTGTCLAEVGHEVLCVDINQAKVDGLNCGVIPIYEPGLEPMVKANHATGRLRFTTDSVAAIAHGEITFIAVGTPPDEDGAADLQYVLAVARTIGQYIDRPAIVVNKSTVPVGTADQVRAAIQHEMDVRGVDFKFEVVSNPEFLKEGDAVADCMRPDRIVIGARSRDAVVRMRRLYAPFNRNHDRIVEMDVRSAELTKYAANAMLATKISFMNEIANIAEHVGADIEYVRKGIGSDPRIGWHFIYPGVGYGGSCFPKDVKALARTAQQYGVDPKLLNAVENVNHAQKGHLFELMLRHYGCSGESTMLAGKTFAVWGLAFKPNTDDMREAPSCRLLVQLWKAGAQVRAYDPEAMQEARRIFGERDDLVFCETAYAALQCADALIVVTEWKQFRSPDFFVVRNALKDAVIFDGRNLYDPQEIEEAGLAYYGIGRGRSLHA

SEQ ID NO: 67241 - protein, 126 aa, Geobacter metallireducens GS-15
MLERGERPWGTYTVLEENTSYKIKRIEVNPGQRLSLQMHHHRSEHWIVVSGTARVTCGDEEYVVNVNESTFIPIGRNHRLENPGKIPLVIIEVQSGEYLGEDDIVRFDDDYNRCEPGTETFSGETD

SEQ ID NO: 67242 - protein, 185 aa, Mesorhizobium sp. BNC1
MAQPRRDDRREREERDSEFVDKLVHINRVAKVVKGGRRFGFAALVVVGDQKGRVGFGHGKAREVPEAIRKATESAKRDLIFVPLREGRTLHHDVGGHHGAGRVLMRAAKPGTGIIAGGPMRAVFETLGVQDVVAKSLGSSNPYNMVRATFDALKRQMHPKDIAAQRGIKYSTLQARRGTAVATEE

SEQ ID NO: 67243 - protein, 274 aa, Robiginitalea biformata HTCC2501
MKQQIFQVDAFAGELFRGNPAAVCILEEWLPDNLMQAIAAENNLSETAFAVPEGKGYEIRWFTPVTEVALCGHATLATAHVLFHEQPGEKHPLPTDADRLEFYSRERGTLTVTRRGDWLELDFPADPPAEAKLPVGMVEAMGAEPRECLRGTTDYLLVYEDQAAIEALNPDFGLLKQIKARGVIVTAPGDAVDFVSRFFAPQSGVDEDPVTGSAHTMLVPYWSGRLKKQHLEALQLSARGGQLRCESRGDRVGIAGRAVTYLAGRIRLPNLKNS

SEQ ID NO: 67244 - protein, 246 aa, Glycine max
MALSSPFLISAVNATCSVPHFHFHFHAQPLSLSSSHFPINIRPSTHHHVHVSHNHKWRAKVSFFTSFLKQKGKDAKIIKEELLEAIAPLDRGADATPQDQQTVDQIARELEAVTPIKEPLKSNLLDGKWELIYTTSQSILQTKRPKLLRSVANYQAINVDTLRAQNMESWPFFNQVTADLTPLNPRKVAVKFDTFKIGGIIPIKAPGRARGELEITYLDEELRVSRGDKGNLFILKMVDPSYRVPE

SEQ ID NO: 67245 - protein, 419 aa, Sulfolobus tokodaii str. 7
MAWKLEDIKVIIPIGGEATRLRPLTVETSKAAVRLLNRPLIEYTILELARQGIKEFIFGVKGYVNYRSLFDLYKEGIGFSARYHIKPRVHFKYIPRAETVGNAHAVKIAVEYYDVKEPFLVVQGDNLFKLDVKKVLEYHEEKKAFMTIVLKKVESVEEFGVAELDNDMKIKRFVEKPKRREEAPSDLANTGIYVISPEIRDVFKSEEVEEMLKLGKMDFGKDIIPYLIKKGYPVYGYVTENLWFDVGTPDRYLEAMLTLLKTLSDEDMQGLRIDANRRIFVQGTSPDSRKRRVIIKRMYKKGDLKLEGDILIGRHCQIGSGTYIEESAIDNFTIIGKSVKIVRSSIMDRVYIGDNAVIENSIIGRHVEIRSTSSKPTKIINSVIADDAVIGEGSEITNSKIYPHKLINSESKIYDTILT

SEQ ID NO: 67246 - protein, 197 aa, Aspergillus nidulans FGSC A4
MAEHDDELIASKTEGFKVGEKKTIAEYNELDKNDESLNRWKASLGLNTGEPTGDPNDPRTCIIKTLALEVQGRPDVVIDVSAPGALEKLKDKPFTIKEGAHFRIKVTFEVHHDVLSGLKYLQVVKRKGIRVSKDQEMLGSYAPCTTGKPIYEKKFQEEEAPSGMMARGHYNAESKFIDDDDKVHLHFHWSFDIAKDW

SEQ ID NO: 67247 - protein, 673 aa, Shewanella sp. MR-4
MAELKEVFVPDIGGDEVQVIEICASVGDTLAAEESILTVESDKATMDIPAPFAGVLAELKVAVGDKVSEGTLIAMMQAAGTANVQAAPVAQAAAPAPAPAAPAPVQAAPAPVAAAPATGATQVVEVTVPDIGGDTDVSVIEVLVAAGDKIEVDAGLITLETDKATMDVPSPFAGVVKEVKVAVGDKVSQGSLVIMLEVGGAAPAAAPQASAPAASAPVAQAAPAAPVAPVAAAAPVVAVKEIQVPDIGDASNVDVIEVLVSVGDDITVDQGLITLETDKATMEVPAPFAGKLLSLTVKVGDKVSQGSVIATIETVTAGSAPAPVAQAAAPAPVAQEAAPAPVAAAPSRPPVPHHPSAGAPVATGVVHASPAVRRLAREFGVDLTQVTGSGRKGRIMKEDVQAYVKYELSRPKATAATSVATGNGGGLQVIAAPKVDFSKFGEVEEIPLSRIQKISGPNLHRNWVTIPHVTQFDEADITEMEEFRKQQNDAAAKKKADYKITPLVFMMKAVAKTLQQFPVFNSSLSSDGESLIQKKYYHIGVAVDTPNGLVVPVVRDVDKKGIIELSRELADISVRARDGKLKSADMQGSCFTISSLGGIGGTAFTPIVNYPDVAILGVSKSEIKPKWNGKEFEPKLMLPLSLSYDHRVIDGAMAARFSVTLSGILSDIRTLIL

SEQ ID NO: 67248 - protein, 154 aa, Glycine max
LPIFASSRTFRTLQFLSFLSCKSSDIYFVTASCNNNNCKGIPNFSKLFYTLLVRFERFQSCIFLNQTSIASHFRSHSQKTEDLASFPRRRFHVEPGAREKALLAEDATLKPFKSYKKSVKKLRKIGNALTIVVVAGCCYEVYVRAFTREEAQKL

SEQ ID NO: 67249 - protein, 475 aa, Shewanella sp. MR-4
MSNEIKTQVVVLGAGPAGYSAAFRAADLGLETVIVERFSTLGGVCLNVGCIPSKALLHVAKVIEEAKAVAAHGVVFGEPTIDLDKLRSFKQKVISQLTGGLGGMSKMRKVNVVNGFGKFTGPNSLEVTAQDGTVTVVKFDQAIIAAGSRPIKLPFIPHEDPRIWDSTDALELKEVPGKLLVMGGGIIGLEMGTVYSSLGSEIDVVEMFDQVIPAADKDVVRVFTKQIKKKFNLILETKVTAVEAREDGIYVSMEGKSAPAEPVRYDAVLVAIGRTPNGKLIDAEKAGVKIDERGFINVDKQLRTNVPHIYAIGDIVGQPMLAHKGVHEGHVAAEVIAGMKHYFDPKVIPSIAYTDPEVAWVGLTEKEAKEQGIAYETATFPWAASGRAIASDCSEGMTKLIFDKDTHRVIGGAIVGVNGGELLGEIGLAIEMGCDAEDLALTIHAHPTLHESVGLAAEIYEGSITDLPNPKAKKK

SEQ ID NO: 67250 - protein, 324 aa, Enterococcus faecalis V583
MSKNFWATLPKPFFVLAPMEDVTDVVFRHVVKEAGAPDVFFTEFTNSDSYCHPEGKDSVRGRLVFTEDEQPMVAHIWGDKPEFFREMSIGVAEMGFQGLDINMGCPVPNVAERGKGSGLILRPEVAAELIDAAKAGGLPVSVKTRIGFTEMAEMEAWITHLLEQDIANLSIHLRTRKEMSKVDAHWEVIPQIMAIRDRVAPQTTITINGDIPDRQKGLELAEQYGVDGIMIGRGIFKNPYAFEKEPKTHTPQELLGLLRLQLDLQDKYAELVPRSIVGLHRFFKIYVKGFPGASDLRAQLMNTKSTDEVRQLLATFETEHGVLD

SEQ ID NO: 67251 - protein, 444 aa, Saccharomyces cerevisiae
MQSMNVQPRVLAVGGEQFFSQRQASEQHQQQNMGPQVYSPKVNRARMFPQGMPVNTINGSVNQEMNNAYLLKQKNEPLLTQQQQQQQQQQQQQQQQQQQQQQQQQQQPFNIGTPVSVASLPPGLNVLQQQQQQQQQQGVGLNRPLASQLPKHLTNQSMPPIFLPPPNYLFVRDVWKSNLYSEFAVIRQLVSQYNHVSISTEFVGTLARPIGTFRSKVDYHYQTMRANVDFLNPIQLGLSLSDANGNKPDNGPSTWQFNFEFDPKKEIMSTESLELLRKSGINFEKHENSGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHKFPNGTDFAKYQGVIYGIDGDQ

SEQ ID NO: 67252 - protein, 433 aa, Saccharomyces cerevisiae
MQSMNVQPRVLAVGGEQFFSQRQASEQHQQQNMGPQVYSPKVNRARMFPQGMPVNTINGSVNQEMNNAYLLKQKNEPLLTQQQQQQQQQQQPFNIGTPVSVASLPPGLNVLQQQQQQQQQQQQQQQGVGLNRPLASQLPKHLTNQSMPPIFLPPPNYLFVRDVWKSNLYSEFAVIRQLVSQYNHVSISTEFVGTLARPIGTFRSKVDYHYQTMRANVDFLNPIQLGLSLSDANGNKPDNGPSTWQFNFEFDPKKEIMSTESLELLRKSGINFEKHENLGIDVFEFSQLLMDSGLMMDDSVTWITYHAAYDLGFLINILMNDSMPNNKEDFEWWVHQYMPNFYDLNLVYKIIQEFKNPQLQQSSQQQQQQQYSLTTLADELGLPRFSIFTTTGGQSLLMLLSFCQLSKLSMHMFPNGTDFAKYQGVIYGIDGDQ

SEQ ID NO: 67253 - protein, 511 aa, Oceanobacillus iheyensis HTE831
MENNELVLVLDFGSQYNQLITRRIREFGVYSELHSHKLTAEEIKEMNPKGIILSGGPHSVYDENSFRCDEGIFELGIPVLGICYGMQLMSLHYDGKVERSKNREYGKALIELDGEPVLFKDTPKGQTVWMSHGDKVTAAPPSFNIDATSPSTPIAAISNVEKNLYGVQFHPEVRHTEYGNDLLNRFVFDVCGCTGDWSIENFIDMEVEKIQETVGDRKVLCALSGGVDSSVVAALIHKAIGDQLTCIFVDHGLLRKNEGDDVMKVFAEDFQMNIIKVDAKDRFLFKLEGVSDPELKRKIIGNEFIYVFDDEASKLKDIDFLAQGTLYTDVIESGTDTAQTIKSHHNVGGLPEDMQFTLIEPLNTLFKDEVRELGSQLGVPDRIVWRQPFPGPGLAIRILGEVTEEHLEIVRESDAILREEIAKAGLDRDIWQYFTVLPNIKSVGVMGDARTYAHTIGIRAVTSIDGMTSDWARIPWDVLERISTRLVNDVDNINRVVYDVTSKPPATIEWE

SEQ ID NO: 67254 - protein, 363 aa, Arabidopsis thaliana
MSRQSFSLLKNLRSIASGSKIQTRSVTYMPRPGDGKPRPVTLIPGDGVGPLVTNAVQQVMEAMHAPVYFEPFEVHGDMKSLPEGLLESIKKNKVCLKGGLKTPVGGGVSSLNVNLRKELDLFASLVNCFNLPGLASRHENVDIVVIRENTEGEYAGLEHEVVPGVVESLKFCSERIAKYAFEYAYLNNRKKVTAVHKANIMKLADGLFLESCQEVAKKYPSIAYNEIIVDNCCMQLVARPEQFDVMVTPNLYGNLVANTAAGIAGGTGVMPGGNVGAEYAVFEQGASAGNVGKDTTEEQKNANPVALLLSSAMMLRHLQFPSFADRLETAVKRVIAEGNCRTEDLGGNSTTQEVVDAVIANLD

SEQ ID NO: 67255 - protein, 427 aa, Zea mays
MVSYDKAFKSYKKALTTTTSVAGLATSMMMDHTIVVEKKNDGLTNNHVYCIVKTYLATRMNIDIQQRLRVSSMDEDDKMMVSMDEGDKMLDVYQGTEFKWCLVCKDNSKDSLNNGSQNESQLFELTFNKRHKDKERTLMIYMTEYDDWSAIDLNHPSTFDTLAMDHKLKQSIIDDLNRFIKRKDYYKKIGKAWKRGYLLYGPPGTGKSSLIATMANQLRFDIYDLELTAVTSNSDLERLLVGMGNRSILVIEDIDCTIELEQREEGEGHDKSNSTEQNRREEKVTMSGLLNFVDGLWPTSGEERIIVFTTNYKERLDPTLLRPGRMDMHIHMGYCTPESFQILANNYHYIEYHDTYPAIEKLIKEMVVTPAEVAEVLMRNDDTDVVLHDLVGFLKSRMKDVNEVKTEHKKENNKMDEKKEDKDNDKD

SEQ ID NO: 67256 - protein, 305 aa, Pseudomonas fluorescens Pf-5
MSAKVVVVGSLNMDLVTRAERLPRGGETLIGKSFATVSGGKGANQAVAAARLGAQVSMVGCVGDDAYGEQLRGALLAEQIDCQTVSVVEGSSGVALIVVDDSSQNAIVIVAGGNGQLTPEKVAGFDGVLQDGQVIICQLEVPLATVGYTLKRGRELGKTVILNPAPASGPLPAQWYGAIDYLIPNESEASALSGVAVDSLESAEVAASRLIAAGAGKVIITLGAQGSLFADGQRFEHFPAPRVKAIDTTAAGDTFVGGFAAALAAGKSEAEAIRFGQVAAALSVTRAGAQPSIPTLSDVQAFIPS

SEQ ID NO: 67257 - protein, 428 aa, Solanum lycopersicum
MNGDMNQQQQQQQLQQQQQQQWMAMQQYQQQWMAMQQYPPAAAMVMQQQMMYGQQYMPYYHQQHQQMIQIQQNASEDNRTIWIGDLQQWMDEGYLHTCFAQAGEVISVKVIRNKQTGQSERYGFIEFNTHEAAEKVLQSYNGTMMPNAEQPFRLNWSAFSSGEKRADVGAGAGSGSDLSIFVGDLASDVTDTMLRDTFSSRYPSVKGAKVVIDSNTGRSKGYGFVRFDDESERSRAMTEMNGIYCSSRAMRIGVATPKKPSPMQQYFPQAVILAGGHASNGAATQTSQTDSDLSNTTVFVGGLDSEVTDEELRQSFSQFGNVVSVKIPAGKGCGFVQFSERSAAEDAIEKLNGTVIGAQTVRLSWGRNPANKQFRTDSGSQWNGGYYGRQNYGGYGYGASQSQDSMYGAGAAHGASSNGYGNHEQSVS

SEQ ID NO: 67258 - protein, 484 aa, Alcaligenes faecalis
MKQFLNFINGEFVATAKTFDNRNPATNEVVGQVHEAGQAEVDAAVAAGRAALKGEWGQMSVVKRAELLHAVADEINRRFDDFLAAELADTGKPRSLASHIDIPRGAANFKIFADIVKNVPTESFQMTTPDGGTAISYGLRTPLGVVGVICPWNLPLLLMTWKVGPALACGNTVIVKPSEETPATATLLGEVMNAVGVPKGVYQVLHGFGPGSAGEFITKHPGVNGITFTGETRTGEAIMAAAAKGVRPVSFELGGKNAGIVFADADFDKAIAGITRSAFENCGQVCLGTERVYVQRPIFDKFVAALKAKAEGLKIGGPDMPGVGIGPLISAEHKQKVMGYYAKARAEGATVVTGGGEPAMTGEYANGHFVQPTIWTGLPESASVIREEIFGPCCHIAPFDTEEEAIALANATDYGLATTVWTQDLGKAHRMAAAIEVGLCWINSWFLRDLRTAFGGSKASGIGREGGVHSLEFYTELRNVMVKL

SEQ ID NO: 67259 - protein, 459 aa, Xanthomonas campestris pv. campestris str. 8004
MTDTPGRSDAATLERFGYAQELKRQLSLKDLLIYGLVFMVPTAPFSIFGGVFDISAGMVPLTYLVGFVAMLFTALSYQQMSQAFPVAGSVYAYVGRGLSGGMGFLAGWAILLDYLLVPTLLYVVGANAMHNVLPQVPQPAWIAFFVVLNTVVNLRGIETTARANRFFLYAQLIVLALFVVLATLAIQRGVNGAQWTLRPFYNPQAFSPQLIFSALSVAVVSFLGFDAISTLSEETRGGNRVVGRATLLALVLVAGLFVLQTWLAALLQPHLQRYPSAQASNDAFFEIGRLIAGPWMQIVIALTVAISAAIANSLVAQAATSRLLFAMARDRQLPAFLRYIHPRTGVPQRAILLVAALSMVLGEVFVGQIALLSSLCNVGALTAFVLLHVAVLWHFRAHGRKVLHGVVPVIGIVILAYVLINADLHAQLGGSAWMVVGLAVLAFLKFSGRSTEFRATDAL

SEQ ID NO: 67260 - protein, 504 aa, Debaryomyces hansenii CBS767
MMRLNNDSLTSIGSNKDKKLPPIPNSQENEAKTTNIIPNEDLILESKTLKRKNFKKLSLDSPSTTSTPSASQAENTSTDMGLRYPPSSKSGRIRPAPLMNLNRNSQGKLNINQSNRNIDPDTQSSTDVIINHFSNLELSNMNKRNPSIASRKRQTVISSISPTKSSASSPNDANLNSLNLTDQQSPIATTSSIKLNNNDLLTLKNLGSGNSGTVSKILHIPTQKTMAKKIIHIDLKSVIQTQIIRELRILHECQSPFIIEFYGAFINNNNTIVICMEYCNCGSLDKILPLCQNNQFPLFVLKKLSYAILSGLTYLYSTHKIIHRDIKPSNVLMNHKGEFKLCDFGVLRELTNSLAMADTFVGTSTYMSPERIQGLTYGVKSDVWSMGLMLIELARGIPVWVDDGEEEGPQGPEGILDLLQRIVNEAPPSLANKTNTTTNQPFDDILCKFIDSCLIKDDNLRKSPWDLLNEPQGFISGVEKGLYDKDVKVWAKGIRKLHKEKNES

SEQ ID NO: 67261 - protein, 418 aa, Robiginitalea biformata HTCC2501
MKKYHISRHHRFITVGLNYEKADAATRGLFALDDASTAVLLDRALEEGIDGLLVTSTCNRTELHGFAQAPQHLIRLLCDYSNGTEADFDRVGYVYQNQEAIGHLFRVGTGLDSQILGDFEIISQLKKSFKLSRKHGLANPFMERLVNAVIQASKRIKNETGISSGATSVAFASVQYLLARVPDIANKKILLFGTGKIGRNTCENLVKHTGHDQITLINRTQDRADALGRKFHVRVQPVEALREEIAASDVLIVATGATRPTVTAPMVPADKPRWILDLTIPFNVAREVGVKNGITLVDLDQLSRITDNTLQQRRSYIPQAESIIAEVHGEFNQWLESRRFAPVIRALKAKLKTMKEEELDNQARKIDGFDASQADVVTERIIQKITRHFANHLKDSDIDTDDSLELIQKVFQLEIPQR

SEQ ID NO: 67262 - protein, 620 aa, Oryza sativa Japonica Group
MESGLVASHRLRVPFAAAHHRHHPAAPPHLLRQRRGSVAATPLRLGLHLPTPTPLRLPAALPLRPSLPPLRAAAASAGDTGAGGTKTLKKIVPLGLMFFCILFNYTILRDTKDVLVVTAKGSSAEIIPFLKTWVNLPMAIGFMLLYTKLADVLSKEALFYTVIFPFIAFFGAFGYLLYPMRDAIHPTALADRLLAALGPSFLGPVAILRVWSFCLFYVMAELWGSVVISVLFWGFANQITTVEEAKEFYPLFGLGANVALIFSGRTVKYFSNMRQNLGPGVDGWAISLRGMMSIVVLLGLVIAGIYWGVNKFVIDKSAAPVVERKKKDKPKLSMGESLKVLVSSRYVRDLATLVVAYGISINLVEVTWKSKLKAQYPSPNEYSSFMGDFSTATGIATFTMMLLGRVILRKFGWGVAATITPAVLLLTGVGFFSLILFGEPLTPLMATLGMTPLLAAVYVGAMQNIFSKSAKYSLFDPCKEMAYIPLDEDMKVKGKAAIDVVCNPLGKSGGALIQQFMILSFGSLANSTPYLGGILLVIVLAWLGAVRSLDSQFSPLAKQELEKEKMLKAKTVETTAQVVGSGNGSLQETLASENSANGSAIKVSQEPESTTSEKSGQQSQ

SEQ ID NO: 67263 - protein, 372 aa, Candidatus Kuenenia stuttgartiensis
MGRDYYQILGVSRNAGSDEIKKAYRQLAMKYHPDRNPGNKESEQMFKEAAEAYGVLSDAEKKKLYDQYGEEGLKATGTRGYSSYEDIFDAFGDIFGGGSIFDEFFGKGRGGGEAGKRGASLKCDIEMGFKEVATGVEKKIELMRREICDACRGTGAKEGTSPVTCPYCGGKGQVQQSQGFFTLRTTCPKCRGTGKIIESPCRKCGGTKRYPRRATISVKIPAGVEDGTRLRLVGQGEPGENGAPSGDLYCDVHVTPHPIFQRHGNDVLCEVPISFAQAALGCKIDVPTLSGNIIQVKVPKGIQNNEIIPIKGEGFPNIHRHGKGNLLVQVVVETPTKISSRQEELLKEFAELEKNNISSRQKKFIEKMKQVS

SEQ ID NO: 67264 - protein, 541 aa, Picrophilus torridus DSM 9790
MEDNLKKSGLKRGFSLHDAAMFGIGGAIGSGILFAVAGGTTYAGPAIIISWIIAAIMIVIVTIPYAEFSAMAPRGGISARISYYSYGSYGGFMSGWSLFLWAVLIPPIEAVAVSEYASYYIKGLYSSVTGFLTPEGIALSIALTILFVFINLFGIRKFGIVNNVLTWFKILVVVAIIVIVPLFVFRPSNFTTPSFIPSNASGILIAIPATGILFSFGGYRQVADMAGEIKNPKRNLPRAIGITLAVQSIFYILMTIIVVGSVNWTGLKTAPGSWSVVGSLGSPIVTIIHSNIAYLHGYAVPVLSGLIILALIFAIFSPMGTFGVYLTGSSRIIFGFSREGAIPSFFGSTTKKGTPLYAIILVAVIGDLFLIPFPSWYTLTDFVVVAAVVNFAIVAASLPVIRKLYPEIERPFKVPFATAWSFVAFIASSILIYFATYPDTLYALGATLAGSVVFIYQAYKKHFQELSIKNSLWIPVYIIVMIIISYLGSSSTGGINLIKYPYDIVSVIIVGIVFWFVSQASAPRSVKGDMESLIKNAPEDV

SEQ ID NO: 67265 - protein, 468 aa, Anabaena variabilis ATCC 29413
MKYQIKRPNPLKTHPFLQKLQWIADPVEYMEKASLQHRDMFTAEVIGFGDTVVFVSHPQGIQTIFANDRKKLVAVGEANRILYPLVGNNSMFLLEGVKHKQRRQLLMPSFHGERMREYGHLIRNITETLFSQLQQNVTFSALTAMREISMQVILQAVFGFYEGERCQQFKHLLPVFLSELFQSPLASSILFFPFLQKDLGNLTPWGRFVRQREKIDKLLYEEIAERRQEINSDRIDILSLLISSRDETGNSMSDQELRDELITLMISGHETTGTAMAWSLYWILQTPEVFQRLIQELDSLGDSPDPMSIFRLPYLTAVCNETLRINPVAMLTLPRVVKEPVELLGNRLESGTTVVGCIYLTHHREDLYPESKLFQPERFLKREFSQYEFMPFGGGVRGCIGQAIAMFEMKIVLATVLSRYQFALADGKPERPQRQGFTLTPANGVKMLITGKHQRQNYSTAASTTFTT

SEQ ID NO: 67266 - protein, 542 aa, Desulfovibrio vulgaris subsp. vulgaris str. Hildenborough
MSTSPFNSRVAPMPHDDATAPVLHYAHDAAGAHDAADAAGAHDAADAAGTPPCAASRTARLRSLDAAHVWHPFTQMRDWMGSEPCIIDAADGNHLIDTDGNRYLDGVSSLWTNVHGHRHPHIDEAIRRQLDRVAHSTLLGLGGTPSIELAARLTAIAPAGLTRVFYSDSGSTAVEAALKIAFQYHRQAPEGDARRTRVMAFSNAYHGDTIGSVSLGGMSLFHGIYGPLLFDPVRAPAPHCYRCPADLRPETCGMACLGEVERLMRHHGHELCAVVVEPLVQGAAGMLVQPRGWLRGLRDLCDRHGVFMVADEVAVGFGKTGTMFACEQEGVVPDMLCLAKGITGGYLPLAATLVTEHIHDGFLGGYADFRTFFHGHTYTGNALACAAALASLDVFEEERTLETLRPRIERLATLLAPLNDLPHVGDIRRVGVMTGIELVADRETRTPYRPEERIGHRVTLEARRRGVIVRPLGDVMVLMPPLSITETELETLVHTVRGAIIAVTEHGADGGLWTKRPDGPDNPDKANTPDTPDGARTGETVV

SEQ ID NO: 67267 - protein, 373 aa, Zea mays
MARRSTPLLRRLLAPSPSLSTPLADAVSRRTVTYMPRPGDGAPRGVTLIPGDGIGPLVTGAVRQVMEAMHAPVYFETYEVHGDMPTVPAEVIESIRRNKVCLKGGLATPVGGGVSSLNVQLRKELDLYAALVNCFNLPGLPTRHDNVDIVVIRENSEGEYSGLEHEVVPGVVESLKVITKFCSERIAKYAFEYAYLNNRKKVTAVHKANIMKLADGLFLESCREVAKKYPGIKYNEIIVDNCCMQLVAKPEQFDVMVTPNLYGNLVANVAAGIAGGTGVMPGGNVGQDHAIFEQGASAGNVGNEKIVEKKRANPVALLLSSAMMLRHLQFPSFADRLETAVKRVIAEGKYRTKDLGGTSTTQEVIDAVIAKLG

SEQ ID NO: 67268 - protein, 733 aa, Saccharomyces cerevisiae
MSKNQSVSASEDEKEILNNNAEGHKPQRLFDQEPDLTEEALTKFENLDDCIYANKRIGTFKNNDFMECDCYEEFSDGVNHACDEDSDCINRLTLIECVNDLCSSCGNDCQNQRFQKKQYAPIAIFKTKHKGYGVRAEQDIEANQFIYEYKGEVIEEMEFRDRLIDYDQRHFKHFYFMMLQNGEFIDATIKGSLARFCNHSCSPNAYVNKWVVKDKLRMGIFAQRKILKGEEITFDYNVDRYGAQAQKCYCEEPNCIGFLGGKTQTDAASLLPQNIADALGVTVSMEKKWLKLKKLSGEPIIKNENENINIEFLQSLEVQPIDSPVDVTKIMSVLLQQDNKIIASKLLKRLFTIDDDSLRHQAIKLHGYTCFSKMLKLFITEQPQVDGKGNETEEDDIKFIKGILDFLLELPKTTRNGIESSQIDNVVKTLPAKFPFLKPNCDELLEKWSKFETYKRITKKDINVAASKMIDLRRVRLPPGWEIIHENGRPLYYNAEQKTKLHYPPSGSSKVFSSRSNTQVNSPSSSGIPKTPGALDSKKHKLSDEEYERKKQKRLEYERIALERAKQEELESLKQKLKLENERKSVLEDIIAEFNKQKELQKEESKKLVEAKEAKRLKRKTVSQSQRLEHNWNKFFASFVPNLIKKNPQSKQFDHENIKQCAKDIVKILTTKELKKDSSRAPPDDLTKGKRHKVKEFINSYMDKIILKKKQKKALGLSSASTRMSSPPPSTSS

SEQ ID NO: 67269 - protein, 1367 aa, Oryza sativa Japonica Group
MELSNQGQTPMSTNMGSQPLPSSNIQPNQAEYPSMFYPSLPADWGAQPMFSMGASVPISSYFIVPMSQQSVQIGASRPETPRSSGAHSLSRVSLRPPQQVLSIRTSLPTMVGSQHSPAGKKLQPTIASPKVQILKSTQSQSSNKRSAQKETPSKVQTQQLESVRSKFRESLSAALRTDSDQSKNQSSDVQPDGSADQKKEMDVDADQVATTSQGMSAAKSEVLTSVGAERRAEDEKLNSDLVSNIATPLNADIQQQPENASLQDEMLGQYTVVADELLQGHGLCWVSDFDAGVPEPATQPNLKRSRASDIDPVVADTLSESESKRMKSANDEEAIDKDSIIQKADDLAVRVEEELFKLFGGVNKKYKEKGRSLLFNLKDKSNPELRERVLSGDITPDRLCSMTAEELASKELSEWRLAKAEELAQMVVLPSTEVDVRRLVRKTHKGEFQVEVEETDGISVEVELGGNLLTQVPSKAPEDQTKSDDKESTDDKTGIQDNDKAPDGTSQDEDNGAGKNDPQDDLEYVDNEKSDLMQELMVDDLKDTENLPPIPSLDEFMQGLDSEPPFENLSAGTPEEDSDDRDEADTTAESAELPEEEVKVSAAEKIVSEADLPSSQDKSESKLESPKDEVGSNLGPVEQREGKLIKSSPDSVEVKQTTTENVLNRDSTVHNMATTLPMIRESIWEGAIQLTMSSLTNVVAIFKSGEKPPVKEWRSFVEIKGRVKLSAFQEFVEQLPKSRSRAIMVTELCWKEGSHESGRQHLLQTIDSYISDERVGLAEPADGIELYLCPSQGKTVEILSRHLPKEHLESLAVSASSIIGVIVWRRPNVPRMPAHPRHDGSRRPSILKKPQVTGSTPGPRPSLPMSSHGAPPGFPVQRHRHEEDVTDDVPPGFGPGVARDEDDLPEFNFVNSSNPAANVTTTQGLQGAGSMYPLPLLARLVLGMMMTTMIYQNGTPTSLSPNNSQQGSSQFHPHHSNRLPPPPPPPSLQQLHHPYQHQQQQQQQLYHHQNALQPQIPSNSIPQAYLRTQQPLQQLPLMQQQLQPAQAWQQTNAWWPAQGGAAAAAAQASMVQQSQYGVIPNSNNSAQSYGSGSESGSEDDDLDVGIGDVPSELEVKNSGLIPAQSKETERQLSKKEWKKKELAELDTVLAELGISGHAERKPDKQNGGDKNGAPQGPWRGGGYKSEEEITAVYMKEKMKKIASAKKKSGRGGWGCKACCKMEDAARSAKLAGAKKKEKTNSLSIDRLLPSPSSEFRMSTGLICSTCYYEVEVPGVGFAPRIDLKLCFASWLFLKSALRIGSTVTLKLMNKEYAAKESLKKFLRFFVGVPKRHFCLSLESKPAALSSHPLWQYPFTRNRRFAYSYYKL

SEQ ID NO: 67270 - protein, 286 aa, Anabaena variabilis ATCC 29413
MTNHSLFVGLVTLDLIYLAESAPKNNQKLVATDYTVAAGGPATNAAVTFSYLGNHAKVLGVVGSHPMTQLIRSDLTKYQVAIADLDPTINTPPPVSSIIVTQATGERAVISINAVKTQVSSDSIPPDILHNIDIVLIDGHQMTVGYVIAQMAKASRIPVVIDGGSWKPGFDQILPFVDYAICSANFYPPKCSSSGEVFAYLHNLGIPHIAITHGEKPIEYLSYGERGTVIVPKITAVDTLGAGDIFHGAFCHYILQESFTKALEYAAKIAADACRLFGTRRWMDVK

SEQ ID NO: 67271 - protein, 556 aa, Xanthomonas oryzae pv. oryzae KACC10331
MRQSHTLEVAEQRVPANQVETQLQRLHAAIESARGEMQQLRDRLHGALAREVGEFLELHALLLDDPELLQGLDELIRTHRYSADYALRVQRDRLAAVFDGMEDAYLKSRMDDLDHVIGRIHAFLHKRAPDLKGVAGEILVCDNVAPSELAQLQAQGVVGIVTTAGSALSHSAILARSLHLPLVVGVSEAVQRIEDGDVLIVDASSGQVIVDPKPEHLRDYRERLRALAKEQRELGRLRSKPTRTRDNVDITLLANAESLEDVAKAHALGASGLGLYRTEFLFLQRNELPDEDEQFHAYRDTVLGMSGRPVTIRTLDLGADKADRTGLTLVDEDNPALGLRGVRLSLARPAVAQTQLRAILRASGYGPVRILVPMVSGREEILLLRKQLKKLTAQLREEGHEIAEHIPLGAMIEVPAAALALDCFIDDIDFLSIGTNDLVQYLLAVDRNNEALGELYSPLHPAVLRLIAQVIATGRTHGKPVAVCGEIAGDPCFVPMLLALGLTEFSLHPATLLEVRRAVRDIHLGELGVHGEKLLSARDRKGIEKWLAGHAQGLLR

SEQ ID NO: 67272 - protein, 142 aa, Chlamydomonas reinhardtii
MDAARGAGGAVSDGAQPQDVATMHALLRSMGVEEFEPRVVNQLMDFMYKYTTDVLLDAEVFSEHAGRQPGQVDASGVTMAIQSRTALYVQPPPQERVTELARQVNDTALPDLVTKPGLPLPPEGKQMTAPNWQYDPQQQYQR

SEQ ID NO: 67273 - protein, 267 aa, Shewanella sp. MR-4
MDGLTGKVVIITGASEGIGRALAIAMARVGCQLVLSARNETRLASLALEIANYGPTPFVFAADVSSASQCEALIQATIVHYGRLDILVNNAGMTMWSRFDELNQLSVLEDIMRVNYLGPAYLTHAALPYLKSSQGQVVVVASVAGLTGVPTRSGYAASKHAVIGFFDSLRIELTDDNVAVTVICPDFVVSQIHKRALDGEGKPLGTSPMQEAKIITAEQCANMMLPVIATRGRLLITSLRGRLGRWLKLIAPGLIDKIARKAIASGR

SEQ ID NO: 67274 - protein, 356 aa, Rosellinia necatrix
MMGACMSSNKEDEEQKKRSQAIDRALDEDSKRLRRECKILLLGSGESGKSTIVKQMKIIHLKGYSEEELYNYRATVFKNLIECAKAVIIAMDQFEIEPSSEGTTDYCDYLRNYTVESGPSARIEAKVGIAVQALWNDPCIDRLMQHATEFYLMDSAGYFFDEVHRICAPDYLPNEMDVLRARTKTTGIYETKFQMGALNIHMFDVGGQRSERKKWIHCFENVTSIIFCVALSEYDQVLLEESSQNRMMESLLLFDSVVNSRWFMRTSIILFLNKVDIFKAKLPRSPLGNYFPDYSGGNDVNKAAKYLLWRFNQVNRAHLNLYPHLTQATDTSNIRLVFAAVKETILNNALKDSGIL

SEQ ID NO: 67275 - protein, 110 aa, Aspergillus nidulans FGSC A4
MGASEHVPPITSKAEFQEKVLNAKGFVVVDCFATWCGPCKAIAPTVEKFAQTYTDASFYQIDVDELSEVAAELGIRAMPTFLLFKDGQKVSDVVGANPGALEAGIKALLA

SEQ ID NO: 67276 - protein, 740 aa, Oceanobacillus iheyensis HTE831
MKAHRKIVSIIMIAALVFSLVNLPGTKTLANNQQSLESVLSDLTPEQKENYKQLQSVEQEGLFLSRDIDLKSEEQVKVIIQLDHHPEKIAVMESELKGQRISSKKAKSDVEEDQQQFKDNIASMFKGKSSNQYTLGKSYKNAMNGIAVELPANKIKEVLNFDVVRAIWSDVEVKIDPPIKEEKLDKEQIEPYMMESIPYLQIDKLHTEGYTGEGIKVGVLDTGIDYNHPDLEGVYAGGYDMVDDDNDPMETTYQDWIDSEQPEYNGSNSYYTEHGTHVAGTIAGEGDNSSEHRIKGVAPEVDLYGYRVLGPYGSGTSENVIAGIDRAIAEGMDVINLSLGAMVNDPLFPTSVAVNNAVLSGVTAVVSAGNAGNQDFTLGSPGTASLALTVGASDVPVDIATFDGAYGSETVDLQLMAKHFDDDLSSLVDTNLPIVDVGFGRASDYNDSPSVEGKIALISRGEIPFVDKITTTKEQGAEAILLYNNVDEGHIPSYLAEGVDYIPTFSLTKDDGEALKGILETDETFTFSNLDAITTEGDRLAEFSSRGPSKVNYDIKPEIVAPGVNIQSTVPSYINDQENGTYTFAYQRLSGTSMASPHIAGIAALLLQSNDQYEPEDVRSLLMNTADPLNGDYSVYEVGAGRVDPYEAVHSDLNFQVIDETTNLENGNEVEIEEITGGMSFGLKYVDKKDLKLKKELEITNAGDQDKVLKGNVEFTNQSLDPEENKVNFSIKNNVKIKSG

SEQ ID NO: 67277 - protein, 409 aa, Amycolatopsis orientalis
MSTHQVVFLLLDLAVIVVLARLLGAVARRLDQPPVIGELLAGILLGPTLFGEGFAAALFPTDVRPFLAALANVGVAMFMFMVGLELEQTLLRGRGKLALTVSVSSIVLPFTLGVGLAFYLAMNRPVEHRLGFLLFIGAAMSVTAFPVLARILQDRGMLRTMLGGLALTCAAIGDVLAWCLLAVVVIVSGGASGTEQWLIVLGPIYVALMLWVVRPLLRKLFTAGVTGALPTVLAGALISGAVTELIGLHFIFGAFLFGVIVPREGTDTLRHRIIDRVEEFNSALLLPVFFIVSGLKVNLSTLSATGLVEFGLVLLVAIAGKFGGAFVGARLHGLPARKSAALATLMNTRGLTELIILTVGLQLGVLDQSLYSIMVAMAVITTAMAGPLLRLIYPASVIERDQAIEQARL

SEQ ID NO: 67278 - protein, 348 aa, Ostreococcus tauri
MLRRPSAPRASPERSGHTSTMGLAVSRMEAAAGSMPPITDAEGDAAAEAAANAAKDSKPTTGTVNYNDLPCPVKYEEMQREVMMSLKADLFEGARFDYNKQLNQKFFLSHGFFLGNVEVPAQGGQIIKIPTSTYEFGANVVDQHYMLVGRVLTDGRVNGRIKYDLSDWLSVKLQSTKETGFSQVMFDADFKGLDYQAQLKYGSGQFYGVNYLQSVTPTLSLGGEGFYLGSQGKSGVGFAARYADDKTVATGQIATTGLLSLTYCTKVSEKAMLASDFLWNWNQRNATASVGYDYILRQCRIRGRIDNHGVVSTYLEERLNVGLNLILSAEVDHANKNHKFGFGMTVGE

SEQ ID NO: 67279 - protein, 174 aa, Glycine max
MASACLKLRNLSRGGGAFRCGRYSKLIHAEREREEEEEEVPSSRISRPLSEILKELNKKVPDSLVKTRLQKDQDASPIRFIPWHVVNRILNLHAPEWSGEVRNITYSADAKSVSVVYRVTLYGTDAEIFRESTGTASVEDTSYGDPVQKAEAMAFRRACARFGLGLHLYHEDAS

SEQ ID NO: 67280 - protein, 244 aa, Nostoc sp. PCC 7120
MSTDENKVIAITGASSGIGEATARLLARQGLRVMLGARRTDRLEAIAAEIRSKGGEAEYRTLDVTNLEDMQAFVEFAQDKFGRLDVVVNNAGLMPLSRLEVLKIDEWNRMIDVNIRGVLHGIAAALPLFKQQRSGQFVNLSSIGGHNVYPTAAVYCATKFAVWAISEGLRQESTDIRVTVISPGVTETELASTITDAEAAEWVEGFREAVIPADAIARAIAFAIEQPVEVDVNEIIVRPIGQMS

SEQ ID NO: 67281 - protein, 277 aa, Rhizoplaca chrysoleuca
VEHGDVKVVAVNDPFIEPHYAAYMLKYDSQHGQFKGTIEVNGNDLIVNGTTVKFYTEKDPANIPWKDTGAYYIVESTGVFTTTEKAKAHLKGGAKKVVISAPSADAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATA

SEQ ID NO: 67282 - protein, 442 aa, Candida albicans
MVNLLKKLHITKSHQSNHSNSDSNSLNSNTSMDNHQQQQQLQQYQQQFQQPQQQLYPGEQIVHPAAAQTGQNTTNVTAVSSSNITQSATSSLHSQQLQHVDVSKSAAEEAIRRSLLPERSTVSKGKYSLTDFSIMRTLGTGSFGRVHLVRSVHNGRYYAIKVLKKHQVVKMKQVEHTNDERRMLKLVEHPFLIRMWGTFQDSKNLFMVMDYIEGGELFSLLRKSQRFPNPVAKFYAAEVTLALEYLHSHDIIYRDLKPENILLDRNGHIKITDFGFAKEVSTVTWTLCGTPDYIAPEVITTKPYNKSVDWWSLGVLIFEMLAGYTPFYDSTPMKTYEKILAGKIHYPSFFQPDVIDLLTKLITADLTRRLGNLINGPADIRNHPWFSEVVWEKLLAKDIETPYEPPITAGVGDSSLFDHYPEEQLDYGSQGEDPYASYFLDF

SEQ ID NO: 67283 - protein, 280 aa, Rhizoplaca chrysoleuca
VEHGDVKVVAVNDPFIEPHYAAYMLKYDSQHGQFKGTIEVNGNDLIVNGTTVKFYTEKDPANIPWKDTGAYYIVESTGVFTTTEKAKAHLKGGAKKVVISAPSADAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATAGIS

SEQ ID NO: 67284 - protein, 351 aa, Solanum tuberosum
MGVQCQENILVTGGAGFIGTHTVVQLLNEGFKVTIIDNFHNSVEEAVDRVRELVGPQLSQNLEFHLGDIRNKDDLEKLFSKKEFAAVVHFAGLKAVGESVVQPFLYFENNLIGSITLYSVMAKYNCKKLVFSSSATVYGQPEKVPCVEDFELKAMNPYGRTKLFLEDIARDIQKADQEWNIILLRYFNPVGAHESGKLGEDPKGIPNNLMPYIQQVAVGRLPELNVYGNDYPTPDGTAIRDYIHVMDLADGHVVALQRLLRQNHLGCVAYNLGTGKGKSVLEMVAAFERASGKKIPLKMCPRRPGDATAVYASTEKAEKELGWKAKYGINEMCRDQWKWASQNPWGYQSKP

SEQ ID NO: 67285 - protein, 280 aa, Rhizoplaca chrysoleuca
VEHGDVKVVAVNDPFIEPHYAAYMLKYDSQHGQFKGTIEVKGNDLIVNGTTVKFYTEKDPANIPWKDTGAYYIVESTGVFTTTEKAKAHLKGGAKKVVISAPSADAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATAGIS

SEQ ID NO: 67286 - protein, 148 aa, Candidatus Kuenenia stuttgartiensis
MQYSAKVMDHFANPRNVGEVAEADGVGEVGNPACGDIMKMSIKVKDNVIVDAKFKTFGCGAAIATSSISTEMIIGKTLDEALRLTNKAVAEALDGLPPAKMHCSVLAEEAIEAAIDDYLKKTTGKGLEKKKGHSHEEHHHHEPDFRPN

SEQ ID NO: 67287 - protein, 576 aa, Xanthomonas campestris pv. campestris str. 8004
MSLRLRGHAASRGNALGRARVRQSHTPEVAEQRVPANQVETQLQRLHAAIAAARTEMQQLRDRLHGALAREVGEFLELHALLLDDPELLQGLDDLIRTHRYSADYALRVQRDRLAAVFDGMEDAYLRSRMDDLDHVIGRIHAFLHKRAPDLKGVAGEILVCDNVAPSELAQLQAQGVVGIVTTAGSALSHSAILARSLHLPLVVGVADAVQRVNDGDVLIVDAGSGQVIVDPTPEHLRDYRERLRTLAKEQRELGRLRSKPTRTRDNVDITLLANAESLEDVAKAHALGASGLGLYRTEFLFLQRNELPDEDEQFHTYRDTVLGMSGRPVTIRTLDLGADKADRTGLTLSDEDNPALGLRGVRLSLARPAVAQAQLRAILRASGYGPVRILVPMVSGREEILLVRKQLKKLTAQLRDEGHEIAEHIPLGAMIEVPAAALALDCFIDDIDFLSIGTNDLVQYLLAVDRNNEALGELYSPLHPAVLRLIAQVIATGRAHNKPVAVCGEIAGDPRFVAMLLALGLTEFSLHPATLLEVRRAVRDLHLGQLRVHGEKLLRARDRKSIEKWLASVAQGLLH

SEQ ID NO: 67288 - protein, 277 aa, Rhizoplaca chrysoleuca
VEHGDVKVVAVNDPFIEPHYAAYMLKYDSQHGQFKGTIEVKGNDLIVNGTTVKFYTEKDPANIPWKDTGAYYIVESTGVFTTTEKAKAHLKGGAKKVVISAPSEDAAMFVMGVNEKEYKPDIEIISNASCTTNCLAPLAKVMHDNYTIIEGLMTTIHSYTATQKTVDGPSSKDGRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATA

SEQ ID NO: 67289 - protein, 494 aa, Parvularcula bermudensis HTCC2503
MLRFIDTPRQTPEKRAAELRREDFEEVYSGFKERQAEAQASRCSQCGVPFCSSGCPLGNHIPDWLRLAAEDQLEEAWRLSESTSNMPEICGRICPQDRLCEGSCVIEQSGHGTVTIGAVEQYITDNAWSKGWIKPIAPARERPQSIGIIGAGPAGLSAADELRSLGYRITVYDRYDRAGGLMTYGIPGFKLEKSVVMRRVKRLADSGVTFVQNADIGGGVPFSDLREKHDAILIATGVYKARELSVPGVGANGVVRALDYLTASNRKGFGDEVPGFDEGHMNAHGKRVVVVGGGDTAMDCVRTAIRQDAASVTCLYRRDRENMPGSAREVVNAEEEGISFRWLSNPKLLLGDANKLDGIRVARMRLGPPDASGRQSPEEIPGEDADLAADMVIKALGFSPEDLPTAFDEPDLALTRYGTLKVDPSSYETSLPGVFAAGDIVRGASLVVWAIHDARRAAASIHQYFKGQTVGAIPETVGEQQTDYDPRTYEPVAP

SEQ ID NO: 67290 - protein, 159 aa, Marinobacter sp. ELB17
MRIGQGFDVHAFCEGDRIILGGVSIPYSCGLKAHSDGDVLLHALADALLGALALGDIGHLFPDTSADWAGADSRDLLRRVMQRVQELNYSVVNVDVTIIAQAPKMAPHINAMRVNIAQDLNMTASQVSVKATTSEQLGFTGRGEGIACQAICLLQAQNS

SEQ ID NO: 67291 - protein, 353 aa, Rosellinia necatrix
MGCGMSTEEKEGKARNEEIENQLKRDKMMQRNEIKMLLLGAGESGKSTILKQMKLIHEGGYSRDERESFKEIIFSNTVQSMRVILEAMESLELPLEEPRMEYHVQTIFMQPAQIEGDVLPPEVGGAIEALWKDHGVQECFKRSREYQLNDSARYYFDNIVRIATPDYMPNDQDVLRSRVKTTGITETTFIIGDLTYRMFDVGGQRSERKKWIHCFENVTTILFLVAISEYDQLLFEDETVNRMQEALTLFDSICNSRWFIKTSIILFLNKIDRFKEKLPVSPMKNYFPDYEGGDDYAAACDYILNRFVSLNQHETKQIYTHFTCATDTTQIRFVMAAVNDIIIQENLRLCGLI

SEQ ID NO: 67292 - protein, 354 aa, Rosellinia necatrix
MCFGSRKTDEAGDARSRELDKIIKQDEKRMLKEVKLLLLGAGESGKSTVLKQMKLIYAQGFSKTEKLEWKPVVLINVIQSLRLIFDAMEDYNIEFERKENEKNKELVLLDVEIGPNDPLPQDYLQPIKSLWADSGVQKAILKGNEYALHDNIAYFCDDVDRLWDKNYIPTDQDLLRTRLRTTGITETVFDLGQLTYRMFDVGGQRSERKKWIHCFENVHCLLFLVAISGYDQCLVEDKDGNQMNEALMLWESIANSHWFAKSALILFLNKMDLFKEKLVSSPITSYGFTDYRGPADDHKLASKYFMDKFKALNRNPEKEIYGHFTNATDTNLLKITMTSVQDMIIQRNLKQLIL

SEQ ID NO: 67293 - protein, 338 aa, Anabaena variabilis ATCC 29413
MNAHRGSAVLSSATFKMQPTATGLTENHRLRLFSGSSNVQLSQEVARYLGMDLGPMIRKRFADGELYVQIQESIRGCDVYLIQPCCQPVNDHLMELLIMVDACRRASARQVTAVIPYYGYARADRKTAGRESITAKLVANLITQAGANRVLAMDLHAAQIQGYFDIPFDHVYGSPVLLDYLTSKQLHDLVVVSPDVGGVARARAFAKKLNDAPLAIIDKRRQAHNVAEVLNVIGDVKGKTAVLVDDMIDTGGTIAAGAKLLREEGARQVYACATHAVFSPPAVERLSSGLFEEVIVTNTIPIPESDRFPQLVVLSVANLLGETIWRIHEDTSISSMFR

SEQ ID NO: 67294 - protein, 431 aa, Marinobacter sp. ELB17
MTTIANIKAREVLDSRGNPTVEADVILKDGTLGRACAPSGASTGSREALELRDGDASRYLGKGVLKAVDAINGKIRDALMGKDAADQRGLDNTMLELDGTENKANLGANAILAVSLAAAKAAAASLGKPLYEHIADINGTSGKYSMPVPMMNILNGGEHADNNVDIQEFMVQPVAAKSFADALRIGAEIFHSLKKVLQAQGLNTAVGDEGGFAPNLPSNEAALAMIQEAVEKAGYKLGTDITLALDCAASEFYKNGQYLLAGEGKSFDSAGFADYLAGLAERYPIVSIEDGMDESDWDGWKILTDKIGDKVQLVGDDLFVTNTKILKRGIDTGVANSILIKFNQIGSLSETLDAIKMAQDAGFTAVISHRSGETEDTTIADLAVATCAGQIKTGSLCRSDRVAKYNQLLRIEEALGGKAAYNGLREIKGQG

SEQ ID NO: 67295 - protein, 190 aa, Triticum aestivum
YGPRTCSCRRGLRRRGRSRRKGSSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 67296 - protein, 506 aa, Burkholderia pseudomallei K96243
MGGRGSPLPDSTDSEENLMGKITGFLEYERRHEAYEAPLTRVKHYKEFVAALTDADAKIQGARCMDCGIPFCNNGCPVNNIIPDFNDLVYRQEWRQAIDVLHSTNNFPEFTGRICPAPCEAACTLGIHDDPVGIKSIEHAIIDKAWAQGWVAPQPAAHKTGKKVAVVGSGPAGLAAAQQLARAGHDVTVFEKSDRIGGLLRYGIPDFKLEKWLIDRRMRQMEAEGVTFRTSVFVGRDPLPETIGNMAKETISPETLKDEFDAVVIAGGSETPRDLPVPGRELAGIHFAMEFLPQQNRVNAGDKLADQLLAKGKHVVVIGGGDTGSDCVGTSNRHGAKHVTQFELLPQPPEAENKPLVWPYWPIKLRTSSSHEEGCERDWAVATKRFEGRNGKVEKLIAARVAWVDGKMQEVPDSEFEIKADLVLLAMGFTQPAAPVLEAFGVAKDARGNARAGTEGDRAYYTSVDKVFAAGDMRRGQSLVVWAIREGRQCARSVDAYLMGSSELPR

SEQ ID NO: 67297 - protein, 200 aa, Zea mays
MAATKVCNVRFEGNVITTTVTASGAAVESWLDEILSVHRRRLHKLVVGLDVEWRPSFSRAYSKTAIVQLCVGRRCLIFQLLHADYVPNTLDEFLSDPDYTFVGVGVAADVERLENDYDLEVANAEDLAELAAKEMGHPDLRNAGLQGIARVVMDAHVEKPQWVRTGPWDASSLSDEQIEYATIDAFVSFEVGRMLLSGYY

SEQ ID NO: 67298 - protein, 261 aa, Mycobacterium avium 104
MTAGTPAPDSAGDRETELTHALAAVRSRLAAAAEAAGRNVAEIEVLPVTKFFPATDVVTLSRLGCRAVGESRDQEATAKVAEVTRLLATSARTNVAIPRWHMVGHIQRNKARSVARWAHTAHSVDSTHLVSALDRGVAAALADGGRIDPMRVYVQVSLDGDESRGGVDISRPGAVDEVCAQVAAANNLDLVGLMAIPPLNSDPDEAFDRLQSEHRRVLETHRNAVGLSAGMSDDFEIAVKHGSTCVRVGTALLGRRPLPSP

SEQ ID NO: 67299 - protein, 417 aa, Oceanobacillus iheyensis HTE831
MEDPNLEANRQDKKSFIQKVKSVGPGAIIAASFIGPGTVTTSTQAGASFGYALIWAVLFSILATIVLQEMSARLGIISKKGLAEAARDQFNHPAIKYPIIGFIIMAIYVGCTAYMSGDLRGTSLGLEALTGVSINIIGPIVGILILLLGLSGSYKLIEKLMVFFVVLMSIIFITTMFIAQPDIGGVLSGMFVPSIPVGSIITIIALIGTTVVPYNLFIHSSSVQERWSRPEQLKDSRRDIYFSIGVGGLITIAIVITSGTLMRGVEVGSVIDLAIQLEPLLGGFAESFLAIGIFSAGFSSATASALGAAITVSSMLKWENGMKNWKFKAVFSSVIIIGILSFVFRFEPLDVLLFAQALNGILLPSIAILLIVIMNNKKLLGSYANSTIINIIGIVVVVICTGLGIYSLVTAIQGFIG

SEQ ID NO: 67300 - protein, 229 aa, Alkalilimnicola ehrlichei MLHE-1
MGRLEVREFHRVTGRAWDLGTLAHDPAFWRAHVPHAAWRILFRGGTERPFSSPLDERYEDGTYVCAACHLPLFSSDTKFDSRTGWPSFYQPFPGHVGTKQDRLLWMVRTEYHCIRCRGHQGHVFEDGPAPTGRRWCNNGLALRFAPATGHADDEERATALFAGGCFWCVEEAFDGGGQFCDRSTFYPAEEYHQNYYQKNPLRYRFYVTRCGRYARLDQLWGSEARPGKD

SEQ ID NO: 67301 - protein, 248 aa, Clostridium difficile 630
MIILKSKKEIELLREAGKIVADTHEVLRKAISPGISTLELDKIAEENIRKYNAEPSFKGYGGFPGSICASINREVVHGIPGETILQEGDIVSLDIGAYYKGYHGDSAKTHGVGMISEEDRKLIEVTRESFYEGIKFAKLGYRLSDISHAVQTHVEKHGFSVVRDLVGHGVGANLHEDPQVPNYGLPGKGPRLREGMVIAIEPMVNAGRYHVKTLSDGWTTVTIDGKKSAHYEHTIAITEHEPLILTKL

SEQ ID NO: 67302 - protein, 1083 aa, Solanum tuberosum
MDPEGDVKGKSLKTLGGQVCQICGDGVGTTVNGEPFVACDVCAFPVCRPCYEYERKDGNQSCPQCKTRYKRHKGSPAISGESVEDGDADDGASDLNYSSENLNEKQKVADRVLSWHATYGRGEETGAPKYDKEVSHNHIPLLTNGTDVSGELSAASPERYSMASPGPAGGAKHIHPLTYSTDANQSPNIRVVDPVREFGSPGIGNVAWKERVDGWKMKQDKNVVPMTTSHPPSERGVGDIDASTDILGDDSLLNDEARQPLSRKVSIPSSRINPYRMVIVLRLVILCIFLHYRIMNPVPNAIPLWLLSVICEIWFAVSWILDQFPKWLPINRETYLDRLALRYDREGEPSQLAAVDIFVSTVDPLKEPPLVTANTVLSILAVDYPVDKVSCYVSDDGAAMLTFEALSETAEFARKWVPFSKKYSIEPRAPEWYFSQKVDYLKDKVQTSFVKERRAMKREYEEFKIRINALVAKAQKVPEEGWIMQDGTPWPGNNTRDHPGMIQVFLGQSGGLDSDGNELPRLVYVSREKRPGFQHHKKAGAMNALVRVSAVLTNGPFMLNLDCDHYINNSKALREAMCFLMDPNLGKYVCYVQFPQRFDGIDRNDRYANRNTVFFDINLRGLDGIQGPVYVGTGCVFNRTALYGYEPPIKPKHKKAGFLSSCFGGSRKKGSNSSKKGSDKKKSSKNVDPTVPIFNLEDIEEGVEGAGFDDEKSLLMSQMSLEKRFGQSAVFVASTLMENGGVPQSATPETLLKEAIHVISCGYEDKSEWGTEIGWIYGSVTEDILTGFKMHARGWRSIYCMPKRPAFKGSAPINLSDRLNQVLRWALGSVEILFSRHCPIWYGYNGRLKWLERFAYVNTTIYPITSIPLLIYCMLPAICLLTGKFIIPQISNLASIWFISLFLSIFATGILEMRWSGVGIDEWWRNEQFWVIGGVSAHLFAVFQGLLKVLAGIDTNFTVTSKATDEDGDFAELYLFKWTTLLIPPTTLLIVNLVGVVAGISYAINSGYQSWGPLFGKLFFAFWVIVHLYPFLKGLMGRQNRTPTIVVVWSILLASIFSLLWVRIDPFTTRVTGPDVQACGINC

SEQ ID NO: 67303 - protein, 280 aa, Rhizoplaca chrysoleuca
VEHGDVKVVAVNDPFIEPHYAAYMLKYDSQHGQFKGTIEVKGNDLIVNGTTVKFYTEKDPANIPWKDTGAYYIVESTGVFTTTEKAKAHLKGGAKKVVISAPSEDAAMFVMGVNEKEYKPDIEIISNASCTTNCLAPLAKVMHDNYTIIEGLMTTIHSYTATQKTVDGPSSKDWRGGRTAAQNIIPSSTGAAKAVGKVIPSLNGKLTGMSMRVPTSNVSVVDLTCRLEKAVSYDEIKATMKKASEGELKGIMAYSEDALVSTDLNGDNHSCIFDATAGIS

SEQ ID NO: 67304 - protein, 274 aa, Zea mays
MAATAISVRLHPTAARHVASARRARLGAVRAQSAPAAAAAALTQDDLKRLAAVRAVEQVKSGMVLGLGTGSTAAFAVAEIGALLAAGKLEKIVGVPTSKRTFEQAQSLGIPLSTLDDNPLIDLAIDGADEVDPDLNLVKGRGGALLREKMVEAASDKFIVIVDETKLVDGLGGSGLAMPVEVVQFCWKYNLVRLQELFKEEGVEAKLRFEGDKPYVTDNSNYIVDLYFKTPIKDALAAGQEIAALEGVVDHGLFLNMASSVIIAGTDGVSVKTK

SEQ ID NO: 67305 - protein, 244 aa, Ostreococcus tauri
MTTSVTRARIGRDGSLGRRTATASASDASGWNFLRRCRTMFVQTQATPNPESLMFQPGRDVYAEGSRNFGSAREAMVSPLARRLFAIDGVTNVFLGVDFITVTKDADHDWETVKPRTFEAIMDFYASGEAVVDEASLEGHGTAIEEDDDEVVAMIKELLETRIRPAVAEDGGDIVFKAYDQETGVVSVQLMGACDGCPSSSVTLKSGIENMLMHYVPEVKGVQQWSPEDELDILELANLHRGRR

SEQ ID NO: 67306 - protein, 371 aa, Glycine max
MAKASIFIYILVAAALLIFLSHSPDKHSGHRHRRLKLRSNFTLAPSRHHAVAFDPLVAELERHREDKEWEKKIIHQALPELESDPAPAHESQPEWEDFMDAEDYLNDEDKFNVTNRLILLFPKIDVDPTDWFVTEHELIQWNLQQAQREVLHRTQREMELHDKNHDGFVSFSEYDPPSWVQNADNESFGYDMGWWKEEHFNASDADGDGVLNLTEFNDFLHPADSKNPKLHQWLCKEEVRERDTDRDGKVNFKEFFHGLFDLVRNYDEESHNDTHNSDNSMDAPARVLFAQLDKDGDGYLSDVELQPIIGKLHPSEHYYAKQQADYIISQADEDKDGRLTLTEMIENPYVFYSAIFNDDEDDDSDYHDEFR

SEQ ID NO: 67307 - protein, 519 aa, Parvularcula bermudensis HTCC2503
MVTSPHHLASQAGLDVLREGGTAIEAAIATGACLAVVYPHMNALGGDSFWLIVPPSGAPRAVMGVGKAAADAGLYRGRGLSTIPTRGGLAANTSAGLVEAWRVAREQDPGEGTLPLKRLFDDAIFHAENGVPVTAGHAALAQGKDKELTGDPGYDAIYRPGGKFLVEGERLSQGALAQTLRGLAARGLRDFYEGDIARALTDDLEKAGSPVTAAHLARQEARVVPPLKCCLQNQIEVLNTPPPTQGLVSLLILALFDRIAPDPTEGVDFVHRAVESFKAARRIAAKARLGDPSLMTSDAQSLLDDHAHLNDVAQAIDLGRASPWPDPGSDGGTVWFGAVDRDGTMVSVIQSIYHEYGSGVVLPETGVTWQNRGASFGLKESDPNPIAEGREPFHTLNPAAALLPDGQRMIYGTMGGEGQPQTQSAIFIRRLLFGQPLQAAITAPRWLLGRTWGAATNSLKIEDRMPEDVVEALRAAGHDVELFPSFDSAMGHAGAILRHTHGRLEGATDPRSDGSVAAW

SEQ ID NO: 67308 - protein, 395 aa, Haloarcula marismortui ATCC 43049
MSYKIGLVGKPSVGKSTFFNAATMNDVPEGAYPFTTIDPSMGEAYVRVDCAAPEFDHTCTPNHGYCTEGVRFVPTKLVDVAGLVPGAHEGKGLGNQFLTDLNEADVLVHVVDFTGETDLEGEPTEDHDPREDIDFLEDELDMWYLDILEKGIERYRSGYHGEDKAIEDDLAEQMSAFKINADEIKQVVLALDLELDPDTWDDEDREALAREIRIRTKPMLIAANKMDTPAAQENWEPITEDPEYEHLTFVPVSAHAEKALKNGNEQGVLDYRPGDEEFTVTADLPEEKAAGLEQIREFVTDFGGTGVQQALETALFEELGAIAVFPGARKPQEDGTFLQDCFVLPDGSTAEDFAYFLHTDIGEGFLHAHDVRTERQIGADTELDHRDVVEITTTN

SEQ ID NO: 67309 - protein, 390 aa, Parvularcula bermudensis HTCC2503
MGPGPANAHPRVLRAMAADLLGQFDPEFTAYMEEVMALYRPIFGTTNRWTFLIDGTARAAIEASLVSLTRPGDRVLVINFGRFGLLLEEILTRIGAKISRLDIPWGEVAAHDQIAAAIDEAAPQVVATVHGDTSTTTAQPLAGLGALCRAAGAYSYVDATATLGGMPFYTDEWELDVVTCGLQKCLGGPAGSAPITISDRAAEAIFARRHIEKGLSQGEAGGPAPRIQSNYFDLAMIMDYWSEKRLNHHTEATSMLYAARECARLALEEGLEARWARHHRAGKAMVAGLRAMGLTVYGQDAYRMANVTGVFIPEHVDGEAVRRRMRTEFEIEIGGAFGPLTGKIWRIGAMGVNARTHKVLITLGALEAVLRAEGLAVPAGAAVDAARSTF

SEQ ID NO: 67310 - protein, 254 aa, Picrophilus torridus DSM 9790
MYSISGSMYSYGIGNTPLLNLDGIYAKAEYKNKFGSIKDRAAFFMISSVMDKIGNKIIVEASSGNTGIAVAGISRELGIKSIIVIPEGASDGTKAMLSRIGVDYITTPGNSTEQSIKYVENLIKSDPQKYLRLNQHSNDMNYLSHYMTTAPEIEHDMGKPDTIVIGIGTGGTISGISKYFKEKYHDVKVIGIIPDENSRIFGLRNPFLSVNHGIIDKNINYIDDVFIISEDAALKGVSELLSKYNLFCRPLVGC

SEQ ID NO: 67311 - protein, 513 aa, Zea mays
  misc_feature (204)..(204): Xaa can be any naturally occurring amino acid
MAASARTTSSLPYLVAVSSPAAHRHGASHPIRASVGEATMDVVSEAELREKGFLGMRKTKLVCTVGPACVEALPALARGGMGVARINLCHGGREWHRAAMRSVRRLNEEGGFCVTLMVDTEGSQLLVADHGGATSVKAEDGSEWIFTNKKADEAHQFTMHVNFDKFSEGILVGDELVIDGGMATFEVTEKIGNDLRCKCTDPGXWADIEFGIAEGVDCIALSFVNDANDIKQLKAYLSRRSLEHIKVFAKIESLESLKNLKDIIEASDGVMVARGDLGVQIPLEQIPAIQESIVKLCRHLNKPVIVASQLLESMVEYPTPTRAEVADVSEAVRQYADAVMLSAESAIGAYPQKALSVLRAASERMESWSREENMQKLLPRHQLAIALPDRISEQICSCAVEMANNLAVDAIFVYTKHGHMASLLSRNRPNPPIFAFTDNANSRKSMNLYWGVIPLHLPLSNSMEDNFNKTISLMRSKGSVKPGDTVLVVSDSDLNQPCAATSVFQSIQVRLVE

SEQ ID NO: 67312 - protein, 325 aa, Mesorhizobium sp. BNC1
MVKAIRLRETGGPEILRLEDYDPGKPGPGEALIEQRAIGLNFIDVYHRTGLYPTAKPFTPGSEAAGVVLEVGEGVEDLKPGDRVAYCVATGGAYAEQRLVRADRLVRVPDAVSDEQAASAMLKGLTAWYLLRRTFPVKAGDTILCHAAAGGVGLVLGQWAKHLGAKVIGTAGSPEKVELAKAHGYDHVIDYTKEDFVAAVGELTSGGKCDVVYDSVGKDTFPGSLDCLRPFGMFVSFGQSSGVVPPFSINLLAQKGSLFATRPSLFTYIAARKDLEEGAQELFSMIERGAVQVRVNQRYPLADVGRAHKDLEARRTTGMTVLIPG

SEQ ID NO: 67313 - protein, 491 aa, Anarthria scabra
SSSPVVSTIEEKNMGRIAQIIGPVLDVVFPPGELPNIYNALVVQGRDLVGQQINVTCEVQQLLGNNRVRAVAMSATDGLMRGMEVIDTGAPLNVPVGGATLGRIFNVLGKPVDNLGPVDTSTTSPIHRSAPAFIELDTKLSIFETGIKVVDLLAPYRRGGKIGLFGGAGVGKTVLIMELINNIAKAHGGVSVFGGVGERTREGNDLYIEMKESGVINEKNLAESKVALVYGQMNEPPGARMRVGLTALTMAEYFRDVNKLNVLLFIDNIFRFVQAGSEVSALLGRMPSAVGYQPTLSTEMGSLQERITSTKGGSITSIQAVYVPADDLTDPAPATTFAHLDATTVLSRGLAAKGIYPAVDPLDSTSTMLQPRIVGNEHYETAQKVKQTLQRYKELQDIIAILGLDELSEEDRLTVARARKIERFLSQPFFVAEVFTGSPGKYVGLTETIRGFQLILSGELDGLPEQAFYLVGNIEEASAKAMNLEGENKLK

SEQ ID NO: 67314 - protein, 442 aa, Picrophilus torridus DSM 9790
MIDDESRTLEYNEKALKLSEFYKGKVGIVPKVPVRSLDDFSVWYTPGVAAVARKIAENRDLSFELTGRWNSVAILTDGTRVLGLGNIGPEAAMPVMEGKSLIFNYLGGVNAVPIPVRAASEDDFIRVAMALEPSFGGFNLEDIESPKCFSILEKLQKTLEIPAWHDDQLGTASITLAGVINALRVVNKKIDDVRVVFNGAGAANIAAAYLFNEAGFKMKNMVMIDSSGILEPERPDMDRLMLNNPLKYKLAIDTNEDRLKGNLMDAVNGADIIISASKSQPGIIRPEHIKLMNRDPIVFALANPLPEIWPRDAINAGARIVATGRSDFNNQINNSLVFPGVFRGILDARARKVNFKVMVSASYEIANAVKNPDENHIVPDMSNWELYPRVAAAVASKCSELGFARKAGDYNTFLKRATDIIEENRRLYDTLIEKNIIKIAMR

SEQ ID NO: 67315 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIVQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 67316 - protein, 425 aa, Sulfolobus tokodaii str. 7
MEEKKLSLSQALALGLGNIIGAGIFVMAGVSITAAGPAALLAFLITAVYAMSVGLNNAELASVFPKVEGGVYSFALLSLGETIGFLVGWFRVIGYAISGGATALGFSGYLITTFSLPSFLYFLLAILLIIVLIIIDYLGLKLAAEIESILVVLNILGLVIFSITALVISGIRLQNFSPFLPHGITGVLTASNIAFFAYSGFNTIATLTPSVKEGERTVPKAIVLSLLISAFLYMLVTFSMVDAIGYKNFKTNSAPLQLVLSTIHAPFYVYFFVNLTAILATITVTLSTIIATERTMVQMELDNLLPKVKGGKLSILLIIGLVMIASLGLGNVEVIALVSNFGIVFSYMLSGIEVAVVRHRGLRGVFKSPGFPFVQIISVILSGVFIYSLGFQSLLIGFVTLLIGLVIHSIHKEIMKKEGIFSRKK

SEQ ID NO: 67317 - protein, 240 aa, Arabidopsis thaliana
MVLLSEIPGGSNGDDPNMNPQELPEELIESIVAPIPRCYYPSLSLLSRAFRHVITSQQLFVTRSGLGFKEPVLYAFIGCTPYTTPRWFILRRSNIPLQLRRLNSLPHMFPGAAVVTIGYKIYVMGGYNYQPVSTVIIIDCRFHTWHYLQDMQRARYHATPGVIDGRIYVIGGRKKQDADWVEVFDVTTESWETVPTQCPNEASENGLFVTYAVMQGRILGVFLLTNQDKVYGSHWELYVS

SEQ ID NO: 67318 - protein, 505 aa, Mycobacterium avium 104
MATQKPQTISYPAPEARPRRHHTDPLDPHVIVLFGATGDLAKRKLIPGLAYLDQSELAPDIQIVATSLEDLSNDEFRELAKNAIDSFGTHKLTPDQWRNFADIITYIPQSAGSDALAAAVAEAEAKLGPNVRRLHYLSVPPKAARAVITMLRDAKLVERSRVVMEKPFGTDLASAVALNDFVHQTFEESQIFRIDHFLGKEAAQNILAFRFANGLFEPIWNRNFIDHIQIDIPEALGLDQRASFYEDTGAYKDMVVTHLFQVMAFVVMEPPTALEPFAISEEKNKVFRSMLPVKPSNVVRGQYIGYREEDGVAKDSDTETFIALKVGIDNWRWAGVPVYLRTGKRMAEGIRIISIAFKEAPRTMFPPGSGVGTQGPDHLTFDLADNSRVSLSFYGKRPGPGMKLDKLSMQFSTQEIETAVDVLEAYERLILDAMRGDHTLFTTAEGIESLWERSEELLNDPPPAKLYQPGTWGPNAIHQLIAPNAWRLPFEREWRDPRPYPGVGG

SEQ ID NO: 67319 - protein, 120 aa, Glycine max
  misc_feature (52)..(52): Xaa can be any naturally occurring amino acid
  misc_feature (82)..(82): Xaa can be any naturally occurring amino acid
  misc_feature (99)..(99): Xaa can be any naturally occurring amino acid
STIEAKTRDYFDGVAPQRHTKPQRKFMQFQRLENDPQEKKLEYNGSQVPEEXVETEYYQDLNSVDKHHHTTGTGFIKVEKNXNDFHIEPDNDTGWHHSXKCNPATNDWVPSPSNEGGFNS

SEQ ID NO: 67320 - protein, 394 aa, Clostridium difficile 630
MLSKRLNFITPSYTIGISSKVKEMESNGVKVINLSIGEPDFNVPNNAKSYGIDSLNKDYTKYDLVPGLKILREEICKKLIEENNCNYSIDEIVVSSGAKNSITNTLLALTDEGDEVLLPKPYWVSYPEMIKLVNAVPVFIDTKKENGFKLTKEELEKSITDKTKILVINNPSNPTGSVYTKDELIEIVDVCIQNKIYILADEIYEKICYTGEFTSIASLSEEAKDITITINGFSKSAAMTGLRLGYTASNKTIAKAMSSIQGHLISHPSLTAQYIAYGALKDCSIDIDNMVKTYKSRRDLIKSKLDSIDNVGYVNPNGAFYIFIDLSKVSEKFEYKDSFSIEFCNQFLEEYNVAVVPGIAFGMDKYIRISYACSENTFLSGLDKLKEFVYKIMA

SEQ ID NO: 67321 - protein, 352 aa, Arabidopsis thaliana
  misc_feature (108)..(108): Xaa can be any naturally occurring amino acid
MGIHFVDKADLWKSALLFNLKLRDRFRIAVDDHRGRATVFSPDGCFSSTIHRWVTRFRNFRRESLPSPPAFYRRRVSKDLTAEEESALFRMLQTVAVPLIGNACHVFXMDIAISKLNNGGWVHIFPEGSRSRDGGKTMGSAKRGIGRLILDADTLPMVVPFVHTGMQDIMPVGASVPRIGKTVTVIIGDPIHFNDILSTEGAQHVSRKHLYDAVSSRIGQRLYDLKAQVDRVYIEQQSMMSHNAKTPSDRAAEIFHRVDWDSFGMGAQFSEESSPSSKPIGQSDDRIVRSPKRRVSPEGGVSLKIKKLMDSTEMMGFAARGLLMNEYKSRVESANVGRPLKAWREYFMNRGL

SEQ ID NO: 67322 - protein, 174 aa, Magnetospirillum magnetotacticum MS-1
MNIKDHIRGVPDFPKPGILFYDISTLLAHPDAWQVAMGRMAREIIKFQPDVLAGIESRGFLVAAPLALKLGCGFVMLRKNGKLPGETIRHDYELEYGTDTIEIQKNAIAEGSRVVILDDLLATGGTMAAGVQLLRKIGAHVTGAGTIIDLAFLPGKQRLKELDVPFTCLASYDD

SEQ ID NO: 67323 - protein, 465 aa, Chlamydomonas reinhardtii
MQADDPARLLRDVVNDLIAPELDVANVDVSGKRVLLRVDFNVPVDEATGAVTDASRITAVLPTIRLLASRGARLILASHFGRPEPKKQSRAQMEAAFSLAPLFVGLAGDCIGPEAEAAVAALQPGQVLLLQNTRFHAGDGANDSGFSGALAALCDVFVQDAFGVVHRDQGSVTGITAHVSECYPGPLVRRELTELAHRLFEPVRPLGVVLGGAKVADKIGVVAALVEMADVVAVGGRMAFTLLAARGVSVGSTQIEPDWLEPCRAMMARAGQRGTQLLLPGDVLWSSSLAAPVDTGVQVLTLDCCTEESPCIPAGRYGVDIGPETSAAFGAALQRCKTIFWNGPMGKFEVPEFAQGTVAVAQAMNEASRNHGAITIIGGGDSVAAVTAAGLDGAITHISTGGGASLELIEGKGMPGLRALLRGRTVSASAPAPAPAPAPAPTPVPVPQQTAAAAPACCAAKKCCT

SEQ ID NO: 67324 - protein, 166 aa, Physcomitrella patens subsp. patens
AQVEGTDRGTQIGEPEKCAINEIVAKLETQCIPEPLSSPLLFGDWEVAYSSNPTAPGGYYRSMLGRALLKTRDMVQSINAPDLISNKVAFAAFGLVEGKVTLQGKLTVLDQKWVEVVFEPPQVMLGSFKTQYGGNSNVKLAILYLDEVVRIGRGSRGSLFIFKRRT

SEQ ID NO: 67325 - protein, 446 aa, Xylella fastidiosa Dixon
MNFETLGLLPSLLRALSEQGYEIPTPIQQQAIPLALAGHDLLAAAQTGTGKTAAFGLPVLQRLMAASSNVGAGKPRALVLTPTRELATQVHDSLRGYAKYQRVSSAVIYGGVGMGNQLDVLRRGVDLLIACPGRLIDHIERRSVDLSGVGILVLDEADRMLDMGFLHSIKRILGKLPRQNRQTLLFSATFAEPIKQLALEFMCRPREVMVASHNTVAETITHRVHPVDVSRKRELLLYLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVHTTPALTKQSGVQHSNGSRNRDGMLPVHQRG

SEQ ID NO: 67326 - protein, 260 aa, Mycobacterium avium 104
MAERLAGKVALVSGGARGMGASHVRSLVAEGAKVVFGDILDDEGKAVAAEVGEATRYLHLDVTKPEDWDAAVATALAEFGRIDVLVNNAGIINIGTLEDYALSEWQRILDINLTGVFLGIRAVVKPMKKAGRGSIINISSIEGMAGTIACHGYTATKFAVRGLTKSAALELGPSGIRVNSIHPGLIKTPMTEWVPEDIFQSALGRAAEPKEVSNLVVYLASDESSYSTGSEFVVDGGTTAGLGHKDFSNVETDAQPDWVT

SEQ ID NO: 67327 - protein, 477 aa, Swietenia macrophylla
  misc_feature (38)..(38): Xaa can be any naturally occurring amino acid
  misc_feature (61)..(61): Xaa can be any naturally occurring amino acid
LEKKKMGQIAQIIGPVLDVPFPPGKMPNIYNALVVKGXBTVGQPINVTCEVQQLLGNNRVXAVAMIATDGLTRGMEVIDTGAPLSVPVGGATLGRIFNVLGEPVDNLGPVDTLTTSPIHKPAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEVTAKATNLE

SEQ ID NO: 67328 - protein, 371 aa, Lactococcus lactis subsp. lactis Il1403
MALTAGIVGLPNVGKSTLFNAITKAGAEAANYPFATIDPNVGMVEVPDERLNKLTELIKPKKTVPTTFEFTDIAGIVKGASRGEGLGNKFLANIREVDAIIHVVRAFDDENVMRENNREDAFIDPMADIETINLELILADLESVNKRYARVEKVARTAKDKDAVAEFNVLKKLKPVLEDGKSARTIDFDEDEIKVLKSLFLLTSKPVLYVANVSEDEVGEPDNIEYVKQIREFAATENAEVAVISARVEEEISELEDDEKAEFLEAIGLKESGVDMLTRAAYHLLGLATYFTAGEKEVRAWTFKRGMKAPQMAGIIHTDFEKGFIRAVTMSYDDLLKYGSEKAVREAGRLREEGKEYVGQDGDIMEFRFNV

SEQ ID NO: 67329 - protein, 157 aa, Triticum aestivum
  misc_feature (18)..(18): Xaa can be any naturally occurring amino acid
THASVFIDGDDIIYRDYXVDVSVAVGTSKGLVVPVIRDADTMNFADIEKGINNLAKKATEGALSIDEMAGGTFTISNGGVYGSLISTPIINPPQSAILGMHSIVQRPVVVDGSILARPMMYLALTYDHRLIDGREAVYFLRRIKDVVEDPRRLLLDI

SEQ ID NO: 67330 - protein, 616 aa, Zea mays
MALLRITLTKSERSSSVMGKDSEYHLQANSSGRKVSKTMNGLQKAKAKGKIGTLMMVGCMSLSITCKKCEPLFLSSPPVCPLILYINTSTASQLATRSLREASAISISQPPFFCSVVYLVVGGDMQFALALDTNSGPHQIRSCEGDGIDRLEKLSIGGRKQEKALRNRCFGGRVAATTQCILTSDACPETLHSQTQSSRKNYADANRVSAIILGGGTGSQLFPLTSTRATPAIFVMSQFNSTSLNRHIHRTYLEGGINFADGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYIQLHDFGSEILPRAVLDHSVQACIFTGYWEDVGTIKSFFDANLALTEQPSKFDFYDPKTPFFTAPRCLPPTQLDKCKMKDAFISDGCLLRECNIEHSVIGVCSRVSSGCELKDSVMMGADTYETEEEASKLLLAGKVPVGIGRNTKIRNCIIDMNARIGKNVVITNSKGIQEADHPEEGYYIRSGIVVILKNATINDGSVI

SEQ ID NO: 67331 - protein, 249 aa, Prochlorococcus marinus str. MIT 9215
MSNTDSLSGKVALITGASRGIGKEIALELSRLGAEVFINYSSSDEKAEEVVNLIKSSGGKAHKLKFDVSKEESVSSAFEEIIKINGTIDILINNAGITRDGLLMRMKSEQWDDVLNTNLKGVFLCTKYASKFMMKKRSGSIVNISSVVGLIGNPGQANYSAAKAGVIGFTKTCAKEFASRSINVNAIAPGFIETEMTEKLNTDEILKAIPLGKLGSCTQIANLVSFLVSSNAGSYITGQTISIDGGMSI

SEQ ID NO: 67332 - protein, 122 aa, Triticum aestivum
  misc_feature (18)..(18): Xaa can be any naturally occurring amino acid
  misc_feature (21)..(21): Xaa can be any naturally occurring amino acid
  misc_feature (31)..(31): Xaa can be any naturally occurring amino acid
  misc_feature (46)..(46): Xaa can be any naturally occurring amino acid
  misc_feature (52)..(52): Xaa can be any naturally occurring amino acid
  misc_feature (76)..(76): Xaa can be any naturally occurring amino acid
  misc_feature (97)..(97): Xaa can be any naturally occurring amino acid
YVVTQLAPLDFQTEPIVXLDXDHYRILHHRXLLKHEELIYGSAEQXLVDAKXNMADTNSRNESYDMCRGKSKPAGXGSIILLKLSEAEEHEYTTLDXYKCGDPEFYAMVSRVLKRAETEFAL

SEQ ID NO: 67333 - protein, 301 aa, Oryza sativa Japonica Group
MGALSYVTVTILEISQGLPDSVGGVLSGPVSNVATRWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDKHAVGGCGDITVWLGDLNYRLQGISSIPARKLIEENRQSKLRGKDQLLQEAEKGEVFNGYCEGTLLFKPTYKYNIGSSNYDTSYKIRVPSWTDRILFKVDHTSGLDAVLNSYEALDCIRSSDHKPVRAHLCLKVHGDSA

SEQ ID NO: 67334 - protein, 480 aa, Coleochloa abyssinica
PVVSTQNIGRIAQIIGPVLDVVFPPGKMPNIYNALVVKGRDTMGEQINVTCEVQQLLGNNRVRAVAMSATDGLTRGMEVIDTGAALSVPVGGTTLGRIFNVLGEPIDDLGPVDTSTTSPIHRPAPAFVELDTKLSIFETGIKVVDLLAPYRRGGKIGLFGGAGVGKTVLIMELINNIAKAHGGVSVFGGVGERTREGNDLYIEMKESGVINEKNLSESKVALVYGQMNEPPGARMRVGLTALTMAEYFRDVNKQDVLLFIDNIFRFVQAGSEVSALLGRMPSAVGYQPTLSTEMGSLQERITSTKKGAITSIQAVYVPADDLTDPAPATTFAHLDATTVLSRALAAKGIYPAVSPLDSTSTMLQPNIVGDEHYEIAQRVKQTSQRYKELQDIIAILGLDELSEEDRLTVARARKIERFLSQPFFVAEVFTGSPGKYVGLAETIRGFQLILSGELDALPEQAFYLVGNIDEAIAKAIKLEV

SEQ ID NO: 67335 - protein, 485 aa, Xylella fastidiosa Dixon
MHHNVHQSEILADPCDLQRAERWRQRDLRVLWHPCTQMREHPDTLPLVPIVRGEGAWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACPAISTDTDDKELGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEEQLHLLAETTRVAIDEAIACV

SEQ ID NO: 67336 - protein, 272 aa, Xylella fastidiosa Dixon
MAGTSAVITIPSDLHESVIAIATDSGRAIMEIYQDHFQVQIKADMSPLTQADLISHQIIVHGLKQLTPSLPVLSEESTGITWEERRHWTSYWLVDPLDGTREFVKRNGEFCINIALIHEGIPVYGMILAPVEGTIWHAMHGGQAFRRDGHRDTTLHVRAPAGTALQVAASRSHIDVHTSALLAQMKEITLVSQGSALKFCRLAEGTLDVYPRLGATYEWDTAAGQCLLLAAGGTLLNIETGKQFRYNKRETLLNSGFIALGDATLPWRDWLP

SEQ ID NO: 67337 - protein, 429 aa, Anabaena variabilis ATCC 29413
MKKVLAIILGGGAGTRLYPLTKLRAKPAVPVAGKYRLIDIPVSNCINSEIFKIYVLTQFNSASLNRHIARTYNFSGFSEGFVEVLAAQQTPENPNWFQGTADAVRQYLWMLQEWDVDEFLILSGDHLYRMDYRLFIQRHRETNADITLSVIPIDDRRASDFGLMKIDNSGRVIDFSEKPKGEALTKMRVDTTVLGLTPEQAASQPYIASMGIYVFKKDVLIKLLKESLERTDFGKEIIPDASKDHNVQAYLFDDYWEDIGTIEAFYNANLALTQQPMPPFSFYDEEAPIYTRARYLPPTKLLDCHVTESIIGEGCILKNCRIQHSVLGVRSRIETGCVIEESLLMGADFYQASVERQCSIDKGDIPVGIGPDTIIRRAIIDKNARIGHDVKIINKDNVQEADRESQGFYIRSGIVVVLKNAVITDGTII

SEQ ID NO: 67338 - protein, 367 aa, Physcomitrella patens subsp. patens
MTVNGILHPERCILVTGGAGYIGTHTSLQLLLDGYKVVILDNLVNSCEEAVRRVVDLAGKQGKNLVFHKVDLCDKVGIQAVFDLHRFDAVIHFAGLKAVGESCAKPLPYYINNILGTLNLLDVMNTRNCKKLVFSSSATVYGQPESVPVTEDSRLFVLNPYGRTKLQVEEMMRDITAADSGWRCIVLRYFNPVGAHPSGRLGEDPQGFPNNLMPFVQQVAVGRRKELTVFGTDYNTKDGSGVRDYIHVQDLATGHSAALHKLFTTPDIGCTAYNLGTGKGTSVLEIVAAFEKAAGLKIPLRIAGRRPGDCSVVYTATDKARKELGWKALNGIDEMCRDQWKWASNNPNGYQPNQEPSVDLKMTKQNS

SEQ ID NO: 67339 - protein, 475 aa, Mesanthemum radicans
IGRIAQIIGPVLDVVFPPGKMPNIYNALVVKGRDTANQQINVICEVQQLLGNNRVRAVAMSATDGLTRGMEVIDTGSPLSVPVGGTTLGRIFNVLGDPIDNLGPVDPSTTSPIHRSAPAFIQLDTKLSIFETGIKVVDLLAPYRRGGKIGLFGGAGVGKTVLIMELINNIAKAHGGVSVFGGVGERTREGNDLYIEMKESGVINEKNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLGETIRGFQLILSGELDSLPEQAFYLVGNIDEATAKAINLEVEK

SEQ ID NO: 67340 - protein, 550 aa, Hebeloma cylindrosporum
MENEKTEHEKRESSSNLEKGDHVVAQTNPQFHFDVHDLDRVQRRLKQRHVQMIAIAGTIGTGLFLGSGGALEAAGPLGALIAYALVGTVAYSSLCAVGEMSTWAPISGTFPHFAARWVDPALGFATGWNYFYTNAISTPVEITAAVILLTFWDHNSKHISLYTAILCVLVCMINIFGVRYFGESEFIFAIIKLTLIIGLLLVGLIVDLGGGPQGDRIGFRYWKNPGAIAGSGLDRNIFGLDRFLAILSVIVQAAFSFQGMELVVIAASETESPRRNIAKAVRRVFYRILVFYILGILMIGMLVAYNDKDLLFLQGNNTAAKSPFVIAINRAGIKVLPHIVNGAIFTSAFSAGNSFLFCSSRVLYGLALRGQAPKVLTYCTKKGLPLYAVLVASAFSFLSFMSVSSGSNRVFGWFVNLSTTGGFTSWFVMNVTYIFFRRGLLAQGYDPTTNSYHNRFQPYIAYWGAGWTLFFILINGFSVFWKFTAAGFLTAYINIPIFLVLYFGYKIVFRTKFWKPLEMDFVTGIPTLEETETPEKPPKNLGERIANIIF

SEQ ID NO: 67341 - protein, 439 aa, Chlamydomonas reinhardtii
MAIANGTTTTTATAARMASSSGTVQSLDTGKLANTIRARAAGTSRGRLCGPKGNSVLAELMRQAKARQQEQERGGAGSAPGQIANLAECRSVDEYERLNRISEGTYGVVFRARCKKTGRICALKKIKMEKERDGFPVTSIREINILLNLHHPNIVNVAEVVMGSRLDQIFMVMEFMDHDLKSLMNDKSQMTRSFSVAEVKCLMLQLLSGIDYLHQNWVIHRDLKTSNILYNNRGELKTCDFGLARQYGSPLRPYTQPVVTLWYRPPELLLGATHYSTAVDMWSTGCIMAELLTGKPLFDGQGEIEQLDKICSVLGTPNEDVWPGIKQLPNWGKIVLRPQPSQLRSRFTSSFGSSATLTEAGFDLLSRLLAYDPAQRITAADAMEHKWFQESPFPQRRELMPTFRSNKDGVGPVRAAAVGGGSPPLNFMSAAAFKAGVGR

SEQ ID NO: 67342 - protein, 518 aa, Triticum aestivum
MAAAAAEMVRGFAATARAARPAATVAAPPQPRRAVAARVLRTSASEKVAADLSVAGTNGSLSALSNTDVSTDATSQAVDATPRRKTKIVCTIGPSTNTREMIWKLAETGMNVARMNMSHGDHQSHQKVIDLVKEYNAQNTDGNTVAIMLDTKGPEVRSGDLPEPIMLAEGQEFNFTIKRGVSTEDTVSVNYDDFISDVEAGDILLVDGGMMSLAVKSKTADTVKCVVVDGGELKSRRHLNVRGKSATLPSITEKDWEDIKFGVENGVDFYAVSFVKDAKVIHELKAYLKSANADIHVIPKIESADSIPNLQSIIAASDGAMVARGDLGAELPIEEVPLLQEEIIRTCRSMQKPVIVATNMLESMIDHPTPTRAEVSDIAIAVREAADAIMLSGETAHGKYPLKAVKVMHTVALRTESSLYDPAKAPSLVARPKALLNDDFCKSQLSKMFGSHATMMANTLRTPIIVFTRVGSMAVLLSHYRPSSTIYAFTNEYVLLWFLTTVLSSCEIYYGSGFCVDL

SEQ ID NO: 67343 - protein, 392 aa, Zea mays
  misc_feature (323)..(323): Xaa can be any naturally occurring amino acid
MGNSSLPDSASGFSLSLYNYHYLLLPHAPCSNLTKVGSADCFLCFFGVSRSSLDAGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEGLMTTVHAITATQKTVDGPSAKDWRGGRAASFNIIPSSTGAAKAVGKVLPDLNGKLTGMSFRVPTVDVSVVDLTVRIEKGASYEDIKKAIKAASXEGPLKGIMGYAEEDLVSTDFLGDSRSSIFDAKAGIALNDHFVKLVSWYDNEWGYSNRVVDLIRHMFKTQ

SEQ ID NO: 67344 - protein, 330 aa, Pyrus communis
DVDFWDAKGQTPLFPRIFGHEASGIVESVGEGVEGLEVGDHVLPVFTGECGDCAHCKFEESNMCDLLRINTDRGVMLSDGKTRFSINGTPINHFLGTSTFSEYTVIHSGCLAKTNPLAPLDIVCILSCGISTGLGATLNVAKPKKGSSVAIFGLGAVGLAAAEGARICGASRIIGVDRNPKRFEEAKKFGVNEFVNPKDHDKPVQEVIAEMTNGGADRSIECTGYINAMISAFECVHDGWGVAVLVGVPNKDAVFMTKPINVLNERTLKGTFFGNYKPRTDLPLVVEMYMSKKLEVEKFITHRVPFSEINKAFDYMTKGEGLRCIVSMEE

SEQ ID NO: 67345 - protein, 330 aa, Pyrus communis
DVYFWEAKGQNPLFPRIYGHEAGGIVESIGEGVTDLKAGDHVLPVFTGECKDCAHCKSEESNMCDLLRINTDRGVMLSDGKSRFSIKDKPIYHFVGTSTFSEYTVVHVGCLAKINPLAPLDKVCLLSCGISTGLGATLNVAKPKKGSTVAVFGLGAVGLAAAEGARFSGASRIIGVDLHSGRFEEAKKFGVTEFVNPKEHKKPVQEVIAELTNGGVDRSIECTGSVEFMISAFECVHDGWGVAVLVGVPHKEAVFKTHPLNFLNERTLKGTFFGNYKPRTDIPSVVEKYMNKELQLEKFITHKVPFSEINKAFEYMLKGEGLRCIIHMED

SEQ ID NO: 67346 - protein, 231 aa, Triticum aestivum
GPFRPIFQKTRLDRSEFPGFCGTPVPRLERGPLHGLKDLKKPECLSLARFIPPLSSPCPPRVGLLATSVALFRGLKSTAGLPVNRRSKGGSLGRVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 67347 - protein, 250 aa, Sphingomonas paucimobilis
MSDLSGKTIIVTGGGSGIGRATVELLVASGANVAVADINDEAGEAVVAASGGKAAYFRCDIAQEEDVKALVAQTLAAFGGLDGAFNNAAIPQAGLPLAEVSLERFRQSMDINVTGTFLCMKYQILAMIERGTKGSIVNTASAAGVVGVPMHGEYVGAKHAVVGLTRVAAADYGKHGIRVNALVPGAVRTPMLQRAMDNDAGLEPYLNSIHPIGRFSEPHEQAQAAVWLLSDAASFVTGSCLAADGGFTAI

SEQ ID NO: 67348 - protein, 351 aa, Passiflora edulis
QVSFDLLEAYLEQHPEASTWGNGAPGFRDNALFQDYHGLKSFRQAMASFMEQIRGGRAKFDPDRIVLTAGATAANELLTFILADPGDALLVPTPYYPGFDRDLRWRTGVKIVPIHCDSSNNFQVTPQALEAAYKNAEAMNLKVRGVLLTNPSNPLGATIQRSVLEEIFDFVTRKNIHLVSDEIYSGSTFSSAEFVSIAEILEARGYTEAERVHIVYSLSKDLGLPGFRVGTIYSYNDKVVTTARRMSSFTLISSQTQHPLACMLSNKEFAENYIKTNRERLRKRYDMIIQGLKDAGIECLKGNAGLFCWMNLSPLLETPTKEGELALWESIVHEVKLNISPGSSCHCSEPG

SEQ ID NO: 67349 - protein, 354 aa, Passiflora edulis
QLCFDLVEEWLKNNPEASICTAEGLSEFRDIAIFQDYHGLPEFRNAVAKFMAKVRGDRVTFDPDRIVMSGGATGAHETIAFCLADPGERFLVPTPYYPGFDRDLRWRTGVKLIPVECESSNNFKVTRESLESAHEMAQLDGIRVKGLLITNPSNPLGTILDRDTLRSIVHFVNEKNIHLVCDEIYAATVFRQPDFVSISEILQEDDIECNLDLIHIVYSLSKDMGFPGFRVGIIYSYNDAVVSCARKMSSFGLVSAQTQHLIASMLSDDEFIEGFIKESRRRLAKRYQVFTRGLAQVGIKCLKTSNAGLFMWMDLRDPLKEKTFDGEMMLWRLIINEVKLNVSPGCSFHCPEPG

SEQ ID NO: 67350 - protein, 223 aa, Brassica napus
MAQQQQSLIYSFVARGTVILVEFTDFKGNFTSIAAQCLQKLPSSNNKFTYNCDGHTFNYLVENGFTYCVVAVDSAGRQIPMAFLERVKDDFNKRYGGGKAATAQANSLNKEFGSKLKEHMQYCMDHPDEISKLAKVKAQVSEVKGVMMENIEKVLDRGEKIELLVDKTENLRSQAQDFRTQGTQMRRKMWFQNMKIKLIVLAIIIALILIIVLSVCGGFNCGK

SEQ ID NO: 67351 - protein, 156 aa, Triticum aestivum
MATISAAAATTVVARAAIARPQALGLPQLRTRSERVRCSYSKDAKEATPAAAVRGAGASLLAAAGAVTASAGPALALVREWMSTEGTGPEPGAEQQPAGVDPSWASSGLIWSILNTITTSCPRTKEAGSPGGASLTSKRYTVIVPPERLHVKTRLR

SEQ ID NO: 67352 - protein, 481 aa, Candida albicans SC5314
MLLHHTLGNGDFTVFHRMSTNICETTAFLDDLATACNEIDRCLRTAYTMQRPVYIALPSNMVDMKVPQAMLEKSIDLSLEPNNIQSQNEVIDRILGMVSKASNPIVLVDACASRHDCKKEVKQLVETTQFPVYVTPMGKGMIDEGGIGGEDLADASAFKNLASNLSSGTSVASRYGGVYIGSLSKPEVKEGIENSDLIFSCGALLSDFNTGSFSYSIGTKNVIEFHSDHAKIKSAIYSGIKMKELMQALNKKISSVLTNYVPKSVPKVKLVNAPTELSAPLTQAWFWTRVSSWFKEEDIIITESGTAAHGILEARFPNNVVGISQILWGSIGYSVGATLGASVAAKEVDPKKRVILFVGDGSLQLTMQEVSTMIKNGVHPYIFVVNNAGYTIEKLIHGLNAKYNNIQPWNHSQILSLFNAKDSQSAKISTVGEADDLFRNKYFGVNSKIRLIELMFSSLDAPKALVQQAKAAADVNRGTTD

SEQ ID NO: 67353 - protein, 256 aa, Burkholderia mallei ATCC 23344
MTNLWDRAFDLTGRVALVTGGAAGIGHACARLLAQRGASVALVDRHPETAGIAATLEGGAARHSGMSLDLRDCSAAQAGVALAASRFGGVDMLVNSAGVALLDKALDVGEAAWDATMAINVKASFFVAQAAARQMIAGARGGRIVNLASQASVVGLERHAAYCASKAAIVGMTKALALEWAPHGITVNAVSPTIVETALGKQAWAGEAGERAKREIPAGRFAQPDEIAALVLYLLSDAAAMMTGENVVIDGGYTVR

SEQ ID NO: 67354 - protein, 418 aa, Physcomitrella patens subsp. patens
MSPQRRKHCNGKGELRRKEEEEAVDEVEEEEEEHEEEDEEEEEEEEDGDREEQEITEYEKQRLKTIERNKAMLASLQLPNLAASFAEATNQSAKAGKLEVPSNARSHSSRRRSERLKAVRGKRSAVGDDSGSSDNSDFESEKSDHSPSKKNRRDREYEPTDDEAGLSESEDEADEQETEVLREGTSSVMPDGVDEDDEQYALRQALALSMGASVEAADFAVSSKKHKKRNTAKKRAAESMGLDPEDDLEDDAPSKPNKGKTKRKTQKMGNKRHYTEEEVDALFPIFDDRGRGRLTVNDLERVSTAHDFTWSTEELLDMIHLFNRNQNGVLDLEDFRNVATRCNLIISKLLYPTKNEMQEQFTTIAILRTSSLDSLNRTNGSKIGRDLLEVSTSAPELLLDDAFNHHLRFPHRCGKATP

SEQ ID NO: 67355 - protein, 491 aa, Flagellaria indica
TSSSGVSTIEEKNKGSIIQIIGPVLDVNFPSGKLPNIYNALVVKGRDTVGHQINVTCEVQQLLGNNRVRAVAMSATDGLTRGMEVIDTGAPLSVPVGGATLGRIFNVLGEPVDNLGPVDTSATSPIHRSAPAFIELDTKLSIFETGIKVVDLLAPYRRGGKIGLFGGAGVGKTVLIMELINNIAKAHGGVSVFGGVGERTREGNDLYKEMKESGVINEKNIAESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRVLAAKGIYPAVDPLDSTSTMLQPRIVGDEHYEIAQRVKETLQRYKELQDIIAILGLDELSEEDRLTVARARKIERFLSQPFFVAEVFTGSAGKYVGLAETIRGFQLILSGELDGLPEQAFYLVGNIDEATAKAMNLEGENKLK

SEQ ID NO: 67356 - protein, 154 aa, Candidatus Kuenenia stuttgartiensis
MGVEYQGKLIGTGRTFGIIVSRYNGFITKRLLEGAIDGLVRHGVKEEDIGVFWVPGAYEIPITAQKVIQRGKYDAVICLGAIIRGETPHFDFVASESAKGITQIGLSSGIPVIYGVITTETLEQAIDRAGAKTGNKGTEAALSAIEMVNLFDQI

SEQ ID NO: 67357 - protein, 324 aa, Candida albicans SC5314
MHERTQNSIKLIAGNSHPELCESIAQRLSLSIAKIGAFQYTNQETAVAVGESVRDEDVYIIQTGCGEEQINDFLMELLMIINACRVASARRITAVIPSFPYARQDKKDKSRAPITAKLVANLIQTAGCDHVITMDLHASQIQGFFRVPVDNLYAEPSVLRYIKENYKQSDIIMVSPDAGGAKRVASLADKLDIQFALIHKERQKANEVSKMVLVGDVTDKICLLIDDMADTCGTLCKAADVLLESKARKVVCMITHGIFSGNAIERLNNSKLEKVICTNSLPVQDKLKQCDKIEMLDISSTLAEAIRRLHNGESVSYLFNNVPE

SEQ ID NO: 67358 - protein, 338 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSAATVYGDNPKIPYVESFPTGTPQSPYGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGNSVLDVVNAFSKACGKPVNYHFAPRREGDLPAYWADASKADRELNWRVTRTLDEMAQDTWHWQSRHPQGYPD

SEQ ID NO: 67359 - protein, 491 aa, Joinvillea gaudichaudiana
  misc_feature (3)..(3): Xaa can be any naturally occurring amino acid
  misc_feature (16)..(16): Xaa can be any naturally occurring amino acid
  misc_feature (381)..(381): Xaa can be any naturally occurring amino acid
  misc_feature (390)..(390): Xaa can be any naturally occurring amino acid
  misc_feature (478)..(478): Xaa can be any naturally occurring amino acid
  misc_feature (486)..(486): Xaa can be any naturally occurring amino acid
  misc_feature (489)..(489): Xaa can be any naturally occurring amino acid
TSXPGVSTIEEKSTGXIDQIIGPVLDVTFPQGKLPYIYNALVVKSRDTAGKQINVTCEVQQLLGNNRVRAVAMSATDGLTRGMEVIDTGAPLSVPVGGATLGRIFNVLGEPVDNLGPVDTSATFPIHRSAPAFIELDTKLSIFETGIKVVDLLAPYRRGGKIGLFGGAGVGKTVLIMELINNIAKAHGGVSVFGGVGERTREGNDLYKEMKESGVINEKNLAESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGEEHYEXAQRVKQTLXRYKELQDIIAILGLDELSEEDRLTVARARKIERFLSQPFFVAEVFTGSPGKYVGLAETIRGFQLILSGELDGLPEQAFYLVGNIDEAXAKAMNLEXESXLK

SEQ ID NO: 67360 - protein, 338 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSAATVYGDQPKIPYVESFPTGTPQSPYGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGNSVLDVVNAFSKACGKPVNYHFAPRREGDLPAYWADASKADRELNWRVTRTLDEMAQDTWHWQSRHPQGYPD

SEQ ID NO: 67361 - protein, 181 aa, Panax ginseng
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNGDELRDAVLLVFANKQDLPNAMNAAEITDKLGLHSLRQRHWYIQSTCATSGEGLYEGLDWLSNNIANKA

SEQ ID NO: 67362 - protein, 465 aa, Distichia acicularis
  misc_feature (54)..(54): Xaa can be any naturally occurring amino acid
PFNPVVSTFQEKNIGHIVQIIGPVLDVVFLPGGLPNIYNALVVKDQDTVGQDIXVTCEVQQLLGNNRIRAVAMNATDGLTRGMEVIDTGAPLSVPVGGATLGRIFNVLGQPIDNLGPVDTSTTLPIHRSAPAFIELDTKLSILETGIKVVDLLAPYRRGGKIGLFGGAGVGKTVLIMELINNIAKGHGGVSVFAGVGERTREGNDLYKEMKESGVINEKKISESKVALVYGQMNEPPGARMRVGLTALTMAEYFRDVNQKDVLLFIDNIFRFVQAGSEVSALLGRMPSAVGYQPTLSTEMGSLQERITSTKKGAITSIQAVYVPADDLTDPAPATTFAHLDATTVLSRPLAAKGIYPAVNPLDSTSTILQSNIVGKEHYETAQRVKQTSQRYKELQDVISVLGLDELLEEDRLIVARARKIERFLSQPFCVAEVFTGSPGKYVDLIETIRGFQLILSGELDRLPE

SEQ ID NO: 67363 - protein, 425 aa, Picrophilus torridus DSM 9790
MISDITYEYYQISFILIIAAFAIPLSRKVSIVYIPVLMLFGIVFGPILGFINQSFALFLLSSFGTVGIGILGLVIILYYESHNINPRIIRRYLYDIAALDTIGMVITAIGAGVIFSLITGVPFRIGFLFGAIISPTDPASLIPTFRRISMREDVSGTLIGESLFNDPLGIILLDVGIALIAPESSYVSFFTLFSSHIGLILGSVVFMILQMAIPALIGIALGFIIIYLNKYFNFENFIIALTLGIVLFEFTSLTAFNITPFPAIIATGAIVGNYSDKSIFWSREMSFNENLSFMAQSIIFILLGSILTLREMENYILLGIILSLLVMFLVRPAAVFSSLSIFNFKRELIRFNNKTKTFMSLVGPRGIVPIVLSTVPYVVGLDDDINILIKYGPLIYVSVSFVVLITIIAQTIYVPLIGKNLLGRK

SEQ ID NO: 67364 - protein, 325 aa, Triticum aestivum
MGAQRALLASFLLAALATQAFVAVSARTSPTDKASQDDVKKPDCVPSLDPHNFPGHGGTTVPLPSHGGSSGTPPYHGGSGTTPSHGGSGSTPSHSGSGSTVPDPSHGGYGTPPSHGGSGSLPDPSHSGGGYGSTPDAPSHGGGAYGSSPTPSTGGAYGSSPTPSHDGGAYGSSPTPAHDGGSYSGTPAAPSHSSHGSITPTPLIPVDPNSLGTCDYWRTHPMQIWSALGSWPSSVSHFFGAAGGAVAGGPSMSIQDALANTRTDGAGALLREGTAALLNSMTRPGFAYTTQQVRDAFAAAVAGGSDSAAAAQAAAFKKANEGKKV

SEQ ID NO: 67365 - protein, 177 aa, Mesorhizobium sp. BNC1
MPIYSLDGHVPQFADDATGWVAPDATLIGEVIIGRNVGIWFGAVLRGDNEPITIGDDSNVQEHTVMHTDRGFPLTVGRGCTIGHRAILHGCTIGDHSLIGMGATVLNGARIGSECLVGAGALITEGKVFPDRSLIVGAPAKAIRVLDDKAAAQLRASAASYVENAERFRRGLKLVTP

SEQ ID NO: 67366 - protein, 314 aa, Bacillus clausii KSM-K16
METVKTKLTGKHLLTLLDFTPTEVAQLLEEAKALKAALKKGEPHTLLAGKSLGMIFENASTRTRVSFEVGMTQLGGHALFLSSRDLQIGRGEPVKDTANVLSRYVDAIMIRTNSHKKVVEFAKHSSVPVINALTDAFHPCQALADALTIMEHKGTLAGKKLVYIGDGNNVAHSLLAVGAKTGMDVTVASPKGYEVDQAIFAKAQEAAMQTGAKLVSTNDPEAAVADADVLYTDVWASMGYEQEQTSRAEALAPYQVNHKLAKGAKDDYLFLHCLPAHRGEEVTADVIDGSHSAIYDQAENRLHVQKAILAALIR

SEQ ID NO: 67367 - protein, 366 aa, Bradyrhizobium sp. BTAi1
MQIKAAVARVQGAPLSIEALDIEDPRDNEILVKVVATGVCHTDLVVRDGMLPTPLPVVLGHEGAGIVTKVGRAISKVDVGDHVVMTFNSCGRCPSCQDHHVSYCHEFFPRNFFAARADGTSALSKQGERINGNFFGQSSFACHAICHEANVVKVDAKFDLELLGPLACGIQTGAGAVMNALKISAGKSFAVFGAGSVGLSALMAARVVGAATIVAVDTNDDRLAMARELGATHTINPTRVDATEEITKITGYGVNFALDTTGIAAVIRGAVMSLAPMGTCGILGASAMGTEITLDEVHFMSGGRRLMGIVEGESVPEVFIPMLAELNAQGRFPFDRLVKFYSLDQINEAIHDSETGRTIKPIVRMS

SEQ ID NO: 67368 - protein, 341 aa, Solanum melongena
MADLLSNYSSKLEAVPPSHCLPLHERPVDPVEIVNTIPVIDLGKAKGDERPAVVQQLMKAFEEYGFFQIINHGVPEKLMEEAMKVYKEFFSLPAEEKERYAKDAANNTATGAAKMYSSSAKHYDSEEHRYWRDVLEHSANLDGKDRETWPDKPSRYREVIGEYSDELRRVSKVILGMVAEGLGLEPGFFDKGLGQRMLVNHYPACPDPSLTLGVGGHCDPNLITIIQQEVYGLQILKDDKWIGVEPKPNAFVVNSGLPITVISNGKLASVAHRVVTNTTHSRTSIGTFICPENIVEPAKALVGPGNPPQFKSFNWGIDFMPHYLSKKSVYHAALEPFKIDA

SEQ ID NO: 67369 - protein, 360 aa, Bacillus clausii KSM-K16
MKGSIVLETGETFVGNWHGEPKQVEGEIVFFTGMTGYQEVITDPSFKGQIVVFTYPLIGNYGVNESDFESSKPQVEGVIVCEAASDPSHWKMKKSVVDYLSEHRIPYMSGVDTRAIVKRIRQHGDMRAVLTTDSRNANVQETRLLSDKFVVADVSVTEPVVYNATGTTHIAVLDYGCKQSIIRSLVKKGAKVTQLPYNTDFAVLEALKPDGVLLSNGPGNPKQLQALLPDIKKVAETFPTLGICLGHQLLALAYGGDTQKLRFGHRGANQPVLDSCTGRVCMTSQNHSYVVTEESLASSILEPRFYNINDRSIEGLVHPKRPVMSIQFHPEASPGPVDSTEIFDAFLAPLLSKGRDHQYA

SEQ ID NO: 67370 - protein, 490 aa, Bradyrhizobium sp. BTAi1
MSIQTDTFLDAGRWEGRAFFADWAGTSAGVIDVRDPATDAVIAMVGVGGADDIARAAQQARAAQPAWARTLPAERARILNKAADLLEANSAELIPWIMRESGSIQPKAGIEIEHGALFIRHAATLATQPMGVMLPAMDGRSNHARRVPHGVVGVISPFNFPLVLSVRAIAAALACGNAVLHKPDPRTPIAGGIIIARIFEDAGLPKGVLQVVPGGAEAGEAMCRDPNIAMISFTGSAVAGAKVGEVAGRHLKKVQLELGGKNALIVLDDADLDIAASNAAWGAFLHQGQICMATGLILAHHSVADALTERLVTKAAHLPVGDPSTGQVALGPIISDNQVASIQKIVDDAVAKGAKLLAGGTHQGRFYAATVLAGVKPGMLAFEEEIFGPVACVVSFSSDAEAVALANASDYGLAAGVISSDLGRAMAIGEQLNVGQLHINDQTVNGGPFAPFGGRGKSGNGSRIGGPADIEEFTQWQWISTKAQASAYPF

SEQ ID NO: 67371 - protein, 378 aa, Alkalilimnicola ehrlichei MLHE-1
MPFRPRYTGLIAKYHDRLPVKDDSRLISLGEGNTPLIRLNNIPGELGKDVDIYVKYEGLNPTGSFKDRGMTMAVTKAVEEGSKAIICASTGNTSASAAAYAARAGIKAFVLIPDGKIAMGKLAQAIMHGADVLQIRGNFDDGMRLVKEVAEQAPVTIVNSVNPYRLQGQKTAAFEIVEELERAPDYHCLPVGNAGNITAHWIGYCEYSGRGEGILTEACTLCNGHCRYASAIVDKRPVMVGYQASGSAPFLRGHMVDDPETVATAIRIGHPQSWDYAWKVKEESGGWFDECTDQEILEAQRLLADREGVFCEPASATSLAGALRDIRHGTIPEGSTVVCTLTGHGLKDPDIAIRQSSDALRTIDATLDDVRRAITDRL

SEQ ID NO: 67372 - protein, 504 aa, Propionibacterium acnes KPA171202
MEVMQPADLALFLGAVVVLLAAFAARIGTRLGLPALLLFLLVGMLLGPIGFGINFNDLAGAHAIGFAALVLVLAEGGLSTNWKDIRPALAPAALLATVGVGVCFGVMTLLGHYVLGLHWSVAALLGAATAPTDSAAVFSVLRGVSLPNHLRSVLEAESGLNDAPTVLVVIALTGVATGESNAGVLPLLGSIAVQLIGGILVGLLVGWVAGKVSRRITLPSGNLYAIAAMAWAVTAYGTGAWIGVSGFSAVYIAAVVIGNGDLPYQHTTRSFSEGIAWICQIGLFVMLGLLANPDRLTWGSVGVGIAAGLLLTLVARPVAVAACTIWFGFERNERLFMSWAGLRGAVPIILATIPMASNMDRADKFFDVILVLVVVFTCIQAPTLPAAADILGVVDPQMAKDVSIEVAPLDEIAADLLQADVPKGSRLAGVTIRELRLPRNCVVSLIIRGDRSFTPHAGTVLEQGDELLIVVPQGKRRTVAERLIEISRGGRLARWHGLRVQTAD

SEQ ID NO: 67373 - protein, 356 aa, Triticum aestivum
  misc_feature (69)..(69): Xaa can be any naturally occurring amino acid
  misc_feature (275)..(275): Xaa can be any naturally occurring amino acid
MAGGGETMGLGGLWRRYAPHNMMIMVQLCYTLMYFVTEAAFNRGLNPYVYVTYRHLLVALLLWPFAYYXKKKLRPKMTWMLFLEIFVLSLLGVSLTLNMYFASLKYTSPTFVTSMVNTVASITFVIAIALRMEIVDLRSARGLAKVAGTAVSFAGVTTMTLYKGAAIASPWRAPVRIPGAGGDAPHDTWLRGSLLAVASCVCWSVWYIMQATSVKRYPAELSLTAWMATVGGAQSAGFAVLLQHERGDWLVRLGPHFWCIIYSGLGCSGFTVVAXLWCRKKKGPVFVTMFNRGSTIRGAILPNSFFGETYSLEAKLGGGGVIRGPIILLWGRARARGLTTPGPCKRENKAGKPGCD

SEQ ID NO: 67374 - protein, 407 aa, Alkalilimnicola ehrlichei MLHE-1
MNLSDEFPRIKRLPPYVFNIVNELKAAARARGEDIVDFGMGNPDQPTPQHIVDKLTEVAQRGDTHRYSMSRGIPRLRRAICNWYRDRYDVDLDRETEAIVTIGSKEGLAHLALATLAPGDAVLVPNPAYPIHPYGVVIAGADIRHVPMLPDGDFFAEMEKAIRDSYPKPKMLILNFPSNPTSACVDLEFFEKVVAVARQHNIWVVHDLAYADIVFDGYRAPSILEVPGAKEVAVESFSLSKSYNMPGWRVGFMCGNRHLIAALARMKSYLDYGTFTPIQVAAIAALEGPQECVQEICEMYRRRRDVLCEGLNAAGWEVEKPKATMFVWARIPERYRDMGSLEFAKKLLRDAKVAVSPGIGFGDYGDEYVRFGLIENEHRTRQAIRCIKQMFRRDGQHDQQQEGEVSS

SEQ ID NO: 67375 - protein, 352 aa, Arabidopsis thaliana
MAVFQLPSLSPEIPFRFTPTPLKFSNRRRINFFRPLSATDDSRSGAPDPESPNQMFILGMGFVGGFFAQQLKESDWVVSGTCRSDSKKKEWEKRGINLHPFSADSPEWSLLDSVKDYTHLLISIPPLADIGDPMLRNVELVRDKLSSGNLRWLCYLSSTSVYGDCGGAWVNENHLPNPKTQSAKVRLAAEQGWLSLGRDLGVSTQILRLGGIYGPGRSAIDTLLKQERLSEGQKRRASRKFTSRVHVEDICQVLKAATEKPASGEIYNIVDDDPAAREEVFEYALELIEKRWPGNITTKPFPFLYESREESSLRGEKRVCNERMKDKLGVKLLYPWYKSGLQSIVENMDNRF

SEQ ID NO: 67376 - protein, 92 aa, Oryza sativa
MAPSVMAWSATTVAPFHGLKSTAGMPGARRSGNSSLGNVTNGGRIRCMQVWPIEGMKKLKTLSYLTPLTVEDLMKQIEYLLRSKWVPCLEFS

SEQ ID NO: 67377 - protein, 401 aa, Prochlorococcus marinus str. MIT 9215
MTPERLGLLWGITVFAGAFARLFSSFTGSPSVVILLLSGLFIGRSGLGLVEPLDLGQGLETIVGLLVCLVLFEGGLNLKLPEGNIRNTVLKISLVRLFISLSAGIFIAHWLAGLSWQVAGIYSAIVLATGPTVVSPLVEQIKLASPLSEVLKAEGLLLEPIGAVLALLLLELTLGDLRGINDVFIALMQRLGGGVLIGLSTGWLLSEILKKIKNEASFGVELQVTLGFIFLVYGICEYFLPESGLPASVAAGFIVGKREVIDKERLDNLIGELAQLAITVLFPLLAADVSWGELSPLGWGGVVCVFMLMVIVRPISIWIATMGRELNLKEKVFLAWLAPRGIVTAAVASLFSIRLEQAGILGAGRLQGLVFLTILMTVGIQGLSAKPLASRLELGQKNNLD

SEQ ID NO: 67378 - protein, 565 aa, Yersinia pestis KIM
MKTHGINGIRPFSAIIDACWRETYTLQRLFKDIIAGVTVGIIAIPLAMALAIASGVPPQYGLYTSAIAGIVIAVSGGSRYSVSGPTAAFVVILYPVSQQFGLAGLLLATILSGLFLLCMGFARLGRLIEYIPLSVTLGFTSGIAITIATMQVKDFFGLHLVAVPENYVGKVTALAQAMPTINVSDTLIATVTLLVLILWPRLKLKLPGHLPALVAGTAVMGVLSLFDQQVATIGSRFGYLLADGTQGQGIPPILPQFVLPWQLPAANGQEFVLNWATLSALLPAAFSMAMLGAIESLLCAVVLDGMTGQKHHSNSELVGQGLGNIVAPFFGGITATAAIARSAANVRAGATSPVSAIIHAVLVLLALLVLAPMLSYLPLAAMASLLLIVAWNMSEAHKVIDLLRRAPKDDIIIMLLCMSLTVLFDMVIAITVGIVLASLLFMRRIAQMTRLSEIPAAVNDKTLVLRVNGPLFFDAAERIFSELLTRCDNYDTIILQWDAVPVLDAGGLNAFLRFTEALTEQQLLVITDIPFQPLKTLARARVKPISGKLNFYASLPEALAALQNN

SEQ ID NO: 67379 - protein, 533 aa, Vitis vinifera
MGTHVESFWIFALVSKCEALSLASIAWVVFFAWFLLSMIFWAYPGGPAWGKYRWRKASPSASMGKPIPGPRGFPVVGSMKLMASLAHHRIAAAAEACGAKRLMAFSLGETRVIVTCNPDVAKDILNSSVFADRPVKESAYSLMFNRAIGFAAYGVYWRTLRRIAATHLFCPKQIKASEAQRAEIAAEMAAMFGENTEPFRVRDVLKRASLSSMMCSVFGRKYQLDSSNNEAHELRTLVEEGYDLLGTLNWSDHLPFLGDFDPQKIRMRCSNLVPKVNRFVTRIIAEHRARTTEKIRDFVDVLLSLQGPDKLSDSDMIAVLWEMIFRGTDTVAVLIEWILARLVLHPDVQSRVHDELDRVVGESRAVAESDITAMEYLPAVVKEVIRLHPPGPLLSWARLATTDTTVDGHHVPAGTTAMVNMWAITRDPNVWSDPLEFKPDRFSGMGADTDISVFGSDLRLAPFGSGRRVCPGKTLGLTTVTFWVASLLHEFEWKPLDGNNNVDLSEVLKLSCEMEKPLTVKVHRRRSTSTSSP

SEQ ID NO: 67380 - protein, 426 aa, Arabidopsis thaliana
MTTTISHLPTELLDEIISRVPLKSTRAVRLTCKNWDSLFKNRSFMKEEAAAKEGESRMIVLMDKNLFAMSIFFNGIDIDPSAEQRGKLTCLYDDSEQVKISQVFHCEGLLLCVLEDDKCSLVVWNPYWGQTRWIEPRYFSRIQNCYGRYMYVYALGYNNKSRSHKILRFIDGAFDFPFWYEIYDFDSDLWTTLDVTPQWFINFPPRGCYNRGVTLKGNTYWCAIRRKSNTNWFVDLDHIICFDFTSERFGPLMPLPFVRYTSGSLVTLSCVREEKLAVLFCNNATVEVWITTKIETDKISWSKFLTVNMYVDLLEGSFFIDEVKKVAMIFDIPMNRETVYIVGEAGNVKELHLGQPVDVDKHFSPLFVCSYVPSLVQIKQPPGCQRKQESSLEKRRCDDENISRLIAHEETYVVYGRYVPSRKKPR

SEQ ID NO: 67381 - protein, 439 aa, Triticum aestivum
LVSGLVLSAVLVFGATVYALTRPRPVYLVDFACYKAPDHLKVGFQEFLRHSALCGFSHDALEFQRKILERSGLSEETYCPEGMHAIPPEPTMANARAEAESVMFGALDSLFAATGVKPKDVGILVVNCSLFNPTPSLSAMIVNRYKLRGNVRSFNLGGMGCSAGVIAIDLARDMLQVHRGTYAVVVSTENITQNWYFGNRKSMLIPNCLFRVGCSAVLLSNRGADRRRAKYSLKHVVRTHKGADDKAFNCVYQEQDGEGKTGVSLSKDLMAIAGGALKTNITTLGPLVLPFSEQLLFFATLVSKKLFNAKVKPYIPDFKLAFEHFCIHAGGRAVIDELEKNLQLQPVHVEASRMTLHRFGNTSSSSIWYELAYMEAKGRVRRGDRIWQIAFGSGFKCNSAVWHALRNVKPSPSTPWDDCIDRYPVELVDGFPTHTHTHK

SEQ ID NO: 67382 - protein, 517 aa, Oryza sativa Indica Group
MQGANMLLDEPVRLTSVLTPVKPKVFPSLTKIVGTLGPNSHSVEVIQECLTAGMAVARFDFSWMDASYHQETLNNLRKAAQNVNKLCPVMLDTLGPEIQVHNSTGGPIELKAGNHVTITPDLSKAPSSEILPIKFGGLAKAVKKGDTLFIGQYLFTGSETTSSWLEVVETSGENVECLVTNTATLAGPMFTLHVSKAHVSLPTLSDYDKEVISTWGLHNSVDIISLSHTRSAEDVRELRSFLQSHGLQDTQIYAKVENTEGLDHFDEILQEADGVIISRGDLGIDLPPEDVFISQKTAIKKCNLAGKPVIITRVVDSMIDNLRPTRAEATDVANAVLDGTDGILLGAETHRGPYPVDAAESVYNQLVHFKKLVKHVGDPMPHEESVASSAVRTAMKVKAAAIVVFTFSGRAARLVAKYKPPMPVLAVVFPREGSDPTKWRSYGTTQARQCFAARGVYPLMASTEEAETGGLTREEYGIKLAQNYGRSVGMLKPYDRLIIFQKIGDSSVVKIIECDSS

SEQ ID NO: 67383 - protein, 338 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSTATVYGDNPKIPYVESFPTGTPQSPYGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGNSVLDVVNAFSKACGKPVNYHFAPRREGDLPAYWADASKADRELNWRVTRTLDEMAQDTWHWQSRHPQGYPD

SEQ ID NO: 67384 - protein, 338 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSVATVYGDNPKIPYVESFPTGTPQSPYGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGNSVLDVVNAFSKACGKPVNYHFAPRREGDLPAYWADASKADRELNWRVTRTLDEMAQDTWHWQSRHPQGYPD

SEQ ID NO: 67385 - protein, 284 aa, Debaryomyces hansenii CBS767
MDKLLQWSIAQQSGDQEAIEKIGKPDPKMLEQLFGGPDEPALMKQAIMVIDNEEATLENREIAFDNFEMLIENMDNANNIENIKLWQSVIDKMSAETPTSLRVYAASCAGIAVQNNPKSQEDFLKYDGLALLISICNEEDVPTELRLKALFAISSLIRNFEVGYAKFDELDGWSVVKFNENEDHKVKLRILSLVSAILSTPLDKKKEEHVHREKLVANIISILKKDGHIGCIDKALNIISQLASSEFEFSSSEIGDIAQGLEEIEKLKDSISEDDYNSVKQVVN

SEQ ID NO: 67386 - protein, 338 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSSATVYGDQPKIPYVESFPTGTPQSPFGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGNSVLDVVNAFSKACGKPVNYHFAPRREGDLPAYWADASKADRELNWRVTRTLDEMAQDTWHWQSRHPQGYPD

SEQ ID NO: 67387 - protein, 477 aa, Arabidopsis thaliana
MQRFAAKRSVQNISVSLWRRCISSTSQAATASVKDSDEFQARLPPFAYTPPPYTGPSADVILSKRKEFLSPSMFCLYRKPLNIVDGKMQYLFDESGRRYLDAFAGIAVVNCGHCHPDVVEPVINQIKRLQHPTVLYLNHAIADFSEALASKLPGDLKVVFFTNSGTEANELALMMAKLYTGCQDIVAVRNGYHGNAAATMGATGQSMWKFNVVQNSVHHALNPDPYRGVFGSDGEKYAKDLQDLIQYGTTGHIAGFICEAIQGVGGIVELAPGYLSAAYDTVKKAGGLFIADEVQSGFARTGNFWGFEAHNVVPDIVTMAKGIGNGFPLGAVVTTPEIAGVLTRRSYFNTFGGNSVSTTAGLAVLNVIEKEKLQENAAMVGSYLKEKLTQLKEKHEIIGDVRGRGLMLGVELVSDRKLKTPATAETLHIMDQMKELGVLIGKGGYFGNVFRITPPLCFTKDDADFLVEAMDYSMSKM

SEQ ID NO: 67388 - protein, 272 aa, Mesorhizobium sp. BNC1
MTARQAVRSNAPQQIDPIWSEIRAEARTAVENDALLAAFLYSTILNQATLEDAVIHRISQRLDHADLSADLLQQTFLAMWEDQPDWSSILRVDIQAYYDRDPACDRFLMPVLYFKGFHAIQTHRLAHWLWGKGRKDFALYLQSRSSAVFQTDINPAATIGRGIFLDHATGLVVGETAVIEDDVSILQDVTLGGTGKETGDRHPKIRHGVLIGAGAKILGNIEIGHCTKVAAGSVVVKPVPPNKTVAGVPARIIGEAGCNEPSRAMDQLLLEE

SEQ ID NO: 67389 - protein, 416 aa, Debaryomyces hansenii CBS767
MSLSNKLSVKDLDVSGKRVFIRVDFNVPLDGKTITNNQRIVAALPTIKYVLENKPKAVILASHLGRPNGEKVDKFSLAPVASELEKLLGKKVNFLDDCVGDNVEKAVNGGSDGEVFLLENLRFHIEEEGSQKKDGEKVKASGEDVKKFRQQLTNLADVYVNDAFGTAHRAHSSMVGLELPQKAAGFLMAKELEYFAKALENPVRPFLAILGGAKVSDKIQLIDNLLDKVDLLIVGGGMSFTFKKVLDNMPIGDSLFDEAGAKNVENLVAKAKKNNVKIVLPVDFITADKFDKDAKTSTATEDEGIPDNWMGLDAGPKSNELFAKTVAEAKTIVWNGPPGVFEFDNFAKGTKSLLDAAVKSAESGNTVIIGGGDTATVAKKYGVVDKLSHVSTGGGASLELLEGKELPGVVAISDKK

SEQ ID NO: 67390 - protein, 148 aa, Panax ginseng
MVTGKQTELIPIPFPPYQIPYSSKFTDSPAFIYFVAAFSVAGLYSIITSLLSGLALLKPGYAKQLVSHFVVVDVLLLGIVAAAIGAAGGVGYIGLRGNSHSRWTKICNIYDTFCQHLAGSIAAGLIASIVLVLLILLSFFTLSRKIPK

SEQ ID NO: 67391 - protein, 388 aa, Bacillus clausii KSM-K16
MSYLFPTYSKKSLRIKEGRGAWLQTEDGKDYLDFMAGIAVCNLGHRHPKVVAALHQQVDRLWHASNLFHYDVQEEAAKQLVQASACDYVFFTNSGTEANEAAIKLARKATGKNHIVSMKQSFHGRTLGSMAATGQDGIKSGFGPMLPSFSYAQFNDMASLHEAVSEETAAIMVEIVQGEGGVHVMTASFAEAMVALCKEQNLLLIVDEIQTGMGRTGKLFAYEHYGLDPDIVTVAKGLGNGFPIGAMLGKASLKEAFGIGSHGSTFGGNPLAAATAIAVLAELSADGFLPEVEEKAERFVAYLKGELSGIAIVKDIRHKGFLIGIETAIPALDLIAACEQQGLLLLPAGSHVTRLLPPLTVSESEWRKAVAIIKQAATIYERENSFSS

SEQ ID NO: 67392 - protein, 257 aa, Bacillus clausii KSM-K16
MATVVIKIGGSTLEALEEGFYEGVVKRASLGDKIMIVHGGGPAINNLLQAMAVESQFVNGLRKTTAEVLTAAETALSGQINKQLVRSLYQAGGKAIGLSGSDGHLLKTIPIDTDKLGFVGAVESVNVDVLFNVAKAGYIPVIAPIGMDANYQPYNINADTAAAAVAKASKAEELVFVTDVDGVQKDGKVIKEMDEVLAKHYIEEGVIYGGMVPKVNACLDSLSGALTKARIVNGKKAYHPSAGTAIVKQSNVLTSGA

SEQ ID NO: 67393 - protein, 157 aa, Vibrio sp. Ex25
MIQQGQALPVATLSELTADGMVNHDVTELFANKKVVLFAVPGAFTPTCSEAHLPGYVVLADELKAKGVDLIACVSVNDAFVMQAWGEAQNASEILMLGDGDASFTKALGLEMDTGGFGGIRSQRYAMIIENGIVTKLNVEEPKEFEASKAETILAAL

SEQ ID NO: 67394 - protein, 520 aa, Anabaena variabilis ATCC 29413
MVLESAISEEAIATNLKQFLLVLSVSLGVATLPQVFSWFRQIPYTLLLVIVGLGLAVVDVRLVVLSPALILSIFLPPLLFEAAWNLKWSDLQRDFVPISLYAVFGVIISIAGVAIGLNQLGGISLTTALLIGASLSATDPVSVTALFRELGVGTRLVTLMEGESLFNDGMAVVAFGFLVALPLGSAELGVQPILLQFFQVVGIGVAIGCLIGFAISYLTQRFDLPMVEQSLTLVSAYGTYLVTEDLGGSGVIGVVTTGLILGNFGSRIGMNPRTRIIVSEFWEFLAFFVNSIVFLLIGDQIRFASLGENLQIIAITVGAMIFMRAVTLFILSKLSVMMTQSQVSLPEQTILWWGGLRGSVSIALALSVPTVLPGREKIIATVFGVVLFTLLVQGLTIKPLLQKLNLLGDAPLREQYLQLVARIVALERVLQYLQTEKRPGIGPEFLRYQEKLVTGEIAELQTKIDKLHHEYPNLQNFTTEQFRDELLAIEADTYAEFVKSGRLNKELAPMLEDVLGHQRD

SEQ ID NO: 67395 - protein, 564 aa, Zea mays
  misc_feature (130)..(130): Xaa can be any naturally occurring amino acid
MATRPALVFVCCCLLLAYAAAARVLDEGEPFGRLKNAARRLRDGEPFGGRKDPADPDHSPGSHGTPPCPPSIGTSPTTPTTPGGGSYYPPSPDIGTSPTTPTAPGGSGGYDAPPSPSSDTSPTTPGGGLXGPPSPSSDTSPVTPPGGGGGGYSAPPSPSSDTSPSTPGGGGGCSVPPSPSSDTSPPTPGGGGGYYGPPSPSSDTSPTTPGGGGTGGCSAPPSPSSGSSPSTPGGGGGYYGPPSPSSDTSPTSPPGGDGGGYSAPPSPSSDTSPSTPGGSDGGCSATPPPSSGTSPSTPGGGGGGCSAPPSPSSDTSPSTPGGGGGYYGPPSPSSDTSPTTPSAPSGGYYGPPSPSSDTSPTTPGGGYYGPPSPSSDTSPTTPGGSGGGGYYGPPSPSSETSPTTPGGGGGYTPTPQVPLPPISTSPPFSPLTPTPTTPTPYDPNTPPFTGPCTYWMMHPGVIWGLFGFWCPLVRLFGPSAAVPFGHDLTVPEALANTREDGMGALYREGTASLLNSMVNNRFPFTTQEVKDAFGAALNSGDDGAAAAQARLFKKANEGHVIRQN

SEQ ID NO: 67396 - protein, 510 aa, Mesorhizobium sp. BNC1
MKDVLEELERRRAAAREGGGKARIAHQHAKGKLTARERLEVFLDEGSFEEFDMFVEHRSTDFGMEKTKIAGDGVVTGWGTVNGRAVFVFAKDFTVFGGSLSEAHAEKVMKVQDMALKNRAPVIGFYDAGGARIQEGVAALGGYAEIFQRNVLASGVIPQISVIMGPCAGGDVYSPAMTDFIFMVRDTSYMFVTGPDVVKTVTNESVTAEELGGAHVHTVKSSIADGAYDNDIEALLQMRRLVDFLPSSNTADIPDIEFSPGDGEPDHSLDRLIPTNANKPYDIKELILKTADEGDFFEIQEHFARNIVTGFGRIEGRTVGFVANQPMVLAGVLDSDASRKAARFVRFCDCFNIPIVTFVDVPGFLPGTSQEYGGLIKHGAKLLFAYAEATVPKITVITRKAFGGAYDVMASKHLRGDINYAWPTAQIAVMGAKGAVEIIFRKDIADVEKIAEHTRKYEERFLSPFVAAERGYVDEVIMPHSTRRRIARALRMLRGKDLQNPWKKHDNIPL

SEQ ID NO: 67397 - protein, 508 aa, Candidatus Kuenenia stuttgartiensis
MGKKPIASVDACKLNKDVLRKIPNPATIVIFGASGDLTERKLIPSLFRLDCDGLLPEKLAVVGVARTEMDSEGFRKKLAESIEIYSRHSKDRICKWSKFEKKLIYHRADYDNLEDYKTLNRLLVDLGKKQDIGANCLFYLSTPPILYPVIVSKLGEAGMAQQSDEYWRRIIIEKPFGRDLASAIDLNNHVHQVFDESQVYRIDHYLGKETVQNLLVFRFGNAIFEPLWSRNYIDHVQITVSEEVGLGNRAGYYDTAGILRDMFQNHLLQLLTLTAMEPPAGFNATSLRDEKVKVLKAVRPIKPEEVAKYTVRAQYRTYRDEKGVVRGTETATFAVLKLFIDNWRWRNVPFYLRSGKALNSKVTEISIQFRHVPHLMFPLPPEEQLPPNKLVLCLQPNEGMRLGFETKLPGAGMKTRTVSMDFLYEQDFGENILPDAYERLILDALQGDASLFTRSDEIELAWKIIDPIIQGWESEYAPPLAFYELGTCGPSKADEFIKADDRKWNPCI

SEQ ID NO: 67398 - protein, 472 aa, Candidatus Kuenenia stuttgartiensis
MQKNSFGLIGLAVMGQNLVLNVADHGFSVSVYNRTAERTHEFMSGEAKNKKITATYSPKEFVASLERPRIIQIMVKAGGAVDAVIAELKPWLDEGDIIIDGGNSYFSDTERRTKELESNKLRYIGMGVSGGEEGARFGPSLMPGGTKEAYALIEPLMSAIAAKAPEDGLPCVAYIGHGGAGHYVKMVHNGIEYADMQLIAESYALLKSTINPAPEEFHEIFTEWNNGELSSFLIEITAFIFTKSDDKTGRPLLEMILDKAGQKGTGKWTSQNAIDIGAPVPTITAAVDARILSSMKKERQEASKILSGPKNNYADERGKIIAAVRDALYASKICSYAQGMNLLKRASEEYGYNMDLGEIASIWRAGCIIRAKLLDDITRAYRSRSDLPNLLLDAGFKHAVQSRQASWRFAVKTAFELGIPAAALSASLAYFDAYRSGFLPANLIQAQRDYFGAHTFERIDTSGVFHANWKEK

SEQ ID NO: 67399 - protein, 461 aa, Phaseolus vulgaris
MASSVLSAALNSLSPSYSLSSRQTHKGKPKIGGNALRFNKSFPNARSSGRVMAVAVNGSRFEGIPMAPPDPILGVSEAFKADTSDVKLNLGVGAYRTEELQPYVLNVVKKAENLMLERGDNKEYLSIEGLAAFNKATAELLLGADNPAIKQQRVATVQGLSGTGSLRLAAALIERYFAGAKVLISSPTWGNHKNIFNDARVPWSEYRYYDPKTVGLDFEGMIEDIKSAPEGSFVLLHGCAHNPTGIDPTPEQWEKIADLIQEKNHIPFFDVAYQGFASGSLDEDAASVRLFVARGMEVLVAQSYSKNLGLYAERIGAINVISSSPESAARVKSQLKRLARPMYSNPPVHGARIVADVVGNPVLFNEWRAEMEMMAGRIKNVRQQLYNSITSKDNSGKDWSFILKQIGMFSFTGLNKEQTDNMTNKWHVYMTKDGRISLAGLSLAKCEYLADAIIDSYHNVS

SEQ ID NO: 67400 - protein, 126 aa, Hopea nervosa
VLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVSNHDELMSNFFAQPDALAFGK

SEQ ID NO: 67401 - protein, 299 aa, uncultured archaeon GZfos27B6
MGEEIERILDDYRAAGRILAEVREEAVEKVKEGNSVLEVAELVENRTREKGAEPAFPCNISRNEEAAHATPSIDDETVFGKDIVKLDIGTHINGYIGDSAVTVDLSGNNEGLVKASEAALNEAIKIIRDGVSTIEIGEVIENTIRERGYKPIVNLTGHGLMRYNSHAPPVIPNVKYEHGIILRENNVIAIEPFATDAQGAGKIVEHGNAEIYSLIKSKPVRMIEAKKLLKEIKKYQGLPFAKRWLPRERLDIALRTLKNGGILRDYPVLREEGKGLISQAEHTIIVTADGCEVTTKRVV

SEQ ID NO: 67402 - protein, 237 aa, Brassica napus
MPLVRTALIALFLVAFLQNAAAQKRPQSIVKSRGAVATDDGRCSGIGMSVLRQGGNAIDASVAAALCLGVVSPASSGIGGGAFTVVKIAGGKAIAYDSRETAPLGATEDMYGSNPDLKKKGVLSAGVPGEVAGLYTAWKQHGKLPWKQLVTPAEKLAEGGFRISKYLYMQLNATRVDVLADKGLSELYVSNGELKKPGTIIHNTALAFTLKQIGEYGPKSIYNGTVGVNLARDIRKA

SEQ ID NO: 67403 - protein, 951 aa, Oryza sativa Japonica Group
MPRRSASRYAAYWAADALAGDDALDFSLTKALVGVSPDSLTGAPEAVRERVALRCLQEVVSLASDGDYEATPTAGGVLSVDASRSCEDSLLQLIREIGSSGSLEKVMLLPFSQDVQKFICIKRPTLPETSFELLREVYPEITPVVLPSPVEQNGNDQHDNVSHDLENTEKTGFNTDGAQLQQDDLANLVNESNTGNLQKDAMATPDFHQPCTSENRCFDQPQEDSINAVGVNIRSPKDSPTNVDRHIQVAAEPSLATSADLLGSNTGTISEQDMIDDTTMVQSQSQGVKNPNTLHYNNGDEPLVASIQSPKDSIHEGLTIQATVSPAFDRSNDALPASTSEISQLPEFITARDTVMNSEPRINKSHPNSPKHDTVDKANQDVDYGSVGIQKAAAFLSEDRNGATQGEKSEIKDPPENTAEHTKMFEQENSVEAQLEVGCSDKVNQDIQDDGNIMTKNMVCDGLNVQTAPEPHSCRMALHNKNLVANHLSEQNIGRNTTAVEKDCCSIPTSPQVVNDTRVKQPSNKRTMGNTVVETSHVHSSDDSLSGFAATGLLSMADKIPFCTQDQDANGPVEGLSEQDLCIKCGKDGQLLKCSSCLLAAHDTCFGSLATLDDSGQLYCPVCFYTKATEAYQKAKKTYSEARKNLSAFLGRKQLAEQHQQAAVGQRAANNEDHLNGCNDASKRKDNHQSEGNNLSHRDEDPTRKRKKQKTNATSDACAQEVVTEKVPVVQNSDVAPMNKHSVLQNNRKQAQVAEHEQPEENEEASGESGNDNSLHKTTHSSQTKCSPAVNQNVDADKENGLASSQQSEDSDEIEATSSNDSTKKSSPPWRKLRHRKAIYQDKDTAMPSNSKKVLGNRDQHMASPSRKRNYACPPKRYSNPIVPAGRRTKLCWTEKEEITLREAMAKFTPRDNGPIPWVQILEHGRDVFHRTRLPSDLRVKWRNMKKKSGS

SEQ ID NO: 67404 - protein, 126 aa, Hopea subalata
  misc_feature (108)..(108): Xaa can be any naturally occurring amino acid
VLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVSNXDELMSNFFAQPDALAFGK

SEQ ID NO: 67405 - protein, 279 aa, Prochlorococcus marinus str. MIT 9215
MRHFADLLLNTNNSKANDQVPFIQRRRGIEIKSSREINLMKKSSKIVATVLREISDLIKPGLSTKDLDDFAEKRIKSFGAVPSFKGYHGFPASICSSINNEVVHGIPNKNKIIKNGDLVKIDTGAYLDGFHGDSCISICVGEVSRKAQNLSDVAYKALYAGLSKIKAGNTLLDVAGEIEDIVLKNGFSVVEDYTGHGVGRNLHEEPSVFNFRTKELPNVVLREGMTLAVEPIVNEGTKYCKTLNDRWTVITKDGKLSAQWEHTIVVLKDGIEILTDRDF

SEQ ID NO: 67406 - protein, 440 aa, Photorhabdus luminescens subsp. laumondii TTO1
MNSTKTVSIQHVINNQKFSKVQWQVLILCFLIVVIDGFDTVLMGYIAPAVVNDFKVEGAILGPAMSAALVGLSLGSIFAGPLADRFGRKSVLTISVTVFGLLSLATAIADSIQTLTILRFLTGLGLGAAMSNAITLISEYAPENRRSLLINIVFCGFPLGAAVGGIISAWIIPHFGWQGVLILGGILPLFLSLFLFSLLPESLRYLVSKGGAEGNIRRILSKMTGNTLNDINKFTFDGEEIIHKSSIKTVLSNRFLIGTAMLWITYCMGALVFYVLTSWMPFLMNDVGFSVSMAATLTALFPLGGVISTVFSGWLMDRINPHKVVATNYALAGILVFFIGQEENVLLLSILIFLAGITMNGAQASMGSISAQFYPTHCRATGVAWMLGFGRFGGIFGTLFGAELIRLELSYSTIFAILSIPAIIAALSLTFKDVSYRRHK

SEQ ID NO: 67407 - protein, 221 aa, Solibacter usitatus Ellin6076
MEGLTERLTAVRLRIERAAEHARRNPAEILLLAVTKIFPASAIREAYDLGLRDFGENYVQEFEGKAPEVAGLPGARFHLIGHLQSNKSSKAAELFHSIQTVDSAKLARRLNESGRPLDVMIEVKLSGEDAKSGVDPAQLPDLIQATRACPNLNLRGLMTMPPWSEDPEAPRAIFRTLRELAAEHGLPGLSMGMSNDLETAIEEGSTCVRVGTALFGRRNKP

SEQ ID NO: 67408 - protein, 148 aa, Triticum aestivum
  misc_feature (140)..(140): Xaa can be any naturally occurring amino acid
MSAGATVNWIRTPFHTQRFHDFSSLSFRCRNTFGSIQPCWLATDQDSSLSKVRVAADYSDSVPDSKYMRDRGYHPLEEIKERPKKKDISLTDVETARTVVEANSKGLLVFPARVHNEPHGHVSWSEFQYVVDDYGDIFFXVPDDGNIL

SEQ ID NO: 67409 - protein, 164 aa, Alkalilimnicola ehrlichei MLHE-1
MIRVGQGFDAHRFGEPGTPLILGGVQVPHERGLAAHSDGDVLMHAVTDGLLGAAGEGDLGTHFPDSDDAYKGIDSRILLRDALQRVRAGGWRVVNVDATLIAQAPRMNPHVGAMRDHLAADLEVAPSAVNVKATTTERMGFPGRGEGIAAMAVVLIARDGFFEH

SEQ ID NO: 67410 - protein, 321 aa, Yersinia pestis KIM
MPEVLLVPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQQNLENPIVVSPDIGGVVRARAIAKLLNDTDMAIIDKRRPRANVSQVMHIIGDVAGRDCVLVDDMIDTGGTLCKAAEALKERGAKRVFAYATHPIFSGNAVDNIRNSVIDEVIVCDTIPLSAEIKALKNVRTLTLSGMLAEAIRRISNEESISAMFEH

SEQ ID NO: 67411 - protein, 293 aa, Arabidopsis thaliana
  misc_feature (21)..(21): Xaa can be any naturally occurring amino acid
  misc_feature (34)..(34): Xaa can be any naturally occurring amino acid
  misc_feature (42)..(42): Xaa can be any naturally occurring amino acid
  misc_feature (50)..(50): Xaa can be any naturally occurring amino acid
  misc_feature (74)..(74): Xaa can be any naturally occurring amino acid
  misc_feature (101)..(101): Xaa can be any naturally occurring amino acid
  misc_feature (136)..(136): Xaa can be any naturally occurring amino acid
  misc_feature (144)..(144): Xaa can be any naturally occurring amino acid
  misc_feature (178)..(178): Xaa can be any naturally occurring amino acid
  misc_feature (199)..(199): Xaa can be any naturally occurring amino acid
  misc_feature (219)..(219): Xaa can be any naturally occurring amino acid
  misc_feature (265)..(265): Xaa can be any naturally occurring amino acid
TITSSFHPNQNLKHHTITHRXHRGTFPAYKRRRXLVDETIDXQDLSNPAXKIHTKSALRLWNLGRFREAFCRSXPPPERRLLQAIHLFSIPPPSAPPLVLXEYKNAETAGLTNPTTPPSPLAPKKNTPVASPVTEXPMPDTLIXPQAETAENTSVPDAAVSNATRATAHRQVFDERQXLARPLKSPLVPTHTQRFLSAXAAVRSNTIDPRGFLFPPPLXLKKRVWKNTRIFLAPSGKDPSEVAVGPNVPGDVRGFFAVLPELDFXCGLVLVFFGAVVWFSPALSIPVLVDGPL

SEQ ID NO: 67412 - protein, 150 aa, Oryza sativa Japonica Group
MRKRRTWAALFLAVYASLLCSSWRLVESVRAWYYSAAGGAGAVAAWPAAFYASVMYGAVFGLLSMGAALAVAAPAMLITWITVLVLLAFAGKPRRSLVAEGRRATADIARLALRVLLREGNAVAALCAAASFAALLLGRRDDDPAEGSGS

SEQ ID NO: 67413 - protein, 465 aa, Clostridium pasteurianum
MPEHIGKVVQVIGPVIDIKFASENLPNIYNALEIGMGDKILIAEVEQHIGDDVVRAISMEPTDGLRRGAKAVDTEKPISVPVGKPVLGRLFNVLGKTIDEAGDLKDDEYYPIHRLPPSFEEQSVVPEMFETGIKVIDLLAPYQKGGKIGLFGGAGVGKTVLIQELINNIAKEHGGLSVFTGVGERTREGNDLYYEMKESGVIDKTALVFGQMNEPPGARMRVALTGLTMAEKFRDEGQDVLLFIDNIFRFTQAGSEVSALLGRIPSAVGYQPTLATEMGALQERITSTKHGSITSVQAVYVPADDLTDPAPATTFTHLDATTVLSRSISELGIYPAVSPLESSSRILDPNIVGEEHYQVASKVKLILERYNELQDIIAILGVDELSEEDRAIVNRARRIQRFLSQPFSVAEQFTGMQGKFVSVSDTIKGFKEILEGKCDDLPEAAFLFVGTIEEAREKAKSMMES

SEQ ID NO: 67414 - protein, 478 aa, Arabidopsis thaliana
  misc_feature (120)..(120): Xaa can be any naturally occurring amino acid
MTILLCFFLVSLLTIVSSIFLKQNKTSKFNLPPSPSSLPIIGNLHHLAGLPHRCFHKLSIKYGPLVFLRLGSVPVVVISSSEAAEAVLKTNDLECCSRPKTVGSGKLSYGFKDITFAPYXYIREEEVDFVVKKVSESALKQSPVDLSKTFFSLTASIICRVALGQNFNESGFVIDQDRIEELVTESAEALGTFTFSDFFPGGLGRFVDWLFQRHKKINKVFKELDAFYQHVIDDHLKPEGRKNQDIVTLILDMIDKQEDSDSFKLNMDNLKAIVMDVFLAGIDTSAVTMIWAMTELIRNPRVMKKAQESIRTTLGLKKERITEEDLGKVEYLNHILKETFRLHPALPFVVPRETMSHIKIQGYDIPPKTQIQLNVWTIGRDPKRWNDPEEFNPERFANSSVDFRGQHFDLLPFGSGRRICPGMPMAIASVELALMNLLYYFDWSMPDGTKGEDIDMEEAGNISIVKKIPLQLVPVQRY

SEQ ID NO: 67415 - protein, 449 aa, Zea mays
  misc_feature (348)..(348): Xaa can be any naturally occurring amino acid
MATHAALAASRIPAGARLHSRAAASRHGVQRVDFADFSGLRPGSCSVSAAAREASFSDVLGAQLVAKATGENAVRAPAEAKLKVAINGFGRIGRNFLRCWHGREDSPIDVVVVNDSGGVRNASHLLKYDSMLGTFKADVKIVDDTTISVDGKPITVVSSRDPLKLPWGELGIDIVIEGTGVFVDGPGAGKHIQAGAKKVIITAPAKGADIPTYVVGVNEGDYDHSVADIISNASCTTNCLAPFVKILDEEFGIVKGTMTTTHSYTGDQRLLDASHRDLRRARAAALNIVPTSTGAAKAVALVLPQLKGKLNGIALRVPTPNVSVVDLVINTVKTGITADDVNAAFRKXAAAGPLQGILDVCDVPLVSVDFRCSDVSCTIDASLSMVMGDDMVKVVAWYDNEWGYSQRVVDLAHLVAAKWPGAAAAGSGDPLEDFCKDNPETDECKVYEA

SEQ ID NO: 67416 - protein, 139 aa, Glycine max
MASMTTMLQTMVPKNAPNLPPRVGVSNNTTKISFAGSGRVPCTRIQRNRNRSSSIVVAAVGDVSSDGTTYLVAGAIAVALIGTAFPIFFSRKDTCPECDGAGFVRKADVTLRANAARKDQTQIVCARCNGLGKLNQIDK

SEQ ID NO: 67417 - protein, 92 aa, Triticum aestivum
ETIRDVVAESENVLEKLQKQEATMREELTRRAKELHDKEFKLLYQNPSPCTDERAGCTDCYRSNTQDPLKCAEAVKRFEACVRMASRMGAAQ

SEQ ID NO: 67418 - protein, 368 aa, Picrophilus torridus DSM 9790
MNLYEYMGKEIFRNYGIPVPDGYTIEKTDEIRDVSYPVAIKSQILIGKRGKAGGIKFADNKNDAVKYASELLGSKINGMTVTKLLIEKKLDIKKELYLSITMDRTNRAPVIIASTEGGMDIEEVPDDKIVKRVIDPLIGYSQYIGREIVSSMKLDADLSKSFLEILERLYRVFMGEDALLVEINPLVIDGNKNIIAADSKIVLDDNALFRHKEINIRDPEKTELEIESQSKSFTFIEMDGDIGVIANGAGLTMATLDALTLHNLKPRNFLDLGGTDSIDIVKDAFSFVMKADPDIIFVNIFGGVTKADTVANGIVASKKEFNITKPIVVRLSGIHEDEGRRILKDNGINAFSNMNDAILDIVKIKEGK

SEQ ID NO: 67419 - protein, 315 aa, Synechococcus elongatus PCC 7942
INGFGRIGRLCLRAGFDDPQLDFVAINDLVPPKNLAYLLHYDSTHGRLQQTVRAEEDRICAGDRCIQCFSETDPAAIPWGELGVDVVIEATGRFTDYRAASRHLEAGAQRVVISAPTSEKDPDRVPTFVYGVNHQNYDPQQHRILSNASCTTNCLAPIAKVLQEHCGIEDGLMTTIHAVTATQPTVDGPSRKDMRGGRSAAQNIIPASTGAAKAVGLVLPELQGHLTGMALRVPTADVSVVDLTFRSRQSTTYAAICEVMQKAANTQLQGILGYTEDDLVSSDFIGDARSSIFDATAGMALNDRFFKVIAWYDNE

SEQ ID NO: 67420 - protein, 435 aa, Solibacter usitatus Ellin6076
MTNRRQLGLFDATMIVMGGIVGSGIFMNPSVVARQVHTPFLILGVWLAGGALAILGAFIWAELATRLPGAGGQYLYLREAYDPAVAFVYGWVLLLVTQTGGMAAVAVTFARYYREISGVAWSDSAIAAAVLLGLTAINCMGARAGSNVQSALMLMKTGAIAVLVIAGIALGGGTIHPLPLLDRPVSLGLLGALGAGMIPVAFAYGGWQTATFVAGEMRNPGRDLSRGLVAGVTGVVVLYLAVNVVCLKVLRPEGLAATRTPASAVMRAAMGDRGAWWIALGIAISTLGFLSQGMLTAPRVYNAMARDGLFFERVGRLSPRTGAPVTAIVLQGIASTVIAFSGKYEQILNYEVSVDFIAFALAGGALFLFRREGRGDQQGGIYRAPGHPYTTALFVAACVAIVASTVITDPLNSARGWGIMLTGVPVYLYWRRKAQ

SEQ ID NO: 67421 - protein, 337 aa, Microdochium nivale
MVVKVGINGFGRIGRIVFRNAIEHDDIEIVAVNDPFIETKYAEYMLKYDSTHGNFKGTIEVASDGLVVNGKKVQFFTERDPSAIPWGKAGADYVVESTGVFTTIDKAGAHLKGGAKKVIISAPSADAPMYVMGVNNETYDGKADVISNASCTTNCLAPLAKVIHDKFTIIEGLMTTVHSYTATQKTVDGPSAKDWRGGRTAAQNIIPSSTGAAKAVGKVIPDLNGKLTGMSMRVPTANVSVVDLTVRIEKGASYEQIKEAIKEAANGPLKGVLAYTEDEIVSSDMIGNPHSSIFDAKAGISLNDNFVKLVSWYDNEWGYSRRVLDLLAYIAKVDAGK

SEQ ID NO: 67422 - protein, 499 aa, Bacillus clausii KSM-K16
MERNKRLAAERARLASGGGTKKQQAQKQAGKQTARERIGMLLDRESFTEHLAFASGSGGEAGDGVIVGYGTISGRLVCVYAQDFTVSGGSLGAMHAKKICAIMDLAYDMQAPLIALIDSGGARIQEGAKALAGYGDIFKRNVRYSGAIPQLSVMLGPCAGGAVYSPALTDAIFMVDQMSQMVITGPKVLKAATGAEVKMEDLGGARMHSEKSGVAHFCAKTEAELFVLVRQFLSYLPNNGAKKPCHKRVSEKVSAHLPRDSKTVYDMVPIICGLADENSFFEWSKRYARNLITAFIRLDGQPVGVVANNPKHLAGCIDMDASDKCARFVRFCDCFHIPLLVLEDVSGFIPGVEQESRGLIRHGAKIIYAFAEATVPKITVIVRKAYGGAYVALNSKALGADFVYAWPGAEIAVMGPAGAAAVLHQKDIQASNDPAKALLQFEENYREKVADPFSAAKEALIDDVIEPDETRQRLIESFSILACKDERANWQKKHGNMPL

SEQ ID NO: 67423 - protein, 67 aa, Glycine max
MDAAKKIDCGGKCNSRCSKARRQKMCIRACNSCCKKCRCVPPGTSGNRELCPCYARLTTHGGKLKCP

SEQ ID NO: 67424 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLIALPIDKVDPTHSYVKDIDDLSKHTLDKIKHFFETYKDLEPNKWVKVKGFEN

SEQ ID NO: 67425 - protein, 342 aa, Gibberella zeae PH-1
MSRQTPRKPRHSRQPSNRIPAVSDYESDAAAIHNDYAPPPPRTNTELNLSVLQRYLPSIHTILSIAANAVIYTFNSASESWEKSGVEGTMFVCAQSPSSEDPAQQPRACVFVLNRRGLDNVIVDLSRVSHAEVSGELVIMKVEGDWEEGDKVLGVWIHNDKDETREMNAAIIQEAWKIARSAGPVASVMHAKPETENPESEESEEFEESKMEGSKGKGKQKAENPAPVKPEAMKPKESVSKTHVSKIQVSKIQLSKIHVPKANVAKDNDPEDNGPKDKEPKGNDRKGKDLKVENSEDEDEDEGEDEGEDEGEDSKIDMPEVELPNEEKPESAGSESDVNTTD

SEQ ID NO: 67426 - protein, 126 aa, Hopea odorata
  misc_feature (16)..(16): Xaa can be any naturally occurring amino acid
VLLGLLSIWNVSFLGXPARAILPYSQALEKFAPHIQQVSMESNGKGVSIDGMPLPFEAGEIDFGEPGTNGQHSFYQLIHQGRVIPCDFIGSAKSQQPIHLKGEVVSNHDELMSNFFAQPDALAFGK

SEQ ID NO: 67427 - protein, 529 aa, Arabidopsis thaliana
MGHRHSKSKSSDPPPSSSSSSSGNVVHHVKPAGERRGSSGSGTVGSSGSGTGGSRSTTSTQQNGRILGRPMEEVRRTYEFGRELGRGQFGVTYLVTHKETKQQVACKSIPTRRLVHKDDIEDVRREVQIMHHLSGHRNIVDLKGAYEDRHSVNLIMELCEGGELFDRIISKGLYSERAAADLCRQMVMVVHSCHSMGVMHRDLKPENFLFLSKDENSPLKATDFGLSVFFKPGDKFKDLVGSAYYVAPEVLKRNYGPEADIWSAGVILYILLSGVPPFWGENETGIFDAILQGQLDFSADPWPALSDGAKDLVREMLKYDPKDRLTAAEVLNHPWIREDGEASDKPLDNAVLSRMKQFRAMNKLKKMALKVIAENLSEEEIIGLKEMFKSLDTDNNGIVTLEELRTGLPKLGSKISEAEIRQLMEAADMDGDGSIDYLEFISATMHMNRIEREDHLYTAFQFFDNDNSGYITMEELELAMKKYNMGDDKSIKEIIAEVDTDRDGKINYEEFVAMMKKGNPELVPNRRRM

SEQ ID NO: 67428 - protein, 132 aa, Helicobacter pylori
SNIKYELDKESGALMVDRVLYGAQNYPANYGFVPNTLGSDGDPVDVLVLSDVAFQAGSVVKARLVGVLNMEDESGMDEKLLALPIDKIDPTHSCVKDIDDLSKHTLDKIKHFFETYKDLEPNKWVKVKGFEN

SEQ ID NO: 67429 - protein, 386 aa, Escherichia coli O157:H7 EDL933
  misc_feature (240)..(240): Xaa can be any naturally occurring amino acid
MTSENPLLALREKISALDEKLLALLAERRELAVEVGKAKLLSHRPVRDIDRERDLLERLITLGKAHHLDAHYITRLFQLIIEDSVLTQQALLQQHLNKINPHSARIAFLGPKGSYSHLAARQYAARHFEQFIESGCAKFADIFNQVETGQADYAVVPIENTSSGAINDVYDLLQHTSLSIVGEMTLTIDHCLLVSGTTDLSTINTVYSHPQPFQQCSKFLNRYPHWKIEYTESTSAAMEXVAQAKSPHVAALGSEAGGTLYGLQVLERIEANQRQNFTRFVVLARKAINVSDQVPAKTTLLMATGQQAGALVEALLVLRNHNLIMTRLESRPIHGNPWEEMFYLDIQANLESAEMQKALKELGEITRSMKVLGCYPSENVVPVDPT

SEQ ID NO: 67430 - protein, 339 aa, Solibacter usitatus Ellin6076
MTPNLPDASPVLDLIEAFRRSKTMFTALSMGVFDTLHEAPSNAETLAAKLGANAGALARLLDGCAALQLLQKRDGLYENAPLSETYLYSGSPHSMSGYVRYSEQALYPMWGNLADAVREGTPRWSQNFGIDGPIFSAFFRTPEAMRDFLMGMHGFGMLTSPKVAAAFDLSRFRRLVDLGGATGHLTIAACELYPEMRGVVFDLPQAAGMARELVERSAASARVEIVSGDFFADELPEADLYYTGRILHDWSEEKIDRLLARIVQRLPSGGALLIGEKLLAEDGVGPVPANMQSLNMLVVTEGRERSLGEYRGLLMRAGFASVEGRHTGVALDAILAIKA

SEQ ID NO: 67431 - protein, 126 aa, Hopea dryobalanoides
  misc_feature (102)..(102): Xaa can be any naturally occurring amino acid
  misc_feature (108)..(108): Xaa can be any naturally occurring amino acid
VLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKXEVVSNXDELMSNFFAQPDALAFGK

SEQ ID NO: 67432 - protein, 429 aa, Alkalilimnicola ehrlichei MLHE-1
MGTIKQIKAREILDSRGNPTVEADVILDSGVMGRAAVPSGASTGTREAVELRDGDAGRYLGKGVRKAVENVNTVIADALCGMDASGQRALDDRMRELDGTDNKGKLGANALLAVSLAAARATAAERGQSLFRYLNPEGPWSLPVPMMNILNGGEHADNSVDIQEFMVMPTGFDRFSEALRCGTEIFHALKKVLQDRGLNTGVGDEGGFAPDLPSNEAALEVILEAIDRAGYKAGENVWLALDAASSEFYQDGVYRLASEGREFSAEAFADYLADLCARYPILSIEDGMDESDWVGWKALTDKLGDRVQLVGDDLFVTNTRILKRGIDEGVGNSILIKFNQIGTLSETLDAIAMAHEAGFTSVVSHRSGETEDTTIADLAVATTATQIKTGSLSRSDRVAKYNQLLRIEEELGEQADYPGLAAFPQLRRG

SEQ ID NO: 67433 - protein, 333 aa, Propionibacterium acnes KPA171202
MHAITVRPTDKTDSKGRHRPGPECIEWTEVPTPKPGPGEVLVKVKAAGINRGDLLQRQGLYPPPKGVSETMGLEVTGVISSLGQDVTGWSEDDEVIALLAGGGYAEYVIVPAGQLLPIPEGIDPVTASTLIEVTATVISNMDHVGLARGETFLVHGGAGGIGQFAIQYAKSLECTVITTCGTAEKQEFCRTLGADVALDYHEDWVAGVKDATGGRGADVILDVMGAKYLDLNVDALAIGGRLDIIGMQGGIKGELNIAKLLNKRALVTATSLRPRPLEEKAKICQRVREVAWPLYTNGSIKPAPVESFPMSEAGRAHERLESGEVLGKVALTL

SEQ ID NO: 67434 - protein, 329 aa, Marchantia polymorpha
MTGKFAGSGAGLCIFVVVLALFVSQAPSVDAQLDQNYYVGTCPNVENLVNQWLVANVFTDPTGPAALVRLVFHDCQVNGCDGSVLLDTQPGAVSELESDANFGIRDLRFIDSIKAAVELACPGVVSCTDILALAARDCVRLTGGPSIRIPLGRKDGRSASNLAADRQLPPSDISVPAFLSEFAQMGMTADEAVAIIGAHTIGVGHCVNVVNRLFPQQDPALSPLMAGQLLTQCPTPNAAFLNNNTILSNDFTNFVFDNQYYRDVMNGNGLFKIDSLIGQNPTTAGIVARFAANQNDFFGVFSRAFVKMTSFRVLTGAQGEVRRNCHRLN

SEQ ID NO: 67435 - protein, 719 aa, Propionibacterium acnes KPA171202
MALVLVLAVGAQWLGWRLRLPALLFLLVIGFALGQWVTPDEIFGRKLLFDGVNLSVAIILFEGSLGLKLREVRDLGRPIFQLCTVTAGLAWVLITGAAMALGFDGRVSLLLGAILIVTGPTVINPILRQLRPTRRVSALLRWEGIVVDPLGAILALLVYQAITSIDGSSIGQGVLNLGLTLLVGLLFAGPIGWIVTAMMRRHLIPDFLQGVIFVGVAVGTCVGANVIREESGLVAVTMLGIYLANQRNLELEPVIEFKEHLQVLLVGVLFIMLAGRVTPSQILDILSAGLIFVALLVLVIRPASVLLGLVGTETTRQERTLMSFMAPRGIVAASVASIFAMQFSESADHVREQAKQIAASDPEHSKRLFSFANQIAGMASQVDRLVPLVFLVIVCTVAIYGLGIGRLAEKLGLASASPRGVMFAGSPAWTIDTAKTLRDFDVPTLIVTRRAYDLYAVRKAGLRCEAADFLSEYATEDMDLAGIASMVACTPDDDTNSIASVHYRRALGRANVFQLERMDERDDGDATTGTAQILKARTAFDPPTSHSAMDKMWRNGKRVRRVKLDENRNWEMFREAMPDAVVMFVVKPSSVNVATNGMSAPKEDDTIIYLGDEWKDAPEPVAAQEEQPRRQTMSVPSSEEAVRDRIDADRRAAEGKNKAAASATAGDPADTTVDHGDKGEKPEQTSEASGGVEDPVRPRFDELSPGRPSPVSADSPSEW

SEQ ID NO: 67436 - protein, 151 aa, Glycine max
MGNQYHQATDGLLSLFTKANHDLSMVHHRLEKEFQQVYPDNANPMKLVSRIKKIQEDISILKGQCHELLAAKQDLIDKAQRILVENRNLVQRMQPSLGISRTGEDDAAFTNFKQVIEEWTAQVRSKTGNETHDSDSGDINKLLFSAIVQSN

SEQ ID NO: 67437 - protein, 117 aa, Vitis vinifera
MAATATASGGKFDKKLPGEKPEKHKGKYRKFLPVVEGTGIGSLEKQQTEKILNKLISKNSHEILNVDKAINMYNVKKEKKRKNRQGKDSSTSSKLKPKKQLQKKSLKKGTSKKGKSK

SEQ ID NO: 67438 - protein, 191 aa, Solibacter usitatus Ellin6076
MSSLKAEFVVSSGKPDTFPSDRLPEIAFLGRSNVGKSSLINALTGHKKLAFTSNTPGRTQTINFYRVDEKFYLVDLPGYGYARVPAGFAEQWKVLIEHYLEFRETLKFSCLILDTRRGWMEKDLDLKRWLDHHGRPYLVVATKTDKLNQSEQERGLRAIRQEGVEPLPFSALSGRGVREIWQAITTTLQAR

SEQ ID NO: 67439 - protein, 207 aa, Vitis vinifera
MGTQEHQIDLGHLLAFDPLHHFPSPPSSREELVKECLQKGTELVQSIADTLFNLPSTEDIDGPLVKLPPPTTRLPREKHLPKPKPPTKWELFAKAKGIKNRKKDKIVYDEQTGTWKRRHGYDRVNDDEDIPIIEAKMTDAGEDPFAKRRAEKKKRVEKQGKNRLQNLKQAAKVGALPRFFSFTVNLPYLLLEPKLPQRKSAKMNLRM

SEQ ID NO: 67440 - protein, 81 aa, Brassica napus
MAEQGMEGSQPVDLMKHPSGIIPTLQNIVSTVNLDCKLDLKSIALQARNAEYNPKRFAAVIMRIREPKTTALIFASGKMVC

SEQ ID NO: 67441 - protein, 431 aa, Oceanobacter sp. RED65
MAKIIDVKAREVMDSRGNPTVEADVLLEGGFFGTACAPSGASTGSREALELRDGDKTRYMGKGVLNAVANVNGAIKNALVGMDATDQKALDHKMLELDGTDNKATLGANAILAVSLAAAKAAASAKGIELYEHIAELNGTAGQFSMPLPMMNILNGGEHADNNVDIQEFMVQPVGFTSFSEGLRAGAEIFHNLKKVLQGKGLNTAVGDEGGFAPNLASNADALAVIKEAVSAAGYQLGKDITLALDCASSEFYKDGKYDLSGEGKVFSAEEFSDYLAELCDQYPIVSIEDGQDESDWDGWKYQTEKLGSKVQLVGDDLFVTNTKILKEGIEKDIANSILIKFNQIGSLTETLEAIKMAKEAGYTAVISHRSGETEDTTIADLAVGTCAGQIKTGSLCRSDRVAKYNRLLRIQEQLGDKAVYNGLKEVKGQA

SEQ ID NO: 67442 - protein, 266 aa, Picrophilus torridus DSM 9790
MIIGYFGDPGSYTSMAAKLMLGGRYVSYRSILDIVNAIERNELDFGVVPIENSIEGQVGQTYDIIYYKDIYINSEYYMKIDHCLIGNSEINKIRFVHSHPQALAQCSNFINKNGFIPVPEYSTSYAIKTISEINNDEHAAIGSEEAANLYNLKIISKSIQNNINNYTRFISISKHMNDHGDKYSIGFSLENRPGSLSRILNIISAFNINMTKIESRPYAKNPFSYIFFIDFEDNGYGNVLIDIIKRETINFKLIGLYRKSGIETGY

SEQ ID NO: 67443 - protein, 743 aa, Gibberella zeae PH-1
MAAAATPTAAARPSPAPADSREDSRSSSSSTSPAPADNEESDFFLGANDSQSSIGVPNFQDMQVEDACQPPVHRLPNEILISVFAKLSSTSDLFHCMLVCKRWARNTVDQLWHRPACTNWKNHASICQTLGMENPSFRYRDFIKRLNLAALADKVNDGSVMPLSVCTRVERLTLTNCRNLTDSGLIALVENSNSLLALDISNDKNITEQSINAIAKHCNRLQGLNISGCESISNESMITLATRCRYIKRLKLNECGQLQDDAIHAFAENCPNILEIDLHQCARIGNGPVTSLMVKGNCLRELRLANCELIDDEAFLTLPYGRTFEHLRILDLTSCHRLTDAAVQKIIDVAPRLRNLVLAKCRNITDTAVHAISKLGKNLHYVHLGHCGNITDEGVKKLVQNCNRIRYIDLGCCTNLTDESVKRLALLPKLKRIGLVKCSSITDESVFHLAEAAYRPRVRRDASGMLVGNEYYASSLERVHLSYCVNLTLKSIMKLLNSCPRLTHLSLTGVAAFQRDDFQPYCRQAPPEFTQHQRDVFCVFSGTMVSKFRDFLNTSPQFEDMWDNGWNRPAVFGSRRAVAASQPTAPPGDGVDDEMVDDENDFEGLDGSEMVVDAQAQNPVNGNGTVNPNGLTNQTFQQAIPIPPPLPLPGFPIGQHPTFFQPHTRFLSSSPFLRQDPRLFRPMFFQTSINNMTEGGISQPVTSQASAALLGYGGPANGESPTGASTATIHRPQENGDQSDSMN

SEQ ID NO: 67444 - protein, 561 aa, Triticum aestivum
  misc_feature (248)..(248): Xaa can be any naturally occurring amino acid
  misc_feature (420)..(420): Xaa can be any naturally occurring amino acid
  misc_feature (493)..(493): Xaa can be any naturally occurring amino acid
  misc_feature (526)..(526): Xaa can be any naturally occurring amino acid
HLLLRLRPIPGDLVEQVCTKKQAGTGPEFPGYRRPTRPISPDFNKLNRLGSLILDSNDFSGEIPKLDLPTLEQFNVSYNKLNGSIPRKLRKMPKDSFLGTGLCGGPLGLCPGETADTPAGSPEGQPGAGGAADVGGGKKKKKLSGGAIAGIAIACVFGLLLLLALIFFLCRKKKSGSAPRSSTAAVEKGRDLGMGPLDGEPKGQNGNGVHGAGAAAGAVPAAAAAAAVAAKSARGSTAGSKKLIYFGXPMAAAPPFDLEDLLPASAEVLGKGAFGTAYKAVMESGAAVAVKRLKDVDLPEPEFRERIAAIGAVQHELVVPLRAYYFSKDEKLLVYDYMSMGSLSALLHGNRSSGRTPLDWEARSAIALSTARGVAHIHSTGPTASHGNIKSSNVLLTKSYEARVSDHGLPTLVGPSFSPXRVSGYRAPEVTDIRRVSQKADVYSFGVLLLELLTGKAPTHAVVNEEGLDLPRWVQSVVREEWTAEVFDQELLXRYHNVEEEMVQLLQLAIDCSAQHPDRRPSMSDXAARIDEIRRSASSPAQHATTDSPAAPAPEGDEPSL

SEQ ID NO: 67445 - protein, 327 aa, Medicago truncatula
MASITTDTTKHIISEIPTYITVYSDGTVDRPRQAPTVSPNPDHPNSPSKDIIISQNPNISARIYLPKVSHSETQKFSILVFFHGGGFFFESAFSKIHHEHCNVFVPLANSIVVSVEYRLAPEHPLPACYDDCWNSLQWVASNSAKNPVNAEPWLINHGDFNRVFIGGPSSGGNIVHNIAMRAGSEALPNDVKLVGAILQQPLFFSSYPVGLESVKFKSSDKDLYSSVWNFVYPSAPCGIDNPMINPVGIGAPSLDGLGCDRMIVCVAGKDGLRERGVWYYELVKKSGWKGKLELFEEENEDHVYHIFHPESESAHKLIKHLASFLHE

SEQ ID NO: 67446 - protein, 126 aa, Hopea apiculata
VLLGLLSIWNVSFLGYPARAILPYSQALEKLAPHIQQVSMESNGKGVSIDGVPLPFEAGEIDFGEPGTNGQHSFYQLIHQGRVIPCDFIGSAKSQQPIHLKGEMVSNHDELMSNFFAQPDALAFGK

SEQ ID NO: 67447 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLIALPIDKIDPTHSYVKDINDLSKHTLDKIKHFFETYKDLEPNKWVKVKGFEN

SEQ ID NO: 67448 - protein, 511 aa, Aspergillus niger
MASTIARTEERQNAGTMELKDDTVIIVLGASGDLAKKKTFPALFGLYRNKFLPKGIKIVGYARTNMDHEEYLRRVRSYIKTPTKEIEEQLDSFCQFCTYISGQYDKDDSFINLNKHLEEIEKGQKEQNRIYYMAFPPSVFTTVSDQLKRNCYPKNGVARIIVEKPFGKDLQSSRDLQKALEPNWKEEEIFRIDHYLGKEMVKNILIMRFGNEFFNATWNRHHIDNVQITFKEPFGTEGRGGYFDEFGIIRDVMQNHLLQVLTLLAMERPISFSAEDIRDEKVRVLRAMDAIEPKNVIIGQYGKSLDGSKPAYKEDETVPQDSRCPTFCAMVAYIKNERWDGVPFIMKAGKALNEQKTEIRIQFRDVTSGIFKDIPRNELVIRVQPNESVYIKMNSKLPGLSMQTVVTELDLTYRRRFSDLKIPEAYESLILDALKGDHSNFVRDDELDASWRIFTPLLHYLDDNKEIIPMEYPYGSRGPAVLDDFTASFGYKFSDAAGYQWPLTSTPTVCK

SEQ ID NO: 67449 - protein, 387 aa, Mycobacterium avium 104
MDLFEYQAKELFAKHNVPTTPGRVTDTAEGARDIAAEIGRPVMVKAQVKTGGRGKAGGVKYAATPEDAYTHAKNILGLDIKGHVVKKLLVSEASDIAEEYYISFLLDRANRTYLAMCSVEGGMEIEEVAATKPERLAKVPVDAVTGVDLATARSIAEKGHLPAEVLDAAAVTINKLWELFVAEDATLVEVNPLVRTPDNQILALDGKVTLDANADFRQPGHAAFEDRDATDPLELKAKEHDLNYVKLDGQVGIIGNGAGLVMSTLDVVAYAGEKHGGVKPANFLDIGGGASAEVMAAGLDVILHDKQVKSVFVNVFGGITSCDAVANGIVTALNMLGDEANKPLVVRLDGNNVDQGRRILAEANHPLVIQAETMDSGADKAAELANK

SEQ ID NO: 67450 - protein, 507 aa, Arabidopsis thaliana
MSLPLYFLLTLFFFFFATAKTRRSSSTGTLPPGPPILPLVGNIFQLGFNPHRSLAAFSKTYGPIMSLKLGRLTAVVISSPEAAKEALRTHDHVMSARTFNDALRAFDHHKHSIVWIPPSARWRFLKKTITKYLLSPQNLDAIQSLRMRKVEELVSLVNEFRERGEAIDLARASFVTSFNIISNALFSVDLATYDSNSSSYEFHNTVVHLTDIAGIPNVGDYFQYMRFLDLQGTRKKAVLCIEKLFRVFQEFIDARLAKRFSRTEKEPKEASSIDMLDSLLDLTQQNEAELTMNDLKHLLLDVFVAGTDTNSSTMEWAMTELFRSTEKMVKAQSEIRQVIGQNGFVQESDIPSLPYLQAIVKETLRLHPAAPLIPRKSESDVQIMGFLVPKNTQVVVNVWAIGRDASVWENPMKFEPERFLLRETDVKGRDFELIPFGSGRRMCPGISMALKTMHMVLASLLYSFDWKLQNGVVPGNIDMSETFGLTLHKAKSLCAVPVKKPTISSSY

SEQ ID NO: 67451 - protein, 132 aa, Helicobacter pylori
SNIKYELDKESGALMVDRVLYGAQNYPANYGFVPNTLGSDGDPVDALVLSDVAFQAGSMVKARLVGVLNMEDESGMDEKLLALPIDKIDPTHSYVKDIDDLSKHTLDKIKHFFETYKDLEPNKWVKVKGFEN

SEQ ID NO: 67452 - protein, 226 aa, Triticum aestivum
  misc_feature (29)..(29): Xaa can be any naturally occurring amino acid
TRPGDIFQCLEDQNAEDDALITNMLEALXNLAPVLDLRIFSSSKPSYIKMTEKSAVHAIMGMLSSSIKAWHCAAAELIGRLIINPDNESFLVPVISQIYRRLVDLLSVPAFDAQAAAVSALYNVSEVNMDCRLKLASERWAVDRLLKIVKAPHPVSEVCRKAAVILESLVSEPQNRMHLLVHENNFAEILTSEGKYSDTFARILYELTARPSNKVTSGQAIWGNIN

SEQ ID NO: 67453 - protein, 475 aa, Arabidopsis thaliana
  misc_feature (441)..(441): Xaa can be any naturally occurring amino acid
MASQSSVAVISSAAARGESFPDSKKPIGSVRFQQPLRLSFSYCKSGNMSSRICAMAKPNDAETLSSSVDMSLSPRVQSLKPSKTMVITDLAATLVQSGVPVIRLAAGEPDFDTPKVVAEAGINAIREGFTRYTLNAGITELREAICRKLKEENGLSYAPDQILVSNGAKQSLLQAVLAVCSPGDEVIIPAPYWVSYTEQARLADATPVVIPTKISNNFLLDPKDLESKLTEKSRLLILCSPSNPTGSVYPKSLLEEIARIIAKHPRLLVLSDEIYEHIIYAPATHTSFASLPDMYERTLTVNGFSKAFAMTGWRLGYLAGPKHIVAACSKLQGQVSSGASSIAQKAGVAALGLGKAGGETVAEMVKAYRERRDFLVKSLGDIKGVKISEPQGAFYLFIDFSAYYGSEAEGFGLINDSSSLALYFLDKFQVAMVPGDAFGDXSCIRISYATSLDVLQAAVEKIRKALEPLRATVSV

SEQ ID NO: 67454 - protein, 148 aa, Zea mays
MEQTFIMIKPDGVQRGLVGEIICKFEKKGFTLKGLKLITVDRPFAEKHYQDLSAKPFFNSLVDYIISGPVVAMIWEGKNVVLTGRKIIGATNPAASEPGTIRGDFAIDIGRNVIHGSDSVESANKEAALWFPDGPVNWQSSLHSWIYE

SEQ ID NO: 67455 - protein, 163 aa, Oceanobacter sp. RED65
MFRIGHGFDVHKFSEETGDVSIKIGGVAIPYERTLLAHSDGDVALHALCDALLGAVALGDIGHHFPDNDPAFANADSRNLLKHVWHEVKAKHYKICNIDITIMAQAPKMAPHIQAMRETIAIDLEIQIDQVNVKATTTEKLGFVGRKEGIAVEAVALLMREPN

SEQ ID NO: 67456 - protein, 338 aa, Synechococcus elongatus PCC 6301
MMSNTMRAVVLEMPGGPEQLQLQSLPWPAIAHPSEVLVQLQAAGLNPIDTKLRQRGSFDPDRRPAILGCDGAGWVAAVGSAVDRFAVGDAVYFCHGGLGLEPGTYADYAVVDQAWLAPKPERLSFVEAAGVPLALITAWEAPYDRGRLQAAQTVLIHAGAGGVGHLAIQLAKLRGARVATTVSTPEKAAIAGHYGADFVIPYRDRDWVAAVLDWTDGKGVDLAFDTVGGAVLEQTFPAVRLYGDLVTILAPDAATNWKVARDRNLRISLELMLTPQLQRVTEARQHQTQILTTASRWFDQEQLHIHIGQVLPISEISQAHQFLERQQGAGKIVIDLTA

SEQ ID NO: 67457 - protein, 434 aa, Candida albicans SC5314
MLSATKRYLATAATAAATATATNTTTTSKAFTNTTSQLGRATLTIKDGPVFNGYSFGANRNVSGEAVFTTSLVGYPESMTDPSYRGQILCFTQPLIGNYGVPSSTAKDQFNLLKYMESPKVQCIGIVVADAALEYSHWTAVESLQQWCKRSGVAAITGVDTRQLVSYLRDKGSSLGRITIGEEYDADEDAAFEDPGAINLVHKVTTKAPFHIACPPQYSKGIHIAVLDCGAKENILRCLVERGASLTVFPYDYPIDKIANKFDGIFISNGPGDPTHCSTTVNNLKKIITNHQDLPIFGICLGHQLLALASGAKTIKLKYGNRAHNIPAIDLITGNCHITSQNHGYAVDANTLSENWQPYFTNLNDLSNEGMIHKYQPIFSTQFHPEAKGGPLDTSFLFDKFFDNINVYKKSNGLNLPPVENSLLVDILPKERVE

SEQ ID NO: 67458 - protein, 236 aa, Anaplasma phagocytophilum HZ
MLAKKEDFHTFGNGVGSAGTGGVVVSASMLSADFSNLREEIAAVSTAGADWLHIDVMDGCFVPSLTMGPVVISGIRKCTNMFLDVHLMINRPGDHLKSVVDAGADMITVHAESEVHLCRLIKQIKLYGKKVGVSIVPKTHHSVLEYIIHDLDVVLVMSVDPGFGGQAFLEPQLKKIEHIRKMIEESSSTAKIAVDGGVSTDNARAVIEAGANILVVGTALFAADDMSKVVRTLKSF

SEQ ID NO: 67459 - protein, 578 aa, Escherichia coli CFT073 [sequence omitted]

SEQ ID NO: 67460 - protein, 478 aa, Vibrio sp. Ex25
MMQQIKNETLKSVFKQWSSEEGIVVINPATEQELVRLKPSSLEELDTLIGQCKTEQVRWAKLSAKERSRRLKKWYQLLLDNAEDIATIITLEQGKPLTESKGEVMYGASFVEWFSEEAKRAYGEVIPAPTTDRRLSAIRQPVGVCAAITPWNFPIAMITRKAAPALAAGCGMLIKPSELTPLTAIAVVELAYQAGIPKELLPVVVSEQAAEFGQVLSTDPRIKKVSFTGSTRVGKILMKQASDSVKAVSMELGGNAPFIVFDDADLDAAAEGLVASKFRNAGQTCVCTNRLYVHEDVKQAFIEKVLSKLNKLQLGNGLEKGVTLGPVITMASKHRLEAVIDQAVQEGASIANSPQRRSGRFMEPVLLDSVKQYMSIVQQELFGPVLPIITFENDEQVLGMANDTEYGLACYFYTNNFKRIVAFSEGLEYGMVGVNEGIISTEVAPFGGVKESGVGREGAKQGLDEYLETKYICLGGLS

SEQ ID NO: 67461 - protein, 359 aa, Triticum aestivum
  misc_feature (222)..(222): Xaa can be any naturally occurring amino acid
MSAYCGKYKDELIKNAAYIGTPGKGILAADESTGTIGKRFASINVENVEDNRRALRELLFCTPGALQYLSGVILFEETLWGSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEVVLAACYKALNDQHVLLGGXTSLKPNMVTPGSDSKKVAPEVIAEYTVRTLQRTVPAAVPAIVFLSGGQSEEEATLNLNAMNKLQTKKPWNLSFSFGRALQQSTLKAWSGKTENEEKARAAFLVRCKANSEATLGTYKGDATLAEGASESLHVKDYKY

SEQ ID NO: 67462 - protein, 727 aa, Zea mays
  misc_feature (150)..(150): Xaa can be any naturally occurring amino acid
MAILSALATEVFIPVAAVIGIAFAVVQWVLVSRVKLSPAAAASGGSKNGYGDYLIEEEEGLNDHNVVVKCAEIQTAISEGATSFLFTEYQYVGICMSIFAVVIFLFLGSVEGFSTKSQPCTYSKDKYCKPALFTALFSTVSFLLGAITSXVSGFLGMKIATYANARTTLEARKGVGKAFITAFRSGAVMGFLLASSGLVVLYITINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEVKAVKEIEPALKKQLIISTALMTVGIAVISWLALPAKFTIFNFGTQKDVSNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSKAGVKVVDVLSPKVFIGLIVGAMLPYWFSAMTMKSVGSAALKMVEEVRRQFNTIPGLMEGTAKPDYATYWKISTDASIKEMIPPGALVMLTPLIVGTLFGFETLYGVLAGALAALRLRTPRVFRLATVMSPLLLRRVVASLLLHGSLKCCCSGATGGALWQPAARGAWRM

SEQ ID NO: 67463 - protein, 321 aa, Candida albicans SC5314
MEVLHQLTTNHTSSLSNLINNHPTSFSSILKEVDITNHSLTYIEKLWASYYIYMNNDILATGLLFFITHELMYFGRCLPWFIIDKTPWFNRYKIQPTKIPTNQEQWECFKTVLKQHFLVEALPIWLFHPVCAKLGITYDVPFPNWKIQAIQIAIFFICEDFWHFVFHSLFHQGWFYKNIHKVHHKYAAPFGLAAEYAHPVEVMALGVGTVGFPILYAYLATVYTNMPPLHLFTLTTWIVLRLFQAVDSHSGYDFPWSLNKFFPLWAGAAHHDEHHHYFIGNYASSFTLWDWLFQTECGTYARKRRERNSQASAESKHKKTL

SEQ ID NO: 67464 - protein, 489 aa, Haloarcula marismortui ATCC 43049
MSQPDSQTAWDRLYIDGEWRDAGTSETIPVTNPATGDEIAAVPAGTEGDVNDAYQAAEAAQSDWAALSREERNEYVQAMIGVMQERLDEIVELLATESGSVQAKATAEANFAMADFQSALEMVPPEEEVRDSMYHEDKDHHIVREPAGVVGIISPWNFPLHLTTRALGPALALGNTVVIKPATDTPITGGLLLADIAEEAGLPDGVVNVVTGHGSDIGDRMAGHPTARVMSFTGSTAVGRSVASQAGDALALPALELGGNGPFVVTEDADIEAAAKAGSVGAFGHQGQVCISINRHLVHEDVYDEYVEKLVEHAESLTIGNPLDEDVEFGPIINESQVEQLTSFIEQTVDAGATLETGGEVEDLFLEPTVLSECTNDMSAACNEHFGPVAPVIPFESDEEAVELANDTEYGLAAGVYSSDVEHGRSIADQIDAGMVHVNDHPIQDEPNAPFGGMKNSGLGRYNGEWIMDELTETKWISVQHEERDYQLL

SEQ ID NO: 67465 - protein, 322 aa, Anaplasma phagocytophilum HZ
MVIIPGSTSLALAKSVSGMLDVPMVIPCVSRFADGEINLEVPTGVATGSGHIVLMQSLSAPASDNLIELTLLTDAVRRTLAPQRITAVIPYLCYSRQDRVMQRVDSQETFTSALSAKVIARILSTSGLDHIVTLDLHSQQAAGFFDVPFTNISAYDVFVDYLSSSNLLERLVIVSPDYGALGRVRAFVRMLSSRYNMNSIQVAVIDKYREGPGISEVMHVVGNVQDRHCFILDDIVDSGGTLCNAAAALKTRGAISVHSFITHGVLSGRAIDAIGTAELDSLVITDTIHNPDRVNLPEKIKVLSVDRLLSDYLLSHAVWRKS

SEQ ID NO: 67466 - protein, 353 aa, Haloarcula marismortui ATCC 43049
MRAAVIEEHGEPLTIQDVPYPEPQPDQVVIETEACGVCRSDWHAWQGDWEWFGIQTGPGQILGHEPAGVVADVGADVEQFSEGDRVTVPFHLGDGSCQYCQRGHANICETSMPLGFLEAAPGAFAEAFPVREADFNCVTLPDAVDFTEMAGLGCRFMTAYHALTDRATLRPGDAVAIHGCGGVGLSAVHIADALGAEPIAVDVQDRKLDRARDLGAAATINAAEADNVPGEVHAVTDGGADVAIDALGIAETCRNAVGSLGKQGTHVQVGLTTDDEAGEIPLPVDTMTLQEIDFHGSYGMPPVRYDELFRLIDAGTLDPSQIVGETLALEDVPATLSSMGEYETVGIPVIDEF

SEQ ID NO: 67467 - protein, 360 aa, Oryza sativa Indica Group
MEDQSLKPIRCKAAVCRAASEPLIVEEIVVDPPKAYEIRIKIICTSLCHTDVTLWHKVDPAFPRILGHEAYGVVESVGENVEGFAAGDTVVPTFMGQCDSCASCAAEWTNQCTAVPFTMGPGMRRDGTTRFWDGEGKPLSDTVAVTSFSQYTVVDVNQVVKVDTAVPPKIACLLGCCGGTGEPEIRRYIEPAWGRSSMEVGQSATRFVGGCLRAGIRRIGGKEFGVTDFVNPSQLGDKSVSEVINAMTDGGADYSFECIGISSVMSEAGRGKTIILGVEKDSQPLCLPSFEFLFGKCVMGSLFGGAKPKTDIPILAEKCMNKELELEKLVTHEVGLTEINTAFNLLLQGKSLRCIIWMDK

SEQ ID NO: 67468 - protein, 230 aa, Zea mays
SVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLPGGINELDERTQVAYGSKNEIIRFEETLYGSSRLAASATATARALI

SEQ ID NO: 67469 - protein, 132 aa, Helicobacter pylori
SNIKYELDKESGALMVDRVLYGAQNYPANYGFVPNTLGSDGDPVDVLVLSDVAFQAGSVVKVRLVGVLNMEDESGMDEKLLALPIDKIDPTHSYVKDIDDLSKHTLDKIKHFFETYKDLEPNKWVKVKGFEN

SEQ ID NO: 67470 - protein, 239 aa, Blastopirellula marina DSM 3645
MVWEAHQAAAQLVRPGATTAEIDAAIENVFIQHDAIPLFKGVPGVTPFPAATCVSINEEVVHGMPGSRQLVEGDIVSLDTGCKVNGWCGDAAVTHAVGTVSPIAAKLLEITQGSLQIAIDQMSRKSRWSEVAREMQEYVEAADFSVVTEFVGHGIGREMHESPQVPNYFSKRFLKEGDFPLRTGLVLAVEPMVNVGKREAKVTKDHWTVVTCDGSLSAHFEHTLALTSDGVEILTGPPS

SEQ ID NO: 67471 - protein, 555 aa, Dunaliella salina
MARLVLLGALLGALCATAVQGSLDGSQVEAGLGRQLTQDKPHEYNYNRHGIDWRDEGLDNCAGSMQSPINIDMATLNRGEERSDVSGLYLNGLASPAYDVAADVTVNAEQDMKITFKDVAQNNMPAIKIDGSDMLFKPVQLHFHHFLSEHAINGAHYPLEAHLVMGDASGNTNQLAVLGIMYQYGEQPDDFVRRLQTKTIDEIATNGAGYGETVNVTDLSVNIMKDVLPPTHHNYVGYDGSLTTPPCDERVKWHVFTEPRTITTGQLEKFLMITKRGHTDAIVTNNRIVQPIGRPLYHYKPTPASYNYARKGIDWREAGLDNCAGDRQSPINIDTTDLQPGAVSGISLNGLESQSFTFTDAYVNLEQDMKVSFTAPTNNLPTVNIDGNDESFRPIQLHFHHFSSEHTVDGMIYPLEAHLVMASQAENSNQLAVIAIFYQYGSEADDFLTRLHTEAISAQQGNANWGDNNVPINLPITFATDLMPSSTEHWAYEGSLTTPPCDERVRWIVMKEPRTTTAEQMETFKTATVNAHYAAEIVNNRAIQERNSRPISSIP

SEQ ID NO: 67472 - protein, 654 aa, Xanthomonas oryzae pv. oryzae KACC10331
MRLICSFLFVLSDCPSMISLRNFSMRRGERLLLSNVDLTMHAGYRVGVVGRNGTGKSSLFAAVKGELEADKGDVDLPGKVRTASVSQETPSLPDPALSFVLGGDIEVSAVLQEEADATVREDWEAVANAHQKMAELGAYDAEARAGKLLHGLGFPADTHHRAVSSFSGGWRVRLNLARALMMPSDLLLLDEPTNHLDMDAVLWLEQWLLKYPGTLLLISHDREFLDNVATHTLHLHGGTAKLYVGGYTDFERQRIEHLRQQQIAHDKEQAERAHLQSFIDRFKAQASKATQAQSRMKRLAKMAGTEAVRAEREFRIQFAQPNRLPFSLIRLNHAACGYTAAPRDSGVGIGDWQKQGTADAITVLHDVGFGLEAGDRIGLLGPNGAGKSTLVKTLVGELVPLAGERSAHPDLRIGYFAQHTVESLHEGQSPMDHFRDLSPDGSNQAFRDFLGKWNFAGDRAFEVVDGFSGGERARLALALIAWQQPNVLLLDEPTNHLDLEMREALAEALSDFEGAIVMVSHDRHLIGLVCDSFWRVADGVVEPFAGDLDEYAAWLRSRPAAQGTKQKMAEVAPTPPPPTKPLPPKKAVNPHKLASAEKRVGELEAALAALDRELANPGNYADSEKMAVLGRDREATAQQLAEAETAWMELIDGA

SEQ ID NO: 67473 - protein, 126 aa, Hopea ferruginea
VLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVSNPDELMSNFFAQPDALAFGK

SEQ ID NO: 67474 - protein, 126 aa, Hopea pierrei
  misc_feature (120)..(120): Xaa can be any naturally occurring amino acid
VLLGLLSIWNVSFLGYPARAILPYSQALEKFAPHIQQVSMESNGKGVSIDGVPLPFEAGEIDFGEPGTNGQHSFYQLIHQGRVIPCDFIGSAKSQQPIHLKGEVVSNHDELMSNFFAQPXALAFGK

SEQ ID NO: 67475 - protein, 132 aa, Helicobacter pylori
SNIKYELDKDSGALMVDRVLYGAQNYPANYGFVPNTLGADGDPVDVLVLSDVAFQAGSVVKARLIGVLNMEDESGMDEKLIALPVDKVDPTHSYVKDINDLSKHTLDKIKHFFETYKDLEPNKWVKVKGFEN

SEQ ID NO: 67476 - protein, 536 aa, Prochlorococcus marinus str. MIT 9303
MHQLMSFPDFSASDAHVQWQRFNNLLWYHNDLGIWLDISRMHINAEDFERLGPRFDQAFKAMQALEQGSIANADEQRMVGHYWLRQPQLAPDQEVRDHIAKEIDLIETFGSNVVNGLIKAPNGKQFTDVLWIGIGGSGLGPLLMIRALQNAEQGLRFHFFDNVDPDGMSRVLGNLGDALSTTLVVTVSKSGATPEPHLGMEQARQRLEEMGGRWSGQAVAVTMLNSQLDQLAQKESWLKRFDMFDWVGGRTSITSAVGLLPAALIGCNTRDFLAGAAQMDEATRVPDLHSNPAALMAAAWFVAGDGLGRRDMVVLPYRDRLEVFSRYLQQLVMESLGKRLDRDGNVVHQGLAVYGNKGSTDQHAYVQQLRDGVDNFFATFIEVLEDIENIPAINNEHPGDFLDGFLQGTRAALSQGGRQSLSISMRRFDPRRLGALVALFERAVGLYGELVNINAYHQPGVESGKKAAAAILNLQSRVEALLADGVDRSAGEIHQVIGEGSEEAIFWIMRHLTANKRGYVAEGDWGIPTSLRFSKG

SEQ ID NO: 67477 - protein, 167 aa, Xylella fastidiosa Ann-1
MKGLNVRIGQGYDVHAFGPSDHVMLGGVRVPHRCGVLAHSDGDVILHALCDAMLGALGLGDIGQHFPPSDVRWKGADSGVFVRHCNLLLRERDWCVGNVDATAICESPKIAPYVNAMREGIARLLEVQPECVSVKATTSEGLGFIGRGEGLAAQVVVLLYRLNGVVV

SEQ ID NO: 67478 - protein, 126 aa, Hopea bilitonensis
  misc_feature (108)..(108): Xaa can be any naturally occurring amino acid
VLLGLLSIWNVSFLGYPARAILPYSQALEKLAPHIQQVSMESNGKGVSIDGVPLPFEAGEIDFGEPGTNGQHSFYQLIHQGRVIPCDFIGSAKSQQPIHLKGEMVSNXDELMSNFFAQPDALAFGK

SEQ ID NO: 67479 - protein, 132 aa, Helicobacter pylori
SNIKYELDKESGTLMVDRVLYGAQNYPANYGFVPNTLGSDGDPVDALVLSDVAFQAGSVVKVRLVGVLNMEDESGMDEKLLALPIDKIDPTHSYVKDIDDLSKHTLDKIKHFFETYKDLEPNKWVKVKGFEN

SEQ ID NO: 67480 - protein, 430 aa, Xylella fastidiosa Ann-1
MTAIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRDNGKYNLVGENKRLTSGQFVDFLDDLVAQYPIISIEDGLAEDDWLGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 67481 - protein, 131 aa, Rhizobium leguminosarum bv. trifolii
MSLLEKFERYPLTFGATPIEHLPRLTAALGGKVEIYAKRDDCNSGLAMGGNKLRKLEYIVPDAIASGADTLVSIGGVQSNHTRMVAATAAKIGMKCVVIQEKWVPHYDAVYDRVGNILMTRLMGADSRLVD

SEQ ID NO: 67482 - protein, 257 aa, Oceanobacter sp. RED65
MINEMPTLGMGTFRLEGDIAKDSVKQALEAGYRHIDTAQIYGNESEVGLAIEESGIDRNEIFLTTKVWLDNLSAEAFIPSVEESLAKLKVASVDLLLIHWPEKEGKVSMKEYLGELAKCQEKGLTKHIGVSNFTNEQLDEALNILGDGKIYTNQVEVHPYLQNQAVIKHCERRSVKVTGYMPLAVGKVMEDKVLLDIANRHNSNPAQVAIAWQLQQGLTTIPSSTKRRNLDGNLAASQLTLDANERIANPDFAPAWD

SEQ ID NO: 67483 - protein, 99 aa, Thermoanaerobacter tengcongensis MB4
MLTEEWLCNIIISVQFLRGGEKGMIFEKVRNIIAEQLGIDPEEITMESSFIDDLGADSLDIVELIMALEEEFDIEIPDEDAEKIKTVGDVVEYLSNIVE

SEQ ID NO: 67484 - protein, 455 aa, Lysinibacillus sphaericus
MKQVLTELQEKDLQHVWHPCSQMKDYEAFPPIVIKKGEGVWLYDEQNQRYLDAVSSWWVNLFGHANPRISQALSEQAFTLEHTIFANFSHEPAIKLAQKLVALTPQSLQKVFFADNGSSAIEVALKMSFQYHMQTGKTQKKRFLALTDAYHGETLGALSVGGVDLYNEVYQPLLLDTVRAQGPDCFRCPFKHHPDSCHAQCISFVEDQLRMHHKEITAVIIEPLIQAAAGMKMYPAIYLRRLRELCTQYDVHLIADEIAVGFGRTGTLFACEQANISPDFMCLSKGLTGGYLPLSVVMTTNDVYQAFYDDYATMKAFLHSHSYTGNTLACRVALEVLAIFEEEQYIDVVQDKGERMRKLALEAFSDLPFVGEYRQVGFVGAIELVANRDTKEPLPSEERIGYQIYKRALAKGLLIRPLGNVLYFMPPYIITDDEMQFMIQTTKDTIVQFFEEREG

SEQ ID NO: 67485 - protein, 509 aa, Anaplasma phagocytophilum HZ
MGPVVLQELENKKIQLKLGGGPSRIEKQHSRGRLTARERLGVFLDKGSFQEYGVFVEHRSVNFGMSESKVAGDGVVTGCGTVYGQRVCVYSQDFTVFGGSLSEMNAKKICHVMDMAAKAGVPVIGINDSGGARIQEGVDSLAGYGEIFQRNVDMSGVVPQISLIMGSCAGGAVYSPALTDFVFMVRGSCMFVTGPDVIKKVTFEDVTQEELGGAAVHTRKTGVADLAFDDEVDALSQVRKFLSFLPPNNRSSARAMPTSDPVDRENESLNTLIPRNSTVPYDMYELIAKVCDEGVFFEIKPDFAKNIIVGFGRIGGSAVGIVANQPMHLAGCLDIDSSRKAARFVRFCDAFNIPLVTLIDVPGFLPGVSQEYSGIIDHGAKLLYAYAEASVPKVSVIVRKAYGGAYIVMNSRHLRGDVNYAWPSAEIAVMGSEGAVGIIFRKEKDQEYLKQLIKEYNDKVVNPYVAASRGFIDDVIMPSTTRWHIYNALHMLRDKKVDRPWRKHDNLPL

SEQ ID NO: 67486 - protein, 168 aa, Blastopirellula marina DSM 3645
MAKDNRRGGDKGGRQSAFVEKVVKIKRCAAVVKGGRRFSFAAMVVCGDGKGKVGCGYGKANEVPPSVEKAVKQAERSLAAVNIVNGSIPHKVIGRYGAGKVVMVPARPGTGIIAGASVRAVCEAVGIHDVLTKSFGSTNPVILVKATIEGLKQLRTRDDIQRLRGVAL

SEQ ID NO: 67487 - protein, 429 aa, Vitis vinifera
  misc_feature (19)..(19): Xaa can be any naturally occurring amino acid
MVASRLQPPFLNPLFSSNXYSSHPLPSPSRPTFLALSANPQETSEPAKDRQKVVRIAWEKLVRWSRSWRSKAKTDVLERTNKVVVLGGGSFGTAMAAHIAARKAQLEVNMLVRNSQVCQSINENHCNCKYFPEHKLPENVIATTDARAALLGADYCLHAVPVQFSSSFLEGIADSVDPTLPFISLSKGLELNTFRMMSQIIPQALGNPRQPFIALSGPSFALELMNKLPTAMVVASKDKKLANATQQLLASSHLRISTSSDVTGVEIAGALKNVLAIAAGIVEGMNLGNNSMAALVAQGCSEIRWLATKMGAKSTTIMGLSGTGDIMLTCFVNLSRNKTVGIRLGSGEKLDDILGSMNQVAEGVSTAGAVIALAQKYNVKMPVLTAVARIIDNELTPKKAVLELMNLPQLLFPESLKGKNFPPWITQSF

SEQ ID NO: 67488 - protein, 396 aa, Vibrio sp. Ex25
MSTAFEVDSNIANIFSSQVPIVEGTYDLTPDQVLIDQAEHESEVRSYPRRLPIAIKQAFGCLVEDTRGQIFLDCLAGAGTLALGYNHPEINQALKEQLDSGLPYQTLDIATSAKTTFIQSVKSFLPQELSENSVIQFCGPSGADAVEAAIKLAKQTTGRNTMFAFRGAYHGMTNGTMGMMGNLGTKARRTGLMSDVHFMPFPYNLRCPFGLGGDEGAKASIRYIDRLLNDDESGIMKPAAIIVEPVQGEGGVVPAPAFWLRELRRICDEHGILLIFDEIQCGVGKTGYNFAFEESGIVPDILCLSKAIGGGLPMSLLVINKQHDTWKPGEHTGTFRGNQLAMVSGAKALEIIQRDNLVEHANIAGQYLRYGLESIQKRVNCIAEVRGKGLMLGCGD

SEQ ID NO: 67489 - protein, 126 aa, Neobalanocarpus heimii
  misc_feature (52)..(52): Xaa can be any naturally occurring amino acid
VLLGLLSIWNVSFLGYPARAILPYSQALEKFAPHIQQVSMESNGKGVSIDGXPLPFEAGEIDFGEPGTNGQHSFYQLIHQGRVIPCDFIGSAKSQQPIHLKGEVVSNHDELMSNFFAQPDALAFGK

SEQ ID NO: 67490 - protein, 499 aa, Yarrowia lipolytica CLIB122
MLRTTRILPSKFGVAARTRAVTQFQRCYSSANEELDVLVIGGGPGGYVAAIKAAQAGLKTGCIEKRGSLGGTCLNVGCIPSKSLLNNSQMYHAIKTDSANRGIEVSDVKMNIAKLQEAKETSVKGLTGGIEMLFKKNKVNYYKGAGSFVSDSEVKVDPIDGGEAVTLKAKNIIIATGSEPTPFPGITIDEKKIVSSTGALALEAVPKKMVIIGGGIIGLEMGSVWSRLGSEVTVVEFQNAIGAGMDDEIAKAAQKMLTKQGIKFKLGTKVLSGAIEGDGVKVEVENVKKGDKETLDADVLLVAIGRRPYSEGLNLEAAGVEKDDKGRIIIDQEYRTNKSNIRCIGDVTFGPMLAHKAEEEGVATAEYIATGHGHVNYAAIPSVMYTHPEVAWVGQTEQQVKEAGIKYNVGKFPFAANSRAKTNLDTEGTVKFIADKETDRILGIHIIGPNAGEMIAEGVLALEYGASCEDIARTCHAHPTLSEAFKEAAMATYDKAIHF

SEQ ID NO: 67491 - protein, 328 aa, Lactobacillus sakei subsp. sakei 23K
MDLFESLKAKITRHDFKIVFPEGTEPRIIGAAARLNADRILKPILIGDAADIQSIASAKGFNLTGITIIDPKAYPQADFDTMVAAFVERRKGKATAEQAQTILQDPNYFGTMMVYLDLADGMVSGAVHSTGDTVRPALQIIKTKPGIQRTSGAFIMQRGRDNERYLFSDCAININPNAQELAEIAVASARTAELFDIDPKVALLSFSTMGSARGEEVTKVQEATKIAQELAPDLDIDGELQFDAAYVPVVANQKAPDSKVAGQANVFVFPELQSGNIGYKIAQRFGNFEAIGPILQGLNKPISDLSRGSNEEDVYKLAIITAAQALQN

SEQ ID NO: 67492 - protein, 126 aa, Upuna borneensis
  misc_feature (108)..(108): Xaa can be any naturally occurring amino acid
VLLGLLSLWNVSFLGYPARAILPYSQALEKFAPHIQQVSMESNGKGVSIDGVPLPFEAGEIDFGEPGTNGQHSFYQLIHQGRVIPCDFIGSAKSQQPVHLKGEVVSNXDELMSNFFAQPDALAFGK

SEQ ID NO: 67493 - protein, 630 aa, Prochlorococcus marinus str. MIT 9303
MVLKQSDGLKTAVARSADNRYSAASNLRNVRGWRAMGTFHCLHRTPADRTGVDNELSTFIPKALRTSPIPAESVEIRFDDISDALAAIRNGECVVVVDDERRENEGDLICAAQFATPEQINFMATEARGLICLAMKGSRLDQLDLPLMVDRNTDANQTAFTVSIDAGPEKGVSTGISAEDRARTIQVALHPETRPRDLRRPGHIFPLRASQGGVLKRAGHTESAVDLSQLAGLAPAGVICEIQNSDGSMARLPQLQNYARRWGLKLINIADLIRYRLENERFVYRQATAELPSLFGSFQAIGYLNGLDGSEHIALVKGDPRELKEPVLVRMHSECLTGDAFGSLRCDCRPQLEAALARIEQEGEGVVVYLRQEGRGIGLINKLKAYSLQDGGLDTVEANESLGFPADLRNYGVGAQILTDLGIHRLRLLTNNPRKIAGLGGYGLQVESRVPLVICPGDHNAAYLAVKREKLGHLMDTGKSENQAPEVGPFVVVAWDGEVNGETLAKLRTRANDWATSNELELIAESSPRLLALWDRPLFVWRVCPRVKTSSEVSSDPLKKASLELLLQELIQWSGSRRIGLLRTDRAEQAMHPPQDLKREERSLASLFKDDFSPLKDWDAWSLPNLILWS

SEQ ID NO: 67494 - protein, 132 aa, Helicobacter pylori
SNIKYELDKESGALMVDRVLYGAQNYPANYGFVPNTLGSDGDPVDALVLSDVAFQAGSVVKVRLVGVLNMEDESGMDEKLLALPIDKIDPTHSYVKDINDLSKHTLDKIKHFFETYKDLEPNKWVKVKGFEN

SEQ ID NO: 67495 - protein, 250 aa, Mycoplasma gallisepticum
MIYIKNPNEIQKIKNAAQIYKKIVKQFNFDYIKNKSLKEIDQMLRDFVSQHHANSCYHGYLGFKGYHCLSLNKTIIHGLANDDIFTSKDKLTIDIGIELDNYYCDSAFTILGPDVNLRQKLLSEVTHNCIFDLVKKIVPNQTTTNDLGIWTEEYAKKHGYNVIKDFGGHGCGIKIHEDPIILNYGTKKPGELLTPNMVICIEPMFFEKDNRYYIDPVDSWSVKPVNKNQYVCHWEHMVLIKEDQAEILTL

SEQ ID NO: 67496 - protein, 154 aa, Xanthomonas axonopodis pv. citri str. 306
MSQFDLTPPSPAQRDALIAGLSDEEQRVLLHHGTEAPFCGVFLDNKLDGVYTCRLCGLPLFRSSAKFESGTGWPSFFAPYDPAHVREIRDTSYGMIRTEIVCARCDSHLGHVFPDGPPPTGERHCLNSVSLGFTENGQALPNPLHRRGAEAQAA

SEQ ID NO: 67497 - protein, 345 aa, Ralstonia solanacearum GMI1000
MKALVYEGPGKISLENKPKPELQAPGDAVVRVTLTTICGTDLHIIKGDVPTCEPGRTLGHEGVGVIESVGAAVTSLKPGDHVLISCISSCGKCANCRRGMYSHCETGGWILGHRIDGVQAEYVRVPHAETSLYKVPPGVDEEALVMLSDIFPTGFECGVLNGRVQPGSTVAIVGAGPIGLASLLTAQFYSPARIIMIDTNVARLEVASGLGASDCINVTRENAAAAVKRLTDGMGVDCAIEAVGVPATFELCQELVAPGGVIANIGVHGVKADLHLETLWSQNIAITTRLVDTVSTPMLLKTVRAGKLLPGQLITHRFKLDDILAAYDTFRNAGETHALKVIIAT

SEQ ID NO: 67498 - protein, 422 aa, Triticum aestivum
  misc_feature (221)..(221): Xaa can be any naturally occurring amino acid
  misc_feature (273)..(273): Xaa can be any naturally occurring amino acid
  misc_feature (294)..(294): Xaa can be any naturally occurring amino acid
  misc_feature (322)..(322): Xaa can be any naturally occurring amino acid
MEAAAAIRSAAAPRMRLAGRSSRGSGAAAARAIPVSRSDWQTACAILSSTNDSPTPPAPKVNGQNNINKLAAPAIPGSEDAVSGLDLVLAAGAGNLPRPLSISDLSPAPLHGAQLRVAYQGVPGAYSEAAAGKAYPGCEAIPCDQFEVAFQAVELWIADRAVLPVENSLGGSIHRNYDLLLRHRLHIVGEVQLPVHHCLLALPGVRRELLARVISHPQALXAQCEHTLTRMGLNVAREAFDDTTGAAEHIAGHALRDTAAIASGRAAELYGLXVLADGVQDDPGNVTRFLNAGXRSPLIPRTDRPVKTSLGPGPNREGTPVXFTVLSAFAFRDISLTKIESRPHRHRPIRLVDDANIGTAKHFEYMFYIDFQASMADVRAQNALAEIQEFTSFLRVLGSYPMDMTPWDAAPSSSSSDQQQRG

SEQ ID NO: 67499 - protein, 385 aa, Triticum aestivum
MSPLSKPRSATRALQHIILLALLLPCLPQPLPAPSPSPTPAQPSLPLSPFNERLDAAYIAFQAWKHVITEDPKNLTADWCGPFVCNYTGVFCAAAPDDPCILTVAGVDLNHGRIAGVLTDHLGLLADLAVLHLNSNRFHGTLPTSMQHMRLLFELDVSNNLLSGAFPSFLTSLPSLKYLDLRFNDFDGELPDAVFGRQLSLDALFANDNRFNVSLASGSLTNSTASVIVLANTKLAGCLPPSIGDMADTLVELILLNTSISSCIPPEIGKLKKLKVLDLSHNEFAGELPESIGDMESLEVINVGYNMLSGAVPETICLLPNLKNLTVVGNYFCEEPVSCLHVPRRDDRMNCIPDWPHQRSHEQCIAFEHRPPVHCGADGCILPPP

SEQ ID NO: 67500 - protein, 540 aa, Glycine max
MQVMASRILSTLHYVCSSSASATKRCLGLYSHWQRSISGIAASVVADVEPSIAPVQIDQSQLLIDGKFVDAASGKTFPTFDPRTGDVIANVAEGDAEDVNRAVHAARKAFDEGPWPKMTAYERSRIILRFADLLEKHNDEVAAIETWDSGKTYEQAANVEIPMVVRLFRYYAGWADKIHGLTVPADGPYHVQTLHEPIGVAGQIVPWNFPLLIFSWKVAPALACGNTVVMKTAEQTPLSALYVSKLFLEAGLPPGVLNVISGFGPTAGAALCSHMDVDKLAFTGSTSTGKRVLELSAHSNLKPVTLELGGKSPFIVCKDADVDAAVEASHFALFFNQGQCCCAGSRTFVHESIYGEFVEKAKARALKRVVGDPFKNGVEQGPQIDSVQFEKIMKYIRSGVESGAQLESGGQRIGSKGYYIQPTVFSNVQDNMLIAKDEIFGPVQSILKFKDLEEVIRRANATSYGLAAGVFTKNMDTANTLMRALQAGTVWINCYDVFDAAIPFGGYKMSGQGRVRGIYSLRSYLQVKAVVTALKNPAWL

SEQ ID NO: 67501 - protein, 331 aa, Thermoanaerobacter tengcongensis MB4
MSVMDNIIQKAKANKKKIVLPEGTEPRTLKAAEIVLKEGIADLVLLGKEEEIREKAKGLDISKAEIVDPEKSPNLERYAKEYYELRKNKGMTEEEAERLMRDPMYYGCMMVKLGDVDGMVSGAIHATADVFRPAFQIIKTAPNVKVVSSAFIMEVPECKYGSDGVFIFADCAINPNPTAEELAAIAIASAHTAKVLAGIEPKVAMLSFSTKGSASHELVDKVKRATEIAKELAPDLLIDGELQVDAAIVKEVGELKAPGSPVAGQANVLIFPDLQAGNIGYKLVQRLAKANAIGPISQGLAKPVNDLSRGCSVEDIVNVIAITSVQAQGIV

SEQ ID NO: 67502 - protein, 401 aa, Arabidopsis thaliana
MATKRSVGTLKEADLKGKSVFVRVDLNVPLDDNSNITDDTRIRAAVPTIKYLMGNGSRVVLCSHLGRPKGVTPKYSLKPLVPRLSELLGVEVVMANDSIGEEVQKLVAGLPEGGVLLLENVRFYAEEEKNDPEFAKKLAALADVYVNDAFGTAHRAHASTEGVAKYLKPSVAGFLMQKELDYLVGAVANPKKPFAAIVGGSKVSTKIGVIESLLNTVDILLLGGGMIFTFYKAQGLSVGSSLVEEDKLDLAKSLMEKAKAKGVSLLLPTDVVIADKFAPDANSKIVPATAIPDGWMGLDIGPDSIKTFSEALDTTKTIIWNGPMGVFEFDKFAAGTEAVAKQLAELSGKGVTTIIGGGDSVAAVEKVGLADKMSHISTGGGASLELIEGKPLPGVLALDEA

SEQ ID NO: 67503 - protein, 280 aa, Zea mays
  misc_feature (154)..(154): Xaa can be any naturally occurring amino acid
MAEDRSPKPIHCKAAVCRAAGEPLTIEEIVVDPPKAYEIRIRVICTSLCHTDITFWKAKVAPVFPRILGHEAYGVVESVGEHVEGFAAGDTVVPTFLGQCERCASCASEHSNVCDAVPFVIGPGMRRDGTTRFRDARGSPLHDLLAVSSFSEYXTVVDVNQVVKVDPAVPPKLACLLSCGAGTGVGAAWRSAKVEPGSTVAIFGLGSVGLAVVQGAKMCGASKIIGVDLNPDKEEVGKSIEKKDIVFHSVTEQSRAPHHALYRVPATSCLSSSQNRNQEK

SEQ ID NO: 67504 - protein, 1379 aa, Chlamydomonas reinhardtii
MDREAQRQLLEAVMETADQDNFRLMQKVADRLERVGMSFPGVEVRWRGLTVEADVPMGSSKVPTLASAALSILRGCVAPFMLSRSGDASLTHRRVLLNNVDGVLRPGRMCLMLGPPGSGKTTLMKTLAAQLHKTYSSLRFTGSVTYNGKTPGTDFVAERAATYVSQQDTHIAEMTVAETLSFASESLGPGLSKQLYDVMRARELEAGVEPDPDLERLWVATFTQSRKNVLVEMFAKLLGLDHVMDTVVGDELLKGISGGQKRRVTAGEMAVGLASVMFLDEISTGLDSASTLIITKALRNLAVYMNATMLVSLLQPSPEVYDCFDDIMVLSHGRIVFLGPREDVVPFFSRLGLQVPPTKTVPDFLQEVTGCHDQAKFWAPNPLRTRVHRSYESTKQFVGAFKASPVGQALQARLEGPPHTHPLQDMVLHHEPYAQSAWQMLASTLRREVLLLRRNKLFMLAGAGQIMFVAFIVSTSFPNLSKSTFADANLFLSVIFFSVMVMFMGGFNSVDSYVKKLPVFFKQRDHHFYTAAAFTLNGAALRIPEHLINATVWSIMVYFSVGFYQDAGRFFIFWLNLVVTGAFSTALFQCLGAVFRNGVLAQGMGAVALMLSIATSGFPIARTSIPGWWIWLYWLSPMAWTVRSMSINELTSSDWDESSAPWGGSEPLGMFTLYYRGFQREWKWVWVGIGIEILITLALTWGQMLALAHLPRDEECPDEMTEEEMERGKVRGHVVLDLRPVARSSRSTSADGAAAGAGAGDAVAVRVGGGELHFECMSLVFKHVNYFVPNPKKGSGERELQLLRDVSGCFRPGVLTALMGASGAGKTTLMDVLAGRKTGGRTDGEQLLNGHTKAMSTLSRVMGYVEQFDVHNPQATVIEALLFSARMRLPAGLLPDTAALLGYVSGVMDVVELRPLMNSMVGWAGSGGLSTEARKRLTIAVELVANPSIVFMDEPTSGLDARAAALVMRAVRNTVNTGRTVVCTIHQPSREIFEAFDELLLLKPGGRVIFNGPLGQDQANLIRHFEAQRGVPKYEPQMNPANWMLDVSAPAAERRMGVDFADLWASSDLAKSNEAFTHAAAQPVPGSQPLAFSSRYAVSMWTQFRLLMHRALVTYWRNPPYNVLRFLVTLGMGIMFGTLYWDRGNKRTTMLGVMDIMGALYSTTVFMGISNCLTILPVINADRAVFYRERAAGMFHVLPYVLSQGLAEMPYLAVQSILYSIIVYFLIQFEFTAVKFFWFLLYFWLNLMAFTFFGVAAMSILPAVPLATAGASFGLLLWNLYCGFLVYKKDIHPWWIGAYYVNPATYTIYGVVATQLGDLYDEYIQVGPGVVMSIPQFIDETFDYKYSFRGWLVLILFGFVLGFRMIACLGLSFLNFQKR

SEQ ID NO: 67505 - protein, 301 aa, Aspergillus oryzae
MVYITQESHKLEVQARPPIAVTNAVSWRSEGIRYRKNEVFLDVVESLNLLVSASGNVLRSEILGAIKMKCYLSGMPELRLGLNDKVMFETTGRATRGKAVEMEDVKFHQCVRLSRFENDRTISFIPPDGEFELMSYRLNTQVKPLIWVECLVESHSGSRMEYMLKAKAQFKRRSTANNVEILVPVPEDADSPRFRTNIGTVHYAPEKSAIIWKIKQFGGGKEFLMRAELGLPSVKGDDEHGGGMTGGFGGSMGGTGGGKAKRPINVKFEIPYFTTSGIQVRYLKITEPKIYFLPFLFSSVT

SEQ ID NO: 67506 - protein, 417 aa, Synechococcus elongatus PCC 6301
MQGILGLSRLAVSFFLKDDLGLSPAQVSALTGIAALPWMIKPAFGLLSDGFPLGGYRRRPYLIAAGLLGSTAWLGLGTVVHSPAMATLAIALSSLSVALSDVIVDSLVVERARQESRSESGSLQSLTWAVSALGGLVTAYLSGFLLQLFETRTLFLITATFPLIVCLVAGWIAEVPQTIQPGLALIREQVGQIGQALRQRQIWMPTLFLFLWQVTPSADSAFFFFSTNELHFEPEFLGRVRLVTNLASLLGVWIFQRFLRGVPIRRIFGWMIVVTTLLGLTSLILVTHLNRSWGISDQWFSLGDSLILTVAGQLSFMPVLILAARLCPSGIEATLFALLMSVLNLAHFGSVELGALLTHWLGVTESQFDRLWLLVLLTNLSSLLPLPLLGLLPAEEAETVPSDAIASAAPEPLVVTQ

SEQ ID NO: 67507 - protein, 372 aa, Physcomitrella patens subsp. patens
MGNSPESYNGYPRVYSPVWRDDDKDGHYMFELGENITPRYKIISKKGEGTFGRVLECWDREVQEYVAIKVIRNVQKYRDAAMIEIDVLRTLAKNDKLGTRRCVQLKTWFDYRNHVCIVCERLGPSLYDFLRKNNYRPFFADLVRDFGRQLLESVAYMHELTLIHTDLKPENILLVSSEYLRVPDYKASNTGKHFKRVPKTSEIKLIDFGSAIFDSHYHCSVVSTRHYRAPEVILGLGWTYPCDIWSVGCILVELCSGDALFQTHENLEHLAMMERVLGPIPVHMIKRADRRLEKYFRYGRELNWPEGTVSRESIRAVRRLPSLRNLIMRYVDHSGGLLIDLLQGLLKFEPSERLTAKEALKHPFFKESNRRL

SEQ ID NO: 67508 - protein, 382 aa, Synechococcus elongatus PCC 6301
MEDKLMLMIPGPTPVPEQVLLAMAKHPIGHRSADFSRLVADTTAGLKWLHQTTGNVLVLCSSGTGAMEAGIINFLSAGDRVLCCENGKFGERWVKLAQAFGLDVDLVQAPWGKPLDPEAIRAKLEADTDKQIKAVILTHSETSTGVINDLETISGYIRAHGALSIVDAVTSLGAANVPIDAWGLDVVASGSQKGYMIPPGLGFVAVSDRAWKAYETATLPKFYLDLGKYRKAAQKDSNPFTPPVNLYYALDAALKIMQREGLENIFARHAKLTRATRAAIKALNLPLYAADEVGSPAITAVAPVEVAAEDIRSFTKKHFDILLAGGQDDLKGKIFRIGHLGFVSGRDVLTAIAAIEAALTGLGYSNFTSGAGVAAAAAELAK

SEQ ID NO: 67509 - protein, 363 aa, Escherichia coli CFT073
MGFKCGIVGLPNVGKSTLFNALTKAGIEAANFPFCTIEPNTGVVPMPDPRLDQLAEIVKPQRTLPTTMEFVDIAGLVKGASKGEGLGNQFLTNIRETEAIGHVVRCFENDNIIHVSGKVNPADDIEVINTELALADLDTCERAIHRVQKKAKGGDKDAKAELAVLEKCLPQLENAGMLRALDLSAEEKAAVRYLSFLTLKPTMYIANVNEDGFENNPYLDQVREIAAKEGSVVVPVCAAVEADIAELDDEERDEFMQELGLEEPGLNRVIRAGYKLLNLQTYFTAGVKEVRAWTIPVGATAPQAAGKIHTDFEKGFIRAQTISFEDFITYKGEQGAKEAGKMRAEGKDYIVKDGDVMNFLFNV

SEQ ID NO: 67510 - protein, 486 aa, Anaplasma phagocytophilum HZ
MIADSQSLSEGYLERVISHLKSRGLVKPTRGPGGGYSLGMSPDRITLDMLLDSVGDKVKMVRCDADGNTGCISSYAGKCNSHDLWESMEKYMMHYFANTTILDVSNNTLKELGGGGDYIYADDNASSEVCQQVRHKLGNALLFGNFYNPSAVYGLGQKARSLVEDVRRVVIEALDARGYEVVFTSSGTEANNLVFNSVNGRHIISAIEHPSVMNAAVDPVLISVTGDGVVSLEALEEALKSGDSKGSLVSVMLANNEIGVIQPLKDVVNIAHKYGAVVHMDAVQACGKIPVSVLDIGADFVTISSHKVGGIVGAGAVLYNGKKVNVVPMLRGGMQEKGLRAGTENIPAIYSLAIALENLKDRLQKMSNVASMRDLLEKKIKEMVPECIIWGSGADRLPNTTCISMPGVSSETQLIGFDSNGIAVGVGAACSSGKIGRSKVLEALGASEEDAKNAIRISLGPEVSSDQVNKIIECWYKIYSNFHSLS

SEQ ID NO: 67511 - protein, 559 aa, Escherichia coli CFT073
MNKIFSSHVMPFRALIDACWKEKYTAARFTRDLIAGITVGIIAIPLAMALAIGSGVAPQYGLYTAAVAGIVIALTGGSRFSVSGPTAAFVVILYPVSQQFGLAGLLVATLLSGIFLILMGLARFGRLIEYIPVSVTLGFTSGIGITIGTMQIKDFLGLQMAHVPEHYLQKVGALFMALPTINVGDAAIGIVTLGILVFWPRLGIRLPGHLPALLAGCAVMGIVNLLGGHVATIGSQFHYVLADGSQGNGIPQLLPQLVLPWDLPNSEFTLTWDSIRTLLPAAFSMAMLGAIESLLCAVVLDGMTGTKHKANSELVGQGLGNIIAPFFGGITATAAIARSAANVRAGATSPISAVIHSILVILALLVLAPLLSWLPLSAMAALLLMVAWNMSEAHKVVDLLRHAPKDDIIVMLLCMSLTVLFDMVIAISVGIVLASLLFMRRIARMTRLAPVVVDVPDDVLVLRVIGPLFFAAAEGLFTDLESRLEGKRIVILKWDAVPVLDAGGLDAFQRFVKRLPEGCELRVCNLEFQPLRTMARAGIQPIPGRLAFFPNRRAAMADL

SEQ ID NO: 67512 - protein, 335 aa, Vibrio vulnificus CMCP6
MTGGMGYIGSHTCVQMMAAGMEPIIVDNLCNAKVDVLSRIEALTGKQPTFYQGDIRDEAFLDSVFAQHDIQAVIHFAGLKAVGESVAKPLEYYDNNVNGSLVLARCMRKAGVKSIVFSSSATVYGDPEIVPITEDSPTGATTNPYGRSKYMVEQCLSDLFHAENDWSITLLRYFNPVGAHPSGSMGEDPQGIPNNLMPFIAQVAVGRREKLSVFGNDYPTPDGTGVRDYIHVMDLADGHIAALKSVGKTSGLHIYNLGTGKGSSVLEMVEAFAAACGKPVPYELCPRRPGDIAECWASTEKAERELGWKATRSVAEMTADTWNWQSNNPNGYSPA

SEQ ID NO: 67513 - protein, 386 aa, Vibrio vulnificus CMCP6
MSELIQNVKTSFEQVLGYAPSHIIQAPGRVNLIGEHTDYNDGFVLPCAINYQTVVAAAKREDNIVRVVSVDYGNAVDEFDITQAITFQQDKMWANYIRGVVKCLLARGYSFTGADISVSGNVPQGAGLSSSAALEVVIGQTFKVLFNLEISQAEIALNGQQAENEFVGCNCGIMDQMISAEGRENHAMLLDCRSLETESVSMPEEMAVVIINSNKKRGLVDSEYNTRRQQCEEAARIFGVKALRDVTIEQFNEKVAELDEMVAKRARHVITENDRTVEAAQALRAHDMKRMGELMAESHASMRDDFEITVKEIDTLVEIVKEVIGDQGGVRMTGGGFGGCIVALVPPALVDDVKATVAAKYQAATGLKESIYVCQAKDGAGLVEVL

SEQ ID NO: 67514 - protein, 450 aa, Sinorhizobium fredii
MITPVPQHNSLEGTPLEPAISSLWSTAKRIDTRVVAERITRAVGTLIHAVLPEARIGELCLLQDTRTGLSLEAEVIGLLDEWRAAHRSEAWRVCPAARSRLHWRMREVPIGPDLLGRVIDSRCRPLDGKCEVKTTEVRPLHGRVPNPMTRRMVERPFPLGVRALDGLLTCGEGQRIGIYGEPGGGKSTLISQIVKGAAADVFIFALICQRGREVREFVERHLGEEGLRRAIVVVETSDRSATERAQCAPMATALAEYFREQGLRVALLLDSLTRFCRAMREIGLAAGEPPTRRGFPPSVFAALPGLLERAGMGERGSITAFYTVLVEGDGTGDPIAEESRGIVDGHIVLSRALAARSHFPAIDVLQSRSRVMDAVVSETHRKAASFFRDLLARYAECEFLINVGEYKQGGDPLTDRAVASIGELKEFLRQSEDEVSDFEETVGWMSRLTS

SEQ ID NO: 67515 - protein, 93 aa, Triticum aestivum
  misc_feature (67)..(67): Xaa can be any naturally occurring amino acid
AYAHAFETLVLLVTKPLETSLVTDGPWLLTLPSIAIITREITMSAVRERARAQNTQILEAVAVYNLXGMWTTATHMTGLTVLLASTYPSLHFQ

SEQ ID NO: 67516 - protein, 791 aa, Pseudomonas putida KT2440
MVEYVVSLDKLGVHDVEHVGGKNASLGEMISNLAGAGVSVPGGFATTAQAYRDFLEQSGLNDRIHAALDALDVDDINALTKTGAQIRQWVMEAEFPPRLDSEIRTAFAEMAAGNDNMAVAVRSSATAEDLPDASFAGQQETFLNIRGVDNVIRAAKEVFASLFNDRAIAYRVHQGFDHKLVALSAGVQRMVRSETGTAGVMFTLDTESGFRDVVFITGAYGLGETVVQGAVNPDEFYVHKNTLQAGRPAILRRNLGSKAIKMIYGDEAKAGRSVKTVEVDRAERARFCLTDAEVSELAKQAMIIEQHYQRPMDIEWAKDGDDGKLYIVQARPETVKSRSSANVMERYLLKEKGTVLVEGRAIGQRIGAGKVRVINDVSEMDKVQPGDVLVSDMTDPDWEPVMKRASAIVTNRGGRTCHAAIIARELGIPAVVGCGNATQVLKDGQGVTVSCAEGDTGFIFEGELGFDIKQNSVDAMPELPFKIMMNVGNPDRAFDFAQLPNAGVGLARLEFIINRMIGVHPKALLNYAGLPADLKDSVDKRIAGYNDPVGFYVEKLVEGISTLAAAFYPKKVIVRLSDFKSNEYANLIGGKLYEPEEENPMLGFRGASRYISESFRDCFELECRALKRVRNEMGLTNVEIMVPFVRTLGEASQVVDLLAENGLARGDNGLRVIMMCELPSNAILAEEFLEYFDGFSIGSNDLTQLTLGLDRDSGIIAHLFDERNPAVKKLLANAIAACNKAGKYIGICGQGPSDHPDLAKWLMEQGIESVSLNPDSVLETWFFLAEGQGAA

SEQ ID NO: 67517 - protein, 348 aa, Kluyvera ascorbata
VAQRPDTHGYSTSRGIPRLRRAISRWYHDRYDVEIDPESEAIVTIGSKEGLAHLMLATLDHGDTVLVPNPSYPIHIYGAVIAGAQVRSVPLVQGVDFFNELERAIRESYPKPKMMILGFPSNPTAQCVELEFFEKVVALAKRYDVLVVHDLAYADIVYDGWKAPSIMQVPGARDVAVEFFTLSKSYNMAGWRIGFMVGNKTLVNALARIKSYHDYGTFTPLQVAAIAALEGDQQCVRDIAEQYKRRRDVLVKGLHEAGWMVEMPKASMYVWAKIPDKYAAMGSLEFAKKLLQDAKVCVSPGIGFGDYGDTHVRFALIENRDRIRQAIRGIKAMFRADGLLPSEHKSAE

SEQ ID NO: 67518 - protein, 226 aa, Moritella sp. PE36
MRDIRLDNKKIHFENAAFRISAPDISHLTDDSGIEIAFAGRSNAGKSSALNTLTRQKSLARTSKTPGRTQLINVFEIEEGKRLIDLPGYGFAKVPFEVKKKWQKALGEYLQKRQSLKGIVVLMDIRHPLKDLDKQLILWAVDSDIPVMALLTKADKLKQGVRSKTVREVKEAVKEFGGDVTVAPFSSLKNTGIDVLKNKLCEWYALEPAINIASDDDEAFDVVDED

SEQ ID NO: 67519 - protein, 320 aa, Ralstonia solanacearum GMI1000
MGPLTPACTVNGNAQRRVVLALPGNQAAAARLAAPLAAEIGQAEMKRFPDGEFHVRLQTPVCDAEVAIVCTLDRPDEKVLPLLWLAIAAHQGGARRVGLVAPYLAYMRQDAIFQSGEICAARHFAELLTRYFDWLVAVDPHLHRIPELSDIYGMPVTVAQAAPAMAAWVRAHVSDPLFIGPDDESRQWVEHVAGLCSAPWTVLSKTRYSAWDVAVSAIGSNPRSQHTPVLIDDIISTGRTLIAAAHQLHSAGLRRPLCVAVHAVFATDAYSELSAVAADVITCDTIAHPSNRIALSEPVAAAISTMFDLPLPAAIQRLAR

SEQ ID NO: 67520 - protein, 92 aa, Oryza sativa
  misc_feature (21)..(21): Xaa can be any naturally occurring amino acid
  misc_feature (68)..(68): Xaa can be any naturally occurring amino acid
MAQPAFLSSLRSRLRSPQPQXLPALPHLQAPRRGFHVELGAREKALLEEDTALKRFKSYQNSVKQVSXKVGNILTGVVLFACAYEIVALANS

SEQ ID NO: 67521 - protein, 132 aa, Helicobacter pylori
SNIKYELDKESGALMVDRVLYGAQNYPANYGFVPNTLGSDGDPVDVLVLSDVAFQAGSVVKARLFGVLNMEDESGMDEKLLALPIDKIDPTHSYVKDIDDLSKHTLDKIKHFFETYKDLEPNKWVKVKGFEN

SEQ ID NO: 67522 - protein, 281 aa, Corynebacterium glutamicum ATCC 13032
MNIHLCCCSRLCGRMVATSQFIDDSEAAQAVRAAIVAGYRNIDTALAYGNERGVGEGIRTAGVPREELFISTKLAAEIKDYDGAVAAIDESLAKIGLDYVDLMLIHSPQPWSDFRGGDYSEGNREAWRALEDAYKAGKIRSIGVSNFLEADLENILDSATVAPHVNQLLVHVGNTPSELISFCDSKGILVEAYSPIAHGEMLKNQQVKAIADKYNVSIPQLCIRYTIQLGTVSLPKTANPDHMSSNAQIDFEISEEDMAALQEVTARDYGEHSGFPVYSGK

SEQ ID NO: 67523 - protein, 199 aa, Pseudomonas putida KT2440
MPCYRLDGLTPVVHPTAYVHPSAVLIGDVIVGPRCYIGPLASLRGDFGRIVLEEGANLQDTCVMHGFPGGDTVVERNGHVGHGAVLHGCRVGEDSLIGMNAVVMDGAHVAPRCIVAATAFVKAGFECAAQSLVMGSPAQVKRPLSEQELAWKQRGTAEYQHLAQRCMNSMVECPPLAEAEPGRPRMEDTGVRPKGQASA

SEQ ID NO: 67524 - protein, 127 aa, Zea mays
MAAASGRAPSACALLLFLLLVVGAAVVDANRGEQEQEQDWDWEQLSAASPSPWSPAPAPAPSPVSFIDCGSACGARCALSSRWNLCRRACGSCCARCNCVPPGTAGNHDVCPCYAAITTRAGRPKCP

SEQ ID NO: 67525 - protein, 464 aa, Photorhabdus luminescens subsp. laumondii TTO1
MQASLQLERGLNARHIRFMALGSAIGTGLFYGSAEAINMAGPAVLLAYLVGGAAVFMVMRALGEMAVHRPDAGSFASYAHQYLGPLPGFITGWTYTFEMIIVCLADVTAFGIYMGLWYPEVPRWIWVLSIIFIIGALNLCKVKVFGEMEFWLSILKVAAISAMIIAGTGIILFGFSGHFQATGVQNLWQHGGFMPNGLGGIIESLAVVMFAFGGIEIIGITSSEAKNPAKVIPQAINSIPFRILLFYVLTIFVLMAIYPWNSIGQEGSPFVAIFQGLGIGSAANILNIVVITAAISAINSDIFGAGRMMYGMAEKGLAHKKFMHLSRNGVPWVTIMVMTLALLCAVVLNYLLPKQVFVIVASIATFATVWVWLMILLSQFAMRRKMSPGEAQKLQFPVPMWPVAPILTIVFMIFIIAVLSYFPATRIAFYVGGAWIALLTSAYYLWIRKNVIIVSAQSAKETRC

SEQ ID NO: 67526 - protein, 542 aa, Clostridium acetobutylicum ATCC 824
MAYTALYREWRPKTFGEVVGQEHVTTTLKNQVKNNRIAHAYLMCGTRGTGKTTTAKILSKAVNCLNPQDGEPCNECEMCKKINAGIAIDVTELDAASNNSVDDIRNIIDDVQYPPHESKFKVYIIDEVHMLSQGAVNAFLKTLEEPPQNVVFILATTDPQKLPVTILSRCQRFDFKRIKRESMIGRLREIVNEKGVFADDRSLGVIARMSDGALRDAVSILDQAIAEGNGKVDYEKVLQMLGIVTNEYIFDLMDHVINKDIEGSIKIVDKIILQGKEITVFMKDFIAHVRNLMVVKVSKKPEEVIDMSEENLKTLKEQSSKIRIEETMRDINILQEAEEKARKSMNSRIYMEMAIIKMCKIEYDTSSEILLARINKLETIIREGKISVQKVEAKQKPSSSQKVPRLTVNKAEEHDEAKPEEEFSSDLNISLDDVRKIWRDVIEMFKSRRNMVMGVHLSNGVPFSCKDGVIEVRFTKEYNFSKQHLEKPQNNKKVEEVLQDMLHGRVRVIYSLEKGDGTTNQGSTEDILKKTFGEEELHIIDE

SEQ ID NO: 67527 - protein, 312 aa, Solibacter usitatus Ellin6076
MTPGNPTLQHEASAQSNPIRIVVLGEVLWDVFPDSVRLGGAPLNFAVHASRMGFESLLVSAVGDDDLGRRAHQAVAKMGLDTSLLHTSARWQTGTASVQLDASGYPAFQIPRPAAYDDARLTEKDILRLTAWSPAWLYHGTLFPSKKEGRSTLSRLIQALPQTMRFYDVNLRPGFDSPELVTGLLADADVVKLNETELREVSRFAGLPSEIEAFGRAGAEQYGWRAVCVTLGERGCAILTGKDYLVAAAHPVDVVDTVGAGDAFAAAFLHGLSRQWAIENIAAFANRVGAIVASRAGAIPDWSVAETADPLH

SEQ ID NO: 67528 - protein, 500 aa, Arabidopsis thaliana
MDSIWILSLLFFIIFLLLAAFKRKNHGKHRRIPSPPGFPIIGNLHQLGELQHQSLWKLSKKYGPVMLLKLGKVPTLILSSSETAKQALRDYDLHCCSRPSLAGGRELSYNNLDMSSSPYNEYWKELRKLCSQELFSANKIQSIQPIKDEEVKKVIDSIAESSSLKNPVNLSKTFLALTTSVVCKAAFGVSFEGSVLNSDRFNKLVRDTFEMLGSFSASDFIPYVGWIIDKFNGLQGWRKKSFRDLDAFYEQIFDLHKEEKEVGSEDLVDVLLRLEKEEIVVGNGKLTRNHIKAILMNILLGGIDTSAITMTWAMAELAKNPRVMKKVQAEIRNQIKNKERISFDDTDKLEYLKMVIKETWRLHPPTPLLLPRDVITEFEINGYTIPAKTRLHVNVWAIGRDPDTWKDPEMFLPERFNDSNIDAKGQNFELLSFGSGRRICPGLYMGTTMVEFGLANMLYHFDWKLPEGMVVEDIDMEEAPGLTVSKKSELVLVPVKYLDH

SEQ ID NO: 67529 - protein, 534 aa, Synechococcus elongatus PCC 6301
MTLQTEMEAALEVAALNREMLIILDFGSQYSELIARRIRETQVYSEVLSYRTTADQIRQLSPKGIILSGGPNSVYDDYAPVCDPEIWNLGIPVLGVCYGMQLMVQQLGGQVDRAERGEYGKAALVIDDPTDLLTNVEPGSTMWMSHGDSVKTMPEGFELLAHTDNTPCAAIADHQRKFYGVQFHPEVVHSVHGMALIRNFVYHICDCEPTWTTETFVEEAIREIRARVGDKRVLLALSGGVDSSTLAFLLHRAIGDQLTCMFIDQGFMRKGEPERLMEVFNEKFKIHVEYIQARDRFLQRLEGITDPEEKRKRIGHEFIRVFEEESRRLGPFDYLAQGTLYPDVIESADTNVDPKTGERVAVKIKSHHNVGGLPKDLQFKLVEPLRRLFKDEVRQVGRSLGLPEEIVKRHPFPGPGLAIRILGEVTAEKLNILRDADLIVRQEVNRQGYYDEFWQAFAVLLPVKSVGVMGDKRTYAYPVVLRFVSSEDGMTADWSRAPYDLLETISNRIVNEVKGVNRVVYDITSKPPGTIEWE

SEQ ID NO: 67530 - protein, 436 aa, Aspergillus oryzae
MEASTLSSRADAQCQTYSNIVWEVLKDLWHPQDNPKGIVNLGVAENTLMHAELQDFVRRNTSIHQHAFTYGDGNFGSKRLRRAVAQFLNERLRPVLPLEAEHIVVTNGVSHAIEHCSWALCNKGDGILLGRPYYKSFIADISLRPEVEVITVSFGGLDPLGTDCVKRYEEAVLSARQRGVVVRGLILCNPHNPSGRCYPEETIKELMKLCQRHRIHFISDEIYALSTWENKEETWDSPPVPFISTLAVPTDGLIDPERVHVLWGMSKDFGANGLRVGYLISQHNRNLHTALQSVALYSYVSSISDHLAAAILENVDWVDRYIESNRQKLSESFSFAVRFLRQQGISYTPGAYAAFFLWVDLGRAYCERHPESSTSRDLNTKISRRLIEEKVFIANGTIFGSEKEGLFRVVFSHPIGYLEEGLKRMMKAINNHACVQ

SEQ ID NO: 67531 - protein, 210 aa, Triticum aestivum
RTRGETSSTSGMRDTVETSPLLQYRAQTVVPGRILKMEEAIKNRDFESFARLTCADSNQFHAVCLDTSPPIFYMNDTSHRIISLVGKWNHARGTPQVAYTFDAGPNAVLIARNRKTGTLLLQRLLYTFPPQENDLDSYMLGDKSILSDAGLQSIADVEALPAPPEMKAPNQKFKGDVSYFICSRPGAGPKVLTDESHALIDSATGLAKGV

SEQ ID NO: 67532 - protein, 337 aa, Escherichia coli CFT073
MPGPHSFRQILSTNGRMPEVLLVPDMKLFAGNATPELAQRIANRLYTSLGDAAVGRFSDGEVSVQINENVRGGDIFIIQSTCAPTNDNLMELVVMVDALRRASAGRITAVIPYFGYARQDRRVRSARVPITAKVVADFLSSVGVDRVLTVDLHAEQIQGFFDVPVDNVFGSPILLEDMLQLNLDNPIVVSPDIGGVVRARAIAKLLNDTDMAIIDKRRPRANVSQVMHIIGDVAGRDCVLVDDMIDTGGTLCKAAEALKERGAKRVFAYATHPIFSGNAANNLRNSVIDEVVVCDTIPLSDEIKSLPNVRTLTLSGMLAEAIRRISNEESISAMFEH

SEQ ID NO: 67533 - protein, 409 aa, Physcomitrella patens subsp. patens
MAPSVFEHVQQAPEDPILGVTVAYNKDPSPLKVNLGVGAYRTEEGKPLVLNVVRRAEQQLVADRSRNKEYQPITGISQFNKLSAKLILGANSPAIAENRVATVQALSGTGALRVGAEFISRHYAKPIIFLPNPTWGNHNKIFPLGGVPQKPYRYYDPKTRGLDYEGMLEDLKAAPDGAVILLHACAHNPTGVDPTEEQWEGIRQVIRSKHQLPFFDCAYQGFASGSLDKDAHAVRLFVADGGECFVAQSYAKNMGLYGERVGALSVVCTNAAVASRVDSQLKLVIRPMYSSPPAHGAAIAATILADGRLFQEWTVELKGMADRIISMRQQLYDALQARGTPGDWTHVLKQIGMFTFTGLNKSQVEFMTRQYHIYMTSDGRISMAGLSSKTVPHLADAIHAAVVGAQRKS

SEQ ID NO: 67534 - protein, 535 aa, Synechococcus elongatus PCC 6301
MRFGPDAHRCCQALGKLRRSRQSLRTSMAKRGAIAAGHPQTVAAGLVALEAGGNAFDAAIAALAASWITEPLLTSPAGGGFLLAAQPHQSPRLYDFFCQTPSQRSPEPQDFYPVGVDFGDAIQEFHIGLGSVAVPGLLAGLLRVQAELGRLPRSVVLEPAIALGREGVEINAFGEYCFRLLDPIVTATPEARSLYQPQGQPLRSGDRFRNTDLAAVLEELAAPKGQAFYEHELLPAIANYCAAGGNLQLTDLQQYPVAVRSPLAIPFGNYRLLTNPPPSSGGLLIAFALSLLNQSVINLNPQQHPQDLVQLMRLTNRARRDFLDGALQQAGIDRQFLTGAAFEQAAAGWLNRLGSTTHISVIDAEGNAASLTSSNGEGCGHVLPDTGIMLNNMLGEADLHPLGFHRWPLGQRLGSMMSPSLLWGEDDRPHLVLGSGGSNRIRTAILQVIHRWAVEGYALAEAIAAPRLHWEAGVLNWEPGWDPAGIEAASQPSETAIAWTTPNMFFGGVHAVGLTATGEFCGAGDPRRSGVYGCC

SEQ ID NO: 67535 - protein, 256 aa, Triticum aestivum
  misc_feature (24)..(24): Xaa can be any naturally occurring amino acid
MGSAASPPRALDAATQEDLKRVSXHRAVDMVESGMTLGLGTGSTAAHALDRLGALLRTGALRAVAGVPTSLKTEAHAARVGIPMLALADAAEIHLSIDGADEVDPDLNLVKGRGGSLLREKMIEGAGARFVVIVDESKLVPRLGCTGSVPVEVVPFGSAYTLGLIRMVFDKLPGFHARLRTVKSKAGDGQEELFLTDNGNHIVEMFFEDGIHGNLRDISDSLLRITGVVEHGMFLGMATKVIVAKKDGTVAVLSKK

SEQ ID NO: 67536 - protein, 333 aa, Methanosarcina acetivorans C2A
MPSKLFITFPPIKLQMIIGVMGPEGSYSERAAKLWIQKNSLKDAEFRYFGDIEDAFLAAVKGNADVSVIPVENSIEGSVGVTLDLLLENEAVIIGEIVVKIEHCLLSKGGPDKIRVILSHPQGLAQCRHFLKRHFPEAELRSTGSTSHAARLAGEFEEMAAIASPEAAERYGLKILLSNIQDRKENHTRFIIIRAGQKTSSEQTMDAAGVEGKSIPEPCRREEPEFHPETSREKVSHSACKTSLIVYLEKDRPGALYELLGAFAKRGINLTKIESRPSKKELGDYYFYIDFEGCTSDALIKGALEDIKSKAGTKSKANTLKVLGSYPAFRNFV

SEQ ID NO: 67537 - protein, 147 aa, Picea sitchensis
MYALSNMNGSLRKDQLICPIPDRMMASGPCTTRAIHKLYARNHSYAVAGNEGEPSYEILEILLNKSQYGDQTSVKNSHPYFYGSPPNRSDNPLVRDTQFIRKGVPSSPVNLSQNTSCGASYGAKPLVRVEGFASKNQDTRCNLSALA

SEQ ID NO: 67538 - protein, 128 aa, Glycine max
MAASAATATATAAAVGAGEVISVHSLEQWTMQIEEANAAKKLVVIDFTASWCGPCRIMAPIFADLAKKFPAAVFLKVDVDELKPIAEQFSVEAMPTFLFMKEGDVKDRVVGAIKEELTTKVGLHAAAQ

SEQ ID NO: 67539 - protein, 344 aa, Oryza sativa
MGTRAAFVVAFLIRSLYGGMQIVTKFAFNEGMSTSVFVFYRHVIAILFLVPVAFVLERKTAPPLTFKVSLKLFLHALYGISGAINIYSLGLSYASATSSSAIFNLLPAVAFILALLMKMESLNLKRINGIAKVSGIVLCIVGVIILAFYQGPELKSFNHHHLFRTSTVYAAATSHPATTWILGIFLTTLSTTCWALWTVLQGPMLEVYPSKLLNTTIQIVFATIQCFFIALAIERDFSRWKLHLDMGLIAVIYSGVLVSGVAYYMQVWVIDKSGPVFLAMTMPITLLVTIMLSSFVLGEAVTLGSIISGVVMVGGLYCVLWAKKSEQAAISKQQMVVPVQTTRV

SEQ ID NO: 67540 - protein, 245 aa, Arabidopsis thaliana
MDKISIRCFIFLVLTSFVTTVSCLSAATDYREVEDEHEFSYEWNQENGPAKWGKLRPEWKMCGKGEMQSPIDLMNKRVRLVTHLKKLTRHYKPCNATLKNRGHDMMLKFGEEGSGSITVNGTEYKLLQLHWHSPSEHTMNGRRFALELHMVHENINGSLAVVTVLYKIGRPDSFLGLLENKLSAITDQNEAEKYVDVIDPRDIKIGSRKFYRYIGSLTTPPCTQNVIWTVVKKVNTHRYFLLFFT

SEQ ID NO: 67541 - protein, 433 aa, Cryptococcus neoformans var. grubii
MGGCMSTPEAPKKTAETKQVPSTSTSSRPPQASTSATATAAGAGTSAANGTANGIKGDTTATNRVGTSGGQGLAAALASTEPPGAQDSKGNKDRSNQIDRQLEDDQKKFRKECKILLLGSGESGKSTIVKQMKIIHQNGYSKDELLSFRGVIYKNVLDSAQALIMAMRKIGVDPEDANNRSYADRILEYRMDAGLDAVIPSEILYNIESLWHDPVIPSVMDRSSEFYLMDSATYFFANIRKIAGPDYVPDEADVLRARTKTTGISETRFNMGQLSIHMFDVGGQRSERKKWIHCFEAVTSIIFCVALSEYDQVLLEESGQNRMQESLVLFESVINSRWFLRTSVILFLNKIDLFKQKLPKVPLVQYFPEYTGMRRNINKAAKYILWRFTQTNRARLSVYPHLTQATDTSNIRLVFAAVKETILQNALRDSGIL

SEQ ID NO: 67542 - protein, 750 aa, Coccidioides immitis RS
MPRSTDRSPSPRREERRRSRSRSPRRRRYDDDRDRDRGRKKQSGFRWKEKPRRDDDISGREPERGLERGYRERDRARSPFRDRDRDYGRGRERYRDGDRDRRPSDRDRDRAPDRDTERNRSKEDRDRKERKPKEKKEKKPAAPAEPMIVVHVNDRLGTKAAIPCLASDPIRLFKAQVAARIGREPHEILLKRQGERPFKDQLTLEDYGVSNGVQLDLRLAGCVLSVSSVQMTVMTMAGVRFLRFDDHYILVCRTHVLLLQLFKNGYHGLLAALQLPRPFAIIPDVIEDMTRPSAGLMVRNIVVLGGTAHPHLNKTICDQLGIPPANILLSKFSVGETRVEIYESVRGKDVYIIQSGGGKVNDHLMELLITISACKTASAKRVTAVLPLFPYSRQSDIPYNKTGAPLVKSPTNRNDTSPAYTFESTPPTPHPAKADSLGLVNGIDGLQKGLATAQLEDREGSGNTSPQKARISHYVNGVPKRSDTMDSIRYEAATKGDRNAAPVNGVHSHDDSASVTSTSSKLTTFQPRPGYRQWVAQAGTLVADLLTCAGADHVITMDLHDPQYQGFFDIPVDNLYGRPLLKKYIQENIPNYKSCIIVSPDAGGAKRATAIADSMGMEFALIHKERRPTKIADRQNATMMLVGDVKDRTCILIDDLADTANTITRAAKLLKKEGASMVYALVTHGILSGDAIDRINASGLDKVIVTNTVDQDDHLKRCPKLEVLEVGQVFAEAIRRVHHGESISVLFQYD

SEQ ID NO: 67543 - protein, 132 aa, Helicobacter pylori
SNIKYELDKESGALMVDRVLYGAQNYPANYGFVPNTLGSDGDPVDALVLSDVAFQAGSVVKVRLVGVLNMEDESGVDEKLLALPIDKIDPTHSYVKDIDDLSKHTLDKIKHFFETYKDLEPNKWVKVKGFEN

SEQ ID NO: 67544 - protein, 513 aa, Vibrio vulnificus CMCP6
MKNNSSTPTSTLDILVVGGGINGAGIAADAAGRGLSVALFEAKDFASATSSASSKLIHGGLRYLEHYEFRLVSEALAEREVLIKKAPHIAFPMRFRLPHRSYLRPAWMIRCGLFLYDHLGKRTTLPSSHKVNLAETGLLKEEMKIGFEYSDCWVDDARLTLLNAISAKRNGAEVRNYCKVSKAERVDGLWKVTIEDQQNGEQFVRYAKALVNAAGPWVKQFYDDSLDGPSPRNIRLIKGSHIVVPRVHPDPQAYILQNNDGRIVFVIPYLDKFSIVGTTDVEYTGDPRHVAISEQEVDYLIDIVNQHFVHQLSKQDVVWTYSGVRPLCDDESDSPQAITRDYTIELEQELDQAPLLSIFGGKLTTYRKLAESAMRKLAPYFDHMGTPWTAQQTLPGGDFSCTREQLAHALRQQYPWLSATLAYRYVCQYGSDARQLLAGAEEVSAMGIELAPEVYQRELDYLMAHEFAQCSEDILWRRTKLGLYLTPEQVQSVENYIAKKHTTAQSPQLQQAS

SEQ ID NO: 67545 - protein, 142 aa, Picea sitchensis
MASSIMALSSTAAVAAVAAPPKTSNGNGSSNGNVVSAFTGLKSTAQFPSSMKISNAGAEWERKTTSNGGRVRCMQVWPPYNNPKFETLSYLPRLTQEQLLKEVEYLLRNKWVPCLEFDEVKFYLKSGYTVNLVLHSFQFLVT

SEQ ID NO: 67546 - protein, 411 aa, Pseudomonas putida KT2440
MYYRVRCSMSASFWKSGHVPTLFAAFLYFDLSFMVWYLLGPLAVQIAADLQLSAQQRGLMVATPILAGAILRFAMGVLVDRLSPKTAGLIGQVVVIVALAAAWHLGVHSYEQALLLGVFLGFAGASFAVSLPLASQWYPPQHQGKAMGIAGAGNSGTVFAALLAPALAAGFGWNNVFGFALIPLSLALVVFALLARNAPQRPKPKAMADYLKALGDRDSWWFMFFYSVTFGGFIGLASALPGYFSDQYGLSPVTAGYYTAACVFAGSLMRPLGGALADRFGGIRTLLGMYGVAAICIAAVGFNLPSAAAALALFVSAMLGLGAGNGAVFQLVPQRFRQEIGVMTGLIGMAGGIGGFLLAAGLGTIKQHTGDYQLGLWLFASLGLLAWFGLHGVKQRWRTTWGSAAVTAARV

SEQ ID NO: 67547 - protein, 507 aa, Yarrowia lipolytica CLIB122
MVTAAVIGGGASGAITVDTLRKQGIETTVFERRDILGGVWVYDSDPGPLTVVPGRTGEQSDLVSNTPDFEGIEPGESINTSPGEYNRQTFENPHRYEPTPTFESLSTNVPERVMTYSDKPKWDWKENGVYTYPLQTRFVHHSTIQRYIEQYFQPNIDVVKFSTTVEKASKTKDGKWTLTTRTRSATEDVWAQTKYDHLVVATGHYHVPFIPDVPGIQLAYRLYPNRIVHSKHFRESNLDLFKDKTVVIVGSRASGADLVSLLAPIAHQTIQSVRATKGPIFKKSFVNQDKVVRAGEVVSYVCKDGGFNVETADGQSFSPDVVIYCTGYQYSYPFLRDQVPDLTDGVFLPDVYLHTFYTPDPSLAFVGVPVDAVSFRAFEYQAVWVARYISGQIELPSVDEQQLWNKRRFEERGSTRSYHSLSSLEAVQDFFDALTELGGGVKAQKKGGRDFPVFGRQDIDELKAAAPARWVEEPNKEAAEEESETSELDTGDSEGHTDDTSVDGDEK

SEQ ID NO: 67548 - protein, 315 aa, Hordeum vulgare
MASSSYTSLLVLVALVTAASAQLSPTFYDTSCPRALATIKSGVMAAVTSDPRMGASLLRLHFHDCFVQGCDASVLLSGMEQNAIPNAGSLRGFGVIDSIKTQIEAICKQTVSCADILTVAARDSVVALGGPSWTVPLGRRDSIDANENEANTDLPGFNSSRAELEAAFLKKGGLNTVDMVALSGAHTIGQAQCSTFRARIYGGDTNINTAYAASLRANCPQTVGSGDGSLANLDTTTANTFDNAYYTNLMSQKGLLHSDQVLFNNDTTDNTVRNFASNPAAFSSAFTTAMIKMGNIAPKTGTQGQIRLSCSRVNS

SEQ ID NO: 67549 - protein, 644 aa, Prochlorococcus marinus str. MIT 9303
MRLSELTHPNQLHGLSIAELEDVARQIRERHLEVVSTSGGHLGPGLGVVELTLALYQTLDLDHDRVVWDVGHQAYPHKLITGRYGDFNTLRQQGGVAGYLKRCESSFDHFGAGHASTSISAALGMAVARERRGESFKCVAVIGDGALTGGIALEAINHAGHMPNTPFLVVLNDNDMSISPPVGALSTHLNRMRHSAPVQFISDSVEERVKSLPFMGGELPAELDLLKGSMRRLSVPKVGAVFEELGFTYMGPIDGHDIERMVRTFETAHKVGGPVLVHVVTTKGKGYPYAEADQVGYHAQSAFDLITGKALPSKGKKPPSYSKVFGETLIKLCQQDSTVVGITAAMATGTGLDLLQKAVPEQYIDVGIAEQHAVTLAAGMACEGLKPVLAIYSTFLQRAFDQLIHDVGIQNLPVTFVMDRAGIVGADGPTHQGQYDISYFRAIPNFTVMAPKDEAELQRMLVTCLQHQGPAALRIPRGSGEGVPLLDEGWEPLAIGRGEVLCEGDDLLIVAYGVMVPAAMITAQLLQEAGVKATVINARFLRPLDQALIHPLARRIGRVVTMEEGALAGGFGAAVVESLSDQDVLVPTFRIGIPDQLVDHASPQQSREALGLTPTQMSERIQEHFCLNSQPSLVGQEAPQALST

SEQ ID NO: 67550 - protein, 87 aa, Actinidia chinensis
VLDRDTLKTIVRFTNDKNIHLVSDEIYAATVFNKPGFISIAEIIEAETYCNRDLIHIVYSLSKDLGFPGFRVGIVYSYNDQVTLCAL

SEQ ID NO: 67551 - protein, 216 aa, Thermoanaerobacter tengcongensis MB4
MKIAPSILSADFANLLQDVKEIEEDADLLHIDVMDGHFVPNITIGSVVVKALRQYTSLPFDVHLMIENPDLYIEDFVKAGADIITVHQEACVHLHRTIQRIKGHEVKAGVALNPATPLETLKYILEYVDLVLVMTVNPGFGGQKFIDSMLKKIKELDEMRKEMNLSFEIEVDGGINIKNIKQVVEAGADIIVAGSAIFESPDPSSTIKEFREAVGT

SEQ ID NO: 67552 - protein, 591 aa, Triticum aestivum
MGIAQAAAPLRLHLGCSGAAPPRPTSLRVGVGFGSHARRKGGRRRNPPRAASSLHPSSNPRAHDHEPALKPPAPAPAVDVAGRDLNGAADHAPQQRRRAASDLEEEAWALLRESVVSYCGSPVGTIAACDPNDSSPLNYDQVFIRDFVPSGIAFLLKGEYDIVRNFILHTLQLQSWEKTMDCHSPGQGLMPASFKVRVVPLEGDEEGATEEVLDPDFGEAAIGRVAPVDSGLWWIILLRAYGKCSGELSFHERIDVQTGIKLILKLCLADGFDMFPTLLVTDGSCMMDRRMGIHGHPLEIQSLFYSALLCAREMLTPEDGSADLIRALNNRLMALSFHIREYYWLDKRKLNEIYRYKTEEYSYDAVNKFNIYPDQIPPWLVEWIPPEGGYLIGNLQPAHMDFRFFSLGNLWSIVSSLATTRQSHAILDLVEAKWSDLVAEMPLKICYPALEDQEWKYITGSDPKNTPWSYHNAGSWPTLLWQLTVACIKMNRPEIAARAVEVAERRISVDKWPEYYDTKRGRFIGKQARLFQTWSIAGFLVAKLLLENPEKSRILCNNEDEEFANAFNLMADSCNPNRKRGRKALKKTYIV

SEQ ID NO: 67553 - protein, 193 aa, Actinidia chinensis
LLNRETLNTLLDFATEKNIHIISNEILASYSRESEEFVSLVEIIDSEDFDRNRVHIVYGLSKDLSLIGFGMGVIYSFNENVLSASKKLTRFASISAPTQHLLISMLSDTNFVDKFIKTNRERLHRICSEFVVGLKRLGIECAKSNAGFYCWADMRWLICSYSEKGERKLWDKLLNVAKVNVTPGSSCHCIEPG

SEQ ID NO: 67554 - protein, 482 aa, Escherichia coli O157:H7 EDL933
MKLNDSNLFRQQALINGEWLDANNGEVIDVTNPANGDKLGSVPKMGADETRAAIDAANRALPVWRALTAKERANILRNWFNLMMEHQDDLARLMTLEQGKPLAEAKGEISYAASFIEWFAEEGKRIYGDTIPGHQADKRLIVIKQPIGVTAAITPWNFPAAMITRKAGPALAAGCTMVLKPASQTPFSALALAELAIRAGIPAGVFNVVTGSAGAVGNELTSNPLVRKLSFTGSTEIGRQLMEQCAKDIKKVSLELGGNAPFIVFDDADLDKAVEGALASKFRNAGQTCVCANRLYVQDGVYDRFAEKLQQAVSKLHIGDGLDKGVTIGPLIDEKAVAKVEEHIADALEKGARVVCGGKAHERGGNFFQPTILVDVPANAKVSKEETFGPLAPLFRFKDEADVIAQANDTEFGLAAYFYARDLSRVFRVGEALEYGIVGINTGIISNEVAPFGGIKASGLGREGSKYGIEDYLEIKYMCIGL

SEQ ID NO: 67555 - protein, 426 aa, Escherichia coli O157:H7 EDL933
  misc_feature (4)..(4): Xaa can be any naturally occurring amino acid
  misc_feature (9)..(10): Xaa can be any naturally occurring amino acid
  misc_feature (13)..(13): Xaa can be any naturally occurring amino acid
  misc_feature (243)..(243): Xaa can be any naturally occurring amino acid
MSSXKELMXXRSXAIPRGVGQIHPIFADRAENCRVWDVEGREYLDFAGGIAVLNTGHLHPKVVAAVEAQLKKLSHTCFQVLAYEPYLELCEIMNQKVPGDFAKKTLLVTTGSEAVENAVKIARAATKRSGTIAFSGAYHGRTHYTLALTGKVNPYSAGMGLMPGHVYRALYPCPLHGISEDDAIASIHRIFKNDAAPEDIAAIVIEPVQGEGGFYAATPAFMQRLRALCDEHGIMLIADEVQXGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGAMIAIELFEDGDHNKPDAKLTAEIVARARDKGLILLSCGPYYNVLRILVPLTIEDAQIRQGLEIISQCFAEAKQ

SEQ ID NO: 67556 - protein, 468 aa, Propionibacterium acnes KPA171202
MAVAATGIPAESGEPAMDKPRMKGRHLVMMSLGSAIGTGLFVGSGKGVAAAGPATLVAYIVAGLLVIAIMYMLGEMVAAHPDSGAFSVYTSRAMGSAAGFAMGWVWWIELVVVVAAEAIAAASTLVAMWPIAPVWLLTLIFLVVLTAINLLGADRFGEFEFWFALLKVVAVVVFLTIGVLLICGVLAAPAAGTSNLVGHGGFLPNGWSGVATALLLVAFSFGGIEIMAVAAAETEDPAHNVSRAVRTIVWRILVFYMGSVAIMVIAVPWDDPELGASPFVAVLNRAGIPAASEVMTLVIVLALLSSLNANLYGAARMLGSLAERGMAPRVAMRTRGRSVPTVAVLASVAFGFCCVLATFEWGDAVLGTLLNIVGSTIIVTYFFTICSHYVLRRRAEKEGAPLPMRLKGFPVVNWAAMILLIGIVVLGMFSPDVRAQLMSTGALVVILYVIGVGWSHHAGRSPFHPTTD

SEQ ID NO: 67557 - protein, 500 aa, Arabidopsis thaliana
MATILFLSLLFLSCILLAAFTHKKRQQHQRKPPSPPGFPIIGNLHQLGELPHQSLWRLSKKYGHVMLLKFGSIPTVVVSSSETAKQVLKIHDLHCCSRPSLAGPRALSYNYLDIAFSPFDDYWKELRRICVQELFSVKRVQSFQPIKEDEVKKLIDSVSESASQGTPVNLSEKFTSLTVRVTCKATFGVNFQGTVLNSDRFEKLIHDTYLFLGSFSASDYFPNGGWIIDWLTGLHGQRERSVRALDAFYEQMFDLHKQGNKEGVEDFVDLLLRLEKEETVIGYGKLTRNHIKAILMNVLIGGIGTSAITMTWAMTELMRNPRVMKKVQSEIRNQIGKKSMITLDDIDQLHYLKMVINETWRLHPPSPFLIPRQVMSEFELNDYVIPVKTRLYVNVWAIGRDPDTWKDPEEFLPERFVNSSIDAKGQHFELLPFGSGRRMCPAMYMGTTMVEFGLANMLYHFDWKIPVGMVAEDIDLEESPGLNASKKNELVLVPLKYLDH

SEQ ID NO: 67558 - protein, 625 aa, Thermoanaerobacter tengcongensis MB4
MIGRMLGNRYEILEKIGEGGMAKVYKAKCHLLNRIVAIKILRPEFAADENFVKKFKRESQAAASLSHPNIVGIYDVGQEGDIYYIVMEYVKGRTLKELIRENGGPLEVKRAVEIASQVCRALDHAHKNKIIHRDIKPQNILVTDEDVVKVTDFGIARAANGATITYTGDVIGTAYYFSPEQAKGSIVDERTDIYSLGIVLFEMLTGKVPFEGDSPISVALKHIQEDILPPSRLNEKVPEELDKIVLKATQKDPNLRYQTASEFLKDLDTFLKNPKDLKFEEKDFEKTKVMPSREAEELKRAALKREREKKRKEIRKKVGIVLLVLLLLASLSYGTVYVLNNFFKVNDVVVPNVVGLSLSQASKVLSEHNLKMEISEERYSDKPENTILEQDPPQGALVKPGTTVYVVISKGRQMVIVPNVIGRDYLEAKNVLENAGLKVNIIENYNEQYQKGYVFDQNPRYGVQVEYGTTIDVYVSKGPKPSIVPNVVNMNLDEAKASLESAGLTLGKVIYKEADNVPENTVLEQSVPPDTEVQKGSPIDLIVSKLPQNSLQQQTKNVIINLPNKDGPMKVEVYVIQDGQKNLVYSGEHTSSDSPLTVPVTAHKGKAVIEVDIDGQVYSRVEARF

SEQ ID NO: 67559 - protein, 577 aa, Desulfitobacterium hafniense Y51
MRRTKIVCTIGPSSESNEKIRQLLKAGMNVARLNFSHGTHGEHGKRIRTLREEAQKLGVHLGVLLDTKGPEIRTGTVPEEGVQLNSGDTFILDTDLSTLGSAERVGITYLQLWQEVHQGTHILLDDGLIDLEVIASEEGKIITKIQNGGVLKSKKGVNVPGVPIQLPAITEKDRDDIIFGLREGIDFIAASFARKAADILAVRRLVEEEGANVKIIAKIENREGIEHLDEILEVADGLMVARGDLGVEVPVEEVPIHQKDMIEKCHHLGKPVIVATQMLDSMIRNPRPTRAEASDVANAILDGTDAIMLSGETAAGQYPVEAVEMMNKIALQIEKHYEPRKIYDPHINIAEAISHASYTVARDLEAAAILTPTHSGLTARMISKYRPTSLIIAATPFVHVARQLSLTWGIYPLLIPESLGTDQLLSVSVNEAISHHLIKTGDVVVITAGVPVGKVGTTNIIKVQVIGDVIAKGTGIGRKAYSGTARIATSAALELFQKGDILVAPYTDKELIPLIAKAGAILVEEGGLTSHGAIAALNYGIPAIVGAADVLMKVKDGQVLTVDALAGVVYEGTVSII

SEQ ID NO: 67560 - protein, 336 aa, Desulfitobacterium hafniense Y51
MSVRIAINGFGRIGRLSMRAILERKSSLDIVAVNDLGSPDLLGHLFKYDSIHDILPYDVEVKENTLEVLDQKVAFLAEKDPGKLPWRELGVDLVIEATGRFTKREQAALHLQAGAKKVIISAPGKHEDITIVMGVNEHLYNPAEHHILSNASCTTNGLAPLAKVLLEEFGIEQGMMTTTHSVTNDQRILDLEHKDWRRARAAYESMIPTTTGATKAVELVLPDLKGKLKGLAVRVPTPNVSLIDFVANLSRSTTKEEVNQKLREAAEGSLKGYLAYSELPLVSHDFNGNPHSAIVDGLSTLMLGERMVKVLAWYDNEWGYSNRIVDLVEYIAGQGL

SEQ ID NO: 67561 - protein, 560 aa, Aspergillus nidulans FGSC A4
MYPLAPDIRSGFDSSVTHERRRELAPIVSTSIAMEAETQPLLQAPYECRAESDIEPSTGRDGLPTATPGKYLSWTSAYILVVSRVIGSGIFATPGSIVKSSGSIGLSLLLWGAGTVLAACGMVISMEYGCMLPRSGGDKVYLEYTYPKPRYLASTLVAVQAVLLGFTASNCIIFAKYTVFAFGGAPTELTHKLFATGLLTLITIVHGRFRQTGIWIQNVLGWLKIFLISSISLTGIWVILLRPSGIESGAGAASAAMDQGLMNWDTLWEGSNWSWNLLSTSLFKVLYSYAGLNNVNNVLGEVRDPIRTLKTVCPAALLTSAALYLLANLSYFLVVPLNEIKQSGELVAALLFDRLFGPRVGGTLFPFAIAVSAAGNVMVVTFALARVNQEIARQGFLPWGDLLSSSKPFGTPLWGLIVHYIPSILVITLPPQGDVYNFILDVEGYPGTIFGLAITVGMLILRYREPYLTRPFKAWLPAVWLRIVVCLALLVSPFIPPPGHKGDVEFFYATYAVVGTGVLAFGVIYWYVWTVLLPRWGGYKLEEEEKVLDDGTAVTRLVKA

SEQ ID NO: 67562 - protein, 478 aa, Solibacter usitatus Ellin6076
MKMIINGQRVDAASGSSFAVRNPANGEIIDTVPQAGPPDVHAAIEVARLGKAVMAALPAHARCEILKRASQTIERRAEELSQLLTSENGKPINQCRFEIGVTARLFSDFAEEAKRIRGQYLPMDNVPGLERMVAYTLRHPIGIVVGIIPFNYPAELFAHKIPGALAAGNSVIVKLPEQCPLTVLMLGEILLDAGLPPEGMQMLTGYPQEMGDELLTHPDVGMISFTGSASAAKLIACKAAGTLKRLAFELGGTDAMIVLEDANLEAAADAVVHGRLTNGAGQICCAAKRILVQESVYSRFLDLLIERVGKINMGDPLLDETNLGPMISPQAVDKAHDQVRQSLEMGARCLTGGERIDGCFYQPTVVVDVTPEMPVMRDEVFGPVAPIYTFKDAESAVRIANDSPYGLQASVFSENISNALKVAHKLEVGGVVINGSGAFRPGNIPFGGFKQSGIGRESIVETVLDMTEETTIVINQAL

SEQ ID NO: 67563 - protein, 203 aa, Escherichia coli
MERTLTTVSYYAFEGLIPVVHPTAFVHPSAVLIGDVIVGAGVYIGPLASLRGDYGRLIVQTGANIQDGCIMHGYCDTDTIVGENGHIGHGAILHGCVIGRDALVGMNSVIMDGAVIGEESIVAAMSFVKAGFHGEKRQLLMGTPARAVRSVSDDELHWKQLNTKEYQDLVGRCHASLHETQPLRQMEENRPRLQGTTDVTPKR

SEQ ID NO: 67564 - protein, 437 aa, Escherichia coli
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTEKKSKFGANAILAVSLANAKAAAAAKGMPLYEHIAELNGTPGKYSMPVPMMNIINGGEHADNNVDIQEFMIQPVGAKTVKEAIRMGSEVFHHLAKVLKAKGMNTAVGDEGGYAPNLGSNDEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSYLIKFNQIGSLTETLAAIKMAKDAGYTAVISHRSGETEDATIADLAVGTAAGQIKTGSMSRSDRVAKYNQLIRIEEALGEKARTTVVKRSKARHKTDFI

SEQ ID NO: 67565 - protein, 61 aa, Triticum aestivum
LVKFATERGRQTRPNLKVGICGEHGGEPSSVAFFAKVGLDYVSCSPFRVPIARLAAAQVLV

SEQ ID NO: 67566 - protein, 484 aa, Arabidopsis thaliana
MAAKKVFGSAEASNLVTELRRSFDDGVTRGYEWRVTQLKKLMIICDNHEPEIVAALRDDLGKPELESSVYEVSLLRNSIKLALKQLKNWMAPEKAKTSLTTFPASAEIVSEPLGVVLVISAWNYPFLLSIDPVIGAISAGNAVVLKPSELAPASSALLTKLLEQYLDPSAVRVVEGAVTETSALLEQKWDKIFYTGSSKIGRVIMAAAAKHLTPVVLELGGKSPVVVDSDTDLKVTVRRIIVGKWGCNNGQACVSPDYILTTKEYAPKLIDAMKLELEKFYGKNPIESKDMSRIVNSNHFDRLSKLLDEKEVSDKIVYGGEKDRENLKIAPTILLDVPLDSLIMSEEIFGPLLPILTLNNLEESFDVIRSRPKPLAAYLFTHNKKLKERFTATVSAGGIVVNDIAVHLALHTLPFGGVGESGMGAYHGKFSFDAFSHKKAVLYRSLFGDSAVRYPPYSRGKLRLLKALVDSNIFDLFKVLLGLA

SEQ ID NO: 67567 - protein, 302 aa, Candida albicans SC5314
MLRRTPCVIRQVIRTSIRNSSNSGSTSALAYKTLHRNQKRPPLPTLETPNWSADTAVSSILYETPVPSKAPPKQHVLNCLVQNEPGVLSGVSGTLAARGFNIDSLVVCNTEVKDLSRMTIVLKGQDGVVEQARRQIEDLVPVYAVLDYTNAEIIKRELLLARVSLLGPEYFQELIATHQLHIDDGSSIPDIDACESAYHPNNLAPSEALRQKHIHLDHISTLTKQFGGKIVDISDRNVVVELSAKPSRVSSFITLLHPFGILELARSGMMALPRTPLNSFTEVEEESIDAADIVDASQLPPG

SEQ ID NO: 67568 - protein, 540 aa, Oryza sativa Indica Group
MGWTTVAQLEVQTVSHQLRLGKRLANLAFHRTNQGCADANTTRPDHLLLELPLLPLFPNFPNLASLLPRIPQPRIPIPPADRAATSPKIPRRIGLADGLIGDFDSAMEAQWLAEYPHQGADKRPRKRPRLAWDVAPPLFQPPKAIPMLYCGQELINGNFATAFLPPPPIYYTGPPRNLSPPWRPDDKDGHYVFAVGENLTPRYRILSKMGEGTFGQVLECWDLEHQETVAIKIVRSLQKYREAAMIEIDVLQRLGKHDFTGSRCVQIRNWFDYRNHICIVFERLGPSLYDFLRKNSYRAFPIDLVREFARQILESVAFMHDLRLIHTDLKPENILLVSSESIRVPDYKVTIRPPKDGSFFKNLPKSSAIKLIDFGSTTFEHQDHNYVVSTRHYRAPEVILGLGWNYSCDLWSVGCILVELCSGEALFQTHENLEHLAMMERVLGPLPKHMIVRADRRAEKYFRRGLRLDWPEGAASRESLKAVWKLPRLQNLVMQHVDHSAGDLIDLLQGLLRYDPDVRLKAREALQHPFFTRCHRRCGY

SEQ ID NO: 67569 - protein, 395 aa, Escherichia coli CFT073
MLPISRHFLLFFLPIFYIFDKFICKGITIMSNAQEAVKTRHKETSLIFPVLALVVLFLWGSSQTLPVVIAINLLALIGILSSAFSVVRHADVLAHRLGEPYGSLILSLSVVILEVSLISALMATGDAAPTLMRDTLYSIIMIVTGGLVGFSLLLGGRKFATQYMNLFGIKQYLIALFPLAIIVLVFPMALPAANFSTGQALLVALISAAMYGVFLLIQTKTHQSLFVYEHEDDSDDDDPHHGKPSAHSSLWHAIWLIVHLIAVIAVTKMNASPLETLLDSMNAPVAFTGFLVALLILSPEGLGALKAVLNNQVQRAMNLFFGSVLATISLTVPVVTLIAFMTGNELQFALGAPEMVVMVASLVLCHISFSTGRTNVLNGAAHLALFAAYLMTIFA

SEQ ID NO: 67570 - protein, 372 aa, Synechococcus elongatus PCC 6301
MAARDIHFANRDRRPSPLVGAFLLRVREPKQVGRIKPGCPTEKRMDIRNGFIDTIGNTPLIRLNSLSEATGCNILGKAEFLNPGGSVKDRAALFIIEDAERQGKLRPGGTVVEGTAGNTGIGLAHICNAKGYRCLIVIPETQSQEKIDLLRTLGAEVRTVPAVPYRDPNNYVKVSGRLAEELDNAIWANQFDNLANRQAHYATTGPEIWQQTEGTVDAWVAATGTGGTYAGVALYLKEQSSKVRCVVADPMGSGLYSWVKTGEIHLEGSSVTEGIGNSRITANMQDVPIDDAIQIADPEALEIIYQLLHRDGLFMGGSVGINVAAAYRLAKEMGPGHTIVTVLCDGGARYQSRLFNAEWLASKGLQMPQVTT

SEQ ID NO: 67571 - protein, 465 aa, Aspergillus oryzae
MEPSSPFGKFFYFSYFAVGSYLAKSLLDQVGSLPLHLLYSTVEVQSHDDAYNYLLFWLTKQRFNESKNRLIASTSLSSGLDYFSEDSDDGEFDDMLDAEASDTEWKASLSNTRQLLWSPSEGIHYFRYGGRCLALTRQIEERGTMLYTRTDKLRISCLGWDASILKQLLLEARVEYSQKEKGKTVIYRGAKRSYDNDFYWARSTARPARPLSTVILDHEEKTAFIQDVQQYLHPSTMRWYSDRGIPYRRGYLFYGPPGTGKSSLAFAAAGFLGLNVYILDLNATQLTEDALAQLFQELPRRCLVLLEDIDTNEVTSRRGDESKKKRKGNNKISLSALLNTIDGVAAQEGRVLVMTTNHQENLDPALIRPGRVDYQIEFKLANRNLMMQMFQNLFRDVLPSIDSHLEDTCHRAPIRRPPAHFLPIVSSTHSPVGKGNPTMQPFKSSDSEAMLAVCIRHVNMRLFHP

SEQ ID NO: 67572 - protein, 724 aa, Candida glabrata CBS 138
MTSTKTDQSDQQSVRWADKPSINQITVRGTIAGIFIGSLVLISNFQFGLQTGWVSMMSLPSALLACAIFKQLWPVFKPDDPVFTDVENVYVQSLAVAIGTGPLALGFVGVVPAIEKFLTYEESGGTREQGIPFTFIQLLLWSAALTYFGIFFAVPLRKQVIVREKLPFPSGNATATLIAVLNGTEIIQEVSKKEVLQMRRRRLEQCPEVLRMDPDSDDSTENALSPLINAEAQRQYNSTSPSDIQPNNVYLKNITILVQTFTISSIYTVIAYFVPVIKAIPFLGNELSKKYLWNLQPSPAYFGQGIIMGLPTVSYMLFGCILGWGILAPIAVHKGWVSNEEDVTDWNEGVQGWVLWCSLAIMITDSIVGFLVLLINSLVKFFMLDNRRVIISNMIDDSFESMILEEEAAINHQRSLSSAQSVGTVRLVSRDLEHEVDQKHLVKYTTVLSGIVVSSVICISFVIYIFGIEVIPVYSMVLALFTALFLSILAIRALGETDLNPVSGIGKISQLLFSFIIPKTHPSAVLINLVAGGIAEAGAQQAGDLMQDLKTGHLLGASPRAQFIAQLIGITWSMFLSSVMYLIYNRVYTIPSIQFRIPTATVWIDCARLVTGKELPYGTLECSLVLAVIFAILSLIRNCYRERELRWMKYIPSGVAVGIGLFNSPSFTIARFIGGLAAHMWLSNHKGNIDVKTTLIVCSSGLILGEGVCSILNIIFTTLNVPHF

SEQ ID NO: 67573 - protein, 514 aa, Prochlorococcus marinus str. MIT 9303
MDDYLQRILRARVYDVAHETPLELAKNLSRRLQNKIWLKREDLQPVFSFKLRGAYNRMSLLSKEELQRGVIASSAGNHAQGVALSASYLNCRAVIVMPITTPEMKVRAVRALGAEVALHGETYDEAYQEAMRRSEKDGLTFIHPFDDPEVIAGQGTIALEILRQIQDPPDAIYVAVGGGGLIGGIATYVKSLWPQVEIIGVEPHDAAAMTLSLEAGERIQLPKVGLFADGVAVRQVGKHTFSLAQMHVDAMVTVSTDEICAAIKDVFEDTRSILEPAGALAIAGMKADIAKRDLQDRTLVAVACGANMNFERLRFVAERAELGEEREAILAVEIPEQAGSLRKLCNVLAGKNLTEFSYRMAEGDRAQIFIGVQVLDLNDRTKLLTRLQSSGFPCLDLSNDELTKGHLRHMVGGRLPASAKTLCRDGCRELLYRFEFPERPGALMTFVSALHPEWSISIFHYRNHGADVGRIVVGVLVQDNEMKNWQRFLDDLGYPNWEETNNPAYCLFLGAQTV

SEQ ID NO: 67574 - protein, 454 aa, Bacillus clausii KSM-K16
MHTIAIGLNYKTAPVEIREKLVFSEHQLPEALKKLRSSKSMMECVILSTCNRTELYVVADQLHTGRYFAKAFLAEWFSVDMEDVTPYLVIRENDHAIEHLFRVACGLDSMVIGETQILGQVKQAFLLAQEEKVTGTVFNQLFKQAVTLGKRVHSSTEISSQAVSVSYAGVELGKKIFGTFSGKHVLILGAGKMSELTAKHLYANGAASISVMNRTKENAVELASQFAGTARSFAELNDALKEADVVISSTGARDFVVTKENAADALKKRKGRPLFAIDIAVPRDIDPEIATISDVYLYDIDDLQNIVETNKKERKKEAEKIGVMIEAEIDDFKAWLNTLGVVPLITALREKALQIQGDTMESIERKLPHLSERDIKVLNKHTKSIVNQLLRDPLTRVKELAAEPDAKHSLELFKTIFALEAQIELAEKAEADHAEQSWKEGQRPSLNQGMALRT

SEQ ID NO: 67575 - protein, 211 aa, Lactobacillus sakei subsp. sakei 23K
MTSQKKAPIIIGVTGGSGSGKTTVSQAIAQKFANHSVMLLPQDAYYKHQDGSFEERQETNYDHPDAFDTDLLIEQATMLKNHQPIEQPVYDYKIHNRTDEVVHVEPQDVIILEGILVLADARLRDLMDIKVYVDTDDDIRLLRRMSRDMESRGRSFDDIVMQYLKTVKPMFHEFIEPTKRYADLIVPEGGNNRVAIDLLVTKIQSILNMND

SEQ ID NO: 67576 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPTDKIDPTHSYVKDIDDLSKHTLDKIKHFFETYKDLEPNKWVKVKGFEN

SEQ ID NO: 67577 - protein, 227 aa, Zea mays
MLFLRCQPRVSSPSASASAPPFRPRVGVAAPLGVRVTGGRRGQAVVAMASADARLAGIASSIRVIPDFPKPGIMFQDITTLLLDPKAFRDTIDVFVERYKDQGITVVAGVEARGFIFGPPIALAISAKFVPLRKPKKLPGEVISEEYSLEYGTDKIEMHVGAVQANDRALVVDDLIATGGTLCAAVKLIERVGAKVVECACVIELAELKGRDKLGDRPVFVLVEADA

SEQ ID NO: 67578 - protein, 197 aa, Bacillus clausii KSM-K16
MKVTKAELAHVAVKAEQYPKNQLPELALAGRSNVGKSSFINKMLNRKGLARTSGQPGKTQTLNFYEINERLYFVDVPGYGYAKVSKTERAAWGKMIETYLSEREELKAVLQLVDIRHRPSEDDQLMYNWMKHYGIPVILVATKADKIPKGKWQKQLTAIAKTLDKEASDPLLFFSSATGLGKDEAWRTILNHLKVTE

SEQ ID NO: 67579 - protein, 466 aa, Escherichia coli O157:H7 EDL933
  misc_feature (345)..(345): Xaa can be any naturally occurring amino acid
MGQSSQPHELGGGLKSRHVTMLSIAGVIGASLFVGSSVAIAEAGPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYADVSGISRLWDSGGFMPNGFGAVLSAMLITMFSFMGAEIVTIAAAESDTPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAXFLTVVVNYYAPAKVFKFLIDSSGAIALLVYLVIAVSQLRMRKILRAEGSEIRLRMWLYPWLTWLVIGFITFVLVVMLFRPAQQLEVISTGLLAIGIICTVPIMARWKKLVLWQKTPVHNTR

SEQ ID NO: 67580 - protein, 605 aa, Prochlorococcus marinus str. MIT 9303
MVVSAMFQVPLMAQIDLTRRTKIVATIGPATETAERIRELVQVGATTFRLNFSHGDHDEHAKRISTIRQVSDELGMHIGILQDLQGPKIRLGRFDKGPITLANGDPFALTSKQVQCNQSVATVTYEKLADEVTTGSRILLDDGRVEMKVVKIDQSEQTLHCIVTVGGVLSNNKGVNFPDVQLSVRALTEKDRQDLAFGLQQGVDWVALSFVRNPSDMKEIRKLIGDHGHSTPVIAKIEKFEAIDQIDSILPLCDGVMVARGDLGVEMPAEEVPLLQKDLIRKANSLGIPIITATQMLDSMASSPRPTRAEVSDVANAILDGTDAVMLSNETAVGDYPVEAVQTMATIARRIERDYPQRPIETYLASTISNAISSAVSSIASHLNAAAIVPLTESGATAHNVSKFRPAAPILAVTNEVAVARKLQLAWGVTPLLVPTQKSTTATFSAAIAVAQELGLLKEGDLTIQTAGTLAGVSGSTDLVKVGIVSAVLGQGIGIGNGTVSGKVRFAFSPNDSTKIEPGEILVIHETSDDYLDAIRKSAGVITEQEGEESHAAVISKRLGIPFIIGIAHATRNLLEGEVVTMQLSNGKVHRGTGGKLPMKLDSML

SEQ ID NO: 67581 - protein, 535 aa, Streptomyces antibioticus
MAPIQRAGEAGPAGAPEQADGLRGRTAELHGIRARALAGPGEKATAAQHAKGKLTARERIELLLDAGSFQEVEQLRRHRAAGFGLEAKKPYTDGVITGWGTVHGRTVFVYAHDFRIFGGALGEAHAQKIHKLMDMAIAAGAPLVSLNDGAGARIQEGVSALAGYGGIFQRNTKASGVIPQISVMLGPCAGGAAYSPALTDFVFMVRETSQMFITGPDVVKAVTGEEITQNGLGGADVHAETSGVCHFAYDDEETCIAEVRYLLSLLPQNNRENPPRVESADPADRRSDVLLDLVPADGNRPYDMAKVIEEIVDDGDYLEVHERWARNIICALARLDGRVVGIIANQPQTLAGVLDIEASEKAARFVQMCDAFNIALITLLDVPGFLPGVGQEHGGIIRHGAKLLYAYCNATVPRISLIVRKAYGGAYIVMDSQSIGADLTYAWPTNEIAVMGAVGAANVVFRRQIAAAPDPDAMRARLVKEYRAELMHPYYAVERGLVDDVIDPAETREVLVRALAMLRLKHADLPSRKHGNPPQ

SEQ ID NO: 67582 - protein, 531 aa, Xanthomonas axonopodis pv. citri str. 306
MSEHSLRRDVGPFALMLTGLGSIIGSGWLFGAWRAAGLAGPGAIWAWVLGAAIITTIALSYAELGAMFPESGGMVRYSHYSHGSLVGFIAGWANWIAIVSVIPVEAEASVQYMASWPWAWAQGLYVQAPGGAGELSVPGLLISAVLVLVYFFLNFWSVKLFARSNTLITMFKLVVPAATGVALIASGFHSENFSVGIHGDAHVLDLAAVLTAVATAGIVFSFNGFQSPVNLAGEARNPGRSIPFAVLGSIALATVVYVILQVAYIGAVPPDLLAKAGWHGIDFRSPFAELAIIVNLHWLAMLLYIDAFVSPSGTGITYTATTARMVYGMEKNGTMPAALGKLHPVWGVPRMAMFFNLAVSFVFLFFFRGWGTLAAVISVATIISYLTGPISAMALRRHAPELHRPLRIAALPVLAGVAFVMATELLYWARWPLTGEIILLMVVALPVYCYYQAKQGWPDLRRNLKGAAWMICYLPTIALVSWAGSTDFGGHGYLSYGTDLAVVAAVGAVFYIWGVRSGWRTPSVEKAVAQA

SEQ ID NO: 67583 - protein, 197 aa, Prochlorococcus marinus str. MIT 9303
MIPIVIEESGRGERAFDIYSRLLRERIIFLGEPVTSDSANRIVAQMLFLEAEDPEKDIYLYINSPGGSVYDGLGIFDTMQHVKPDVQTVCVGLAASMGAFLLCAGAMGKRSSLQHSRIMIHQPLGGARGQASDIRIQADEILFLKDRLNRVLADRTGQPLERIQEDTDRDFFMSPTEAVGYGLVDSVIDKRPVHSVN

SEQ ID NO: 67584 - protein, 312 aa, Cryptococcus neoformans var. neoformans B-3501A
MLRRQTRERREYIFKKSQESQERAIYERKQKIKDLLAQGKPLPTELRNEVRELGGKDLVLDEAQQGHCEDLRLSRGIILIDGADNDGLADPRSHIDDEYAKVGTYDPKIVITTSRSPSSRLLQFSKELRLVFPNSYRLNRGNTVVKDLVSACNAQGVTDLVVVHEHRGVPDALIVSHLPHGPTLSMTLHNVTLRHDVSSNSSTVSEQYPHLIFDGFSTKLGERVTGILKALFPVPKDDAKRVMTFKNENDFISFRHHVFANTGHKDVQLAEVGPRFEAKPFEIRQGTVDQTEADVEWLLRPYLRTAKKRNQF

SEQ ID NO: 67585 - protein, 132 aa, Helicobacter pylori
SNIKYELDKESGALMVDRVLYGAQNYPANYGFVPNTLGSDGDPVDALVLSDVAFQAGSVVKARLVGVLNMEDESGVDEKLLALPIDKIDPTHSYVKDINDLSKHTLDKIKHFFETYKDLEPNKWVKVKGFEN

SEQ ID NO: 67586 - protein, 406 aa, Candidatus Protochlamydia amoebophila UWE25
MSFEIRDPMPFFNNISLLPPDPILNLSIDFSLDQNPQKINLSAGTYKTADGHSLVFTSVRKAEIDLLQKHLNKDYQPIEGNSVFLKNSLELLFGSDHALFTNKKFFAVQTVGGTSALRLGGEFLNKLTCQKIFISQPSWPNHKQVFEKTGLKIDSYPYFDFNAYKLNFSGMCQAIRQMPTGSVILLHGCCHNPSGVDPTFEQWKELSQLIKKHELIPFFDIAYQGFGKDLELDAQPIRYFASEGHEMLIAYSFSKNFGLYGERVGFLTVVTSQQKQIPSIASQLKVLIRANYSNPPLQGARIVSTILSSPELTEEWKIELKNMRDRVVEMRKTFIASLLVKGEDKNLNYLQQQIGLFGFCGLNYSQVNRLRKEFAIYIPSDGRINIAGLNTQNIEYVVNAISSVME

SEQ ID NO: 67587 - protein, 451 aa, Aspergillus nidulans FGSC A4
MTSHTFIERQETMLGPSASTLSRRARSSLKCTSNALWDVLNDIWHPQSNPHGYVTLGVADNTLMQQQLLFRANSSFEMSGQHLALNDTITGSPRLKAAIADILSRYLHPSKLLRPSHILATNGVASAIEHCSWALCDPGDGILVGRPYFRGFSRDICLRPAARLVQVSFEGVDPLGISAVSIYEEALINSSKQGCAIRAIMICNPHNPLGRCYSQSFLIEIMKLCQRFGVHLISDEIYALSVWREGQDGAVSMNKFTSVLSIDHDGLIDPSLVHVLWGVSKDFGANGMRLGAVISQGNSDMLESIRGVAQYSSVSGLADCFTTNILEDERFVNQFIAENNKALAATYEYVVAFMDRHGIPYARGSNAGFFVWCDLLTPYLKLQPASSFDGSEKAKAIKNRELLDKLSRFKVHLGVGDDFGSEQKGWFRITFSQSQEQLDEGLARIIDALRY

SEQ ID NO: 67588 - protein, 404 aa, Arabidopsis thaliana
MWCLPSVRPNVSEMFFKSPMLKPTARFSSTSSPYLPPSFSVAPMMDWTDNHYRTLARLITKHAWLYTEMIAAETLVHQQTNLDRFLAFSPQQHPIVLQLGGSNVENLAKAAKLSDAYGYDEINLNCGCPSPKVAGHGCFGVSLMLKPKLVGEAMSAIAANTNVPVTVKCRIGVDNHDSYDELCDFIYKVSTLSPTRHFIVHSRKALLGGISPADNRRIPPLKYEYYYALVRDFPDLRFTINGGITSVSKVNAALKEGAHGVMVGRAAYNNPWQTLGHVDTAVYGVPSSGLTRRQVLEQYQVYGDSVLGTHGNGRPNVRDLVKPLLNLFHSENANSLWKRRADAAFKECRSVGSLLEESLRAIPDCVLDSPISGSPESGDEDVFADVHNVLPPPYEAGEEIILCA

SEQ ID NO: 67589 - protein, 317 aa, Triticum aestivum
  misc_feature (187)..(187): Xaa can be any naturally occurring amino acid
  misc_feature (204)..(204): Xaa can be any naturally occurring amino acid
  misc_feature (240)..(240): Xaa can be any naturally occurring amino acid
  misc_feature (250)..(250): Xaa can be any naturally occurring amino acid
  misc_feature (270)..(270): Xaa can be any naturally occurring amino acid
  misc_feature (276)..(276): Xaa can be any naturally occurring amino acid
  misc_feature (283)..(283): Xaa can be any naturally occurring amino acid
  misc_feature (304)..(304): Xaa can be any naturally occurring amino acid
MFVPVRNSRDIVDPRPAMALYRRAASAIRRRGAGALPLPLLPARAMAMASSLFGHVEPAPKDPILGVTEAFLADPSPDKVNVGVGAYRDDDGKPVVLDCVREAERRIAGNLNMEYLPMGGSIHMIEESLKLAYGEDSEFIKDKRIAAVQALSGTGACRLFADFQKRFLPDSQIYIPTPTWSNHHNIXWRDAQVPQRTFSYYHPXESRGLDFAGLMDDIKNAPNGSFFLLHACAHNPTGSXPTEGPWPEEXSYQFQLENHFPFFDMAYQGXANGDPXRDAKATXLSLEDGHKIGMCSVISKNMGXYGQRAGCLSISAR

SEQ ID NO: 67590 - protein, 185 aa, Geobacillus thermoleovorans
PGRAVAVIGAGGVGFNIIQGAALAGAKQIIAVDIVEEKLAMTKTFGATHTVNAREDDAVSAVLDLTDGIGVDYAFEAIDRPETMADAYNMTRKAGTTVIVGIAAPHEAVEINAFSLPSQSKALTGSWLGQGNPPIDYPKLLDLYAAGKLKLEPLISAVYSLDQINDGFAALKSGQNIRGIIRFEE

SEQ ID NO: 67591 - protein, 497 aa, Geobacillus thermoleovorans
MTMISAQTTEADLWIDGEWRPAASGERFDVIDPATGEVTARVANAGEDDVDAAVAIAEEAFSVRRWLAISPLERGRILRRIAELIRQHHCELAQLMTRENGMPINLALFIEIPLADCFDFFASLVVKPQGEVLPFSVAGSAPDYMAWTMKEPIGVAGLITPWNFPLLMPTWKIAPALAAGCTMVVKPAPETPLTALKLAEICHEAGVPEGVINVLPGLDEAGKALVRHPRVPKIAFTGETETGRHILQAAAPHIKRVTLELGGKSPNIIFADADLEQAAKSALFGVFYNSGQVCQAGSRILVERTVYEPFVERLAERAKKLKVGPGTNPRSDLGPVISREQYEKVLRYIEIGKQEGARLAAGGRALDGGGGGYFIEPTVFADVSPSMRIACEEIFGPVAAVIPFADEEEAVRIANGTMYGLAAAVWTNDIKRALRLARRVKSGTVWLNTYQVLSPTVPFGGYKQSGLGRELGMQALDAYLETKTVICDLNDRPMTLF

SEQ ID NO: 67592 - protein, 581 aa, Pseudomonas putida KT2440
MAAEGNAGLLLGVITLLSAAVVAVPLLKRIGFGSVLGYLLAGMMIGPFGLQLVNDPHTIIDVGELGVVMFLFVIGLELNPSHLWALRAQIFGLGSLQVLICAVLLTVVGKAFGFPWQVSFVCAAGFVLTSTAIVMQVLSERGDLTEPRGQRIVSILLFEDLLIVPLLAVVAFLAPTAAVPEPTSPLWQRMAIAAVSLSALVIIGLWLLNPLFRVLAQARAREVMTAAALLVVLGAALLMEIGGLSMAMGAFVAGVLLSESTFRHQLEVDIEPFRGLLLGLFFLGVGMALDLQVVARNWLLISSGVLALMVVKALCIYGVARLAKSQHGDALDRAVLMAQGGEFAFVLFTEALKLKVVSAEINANMTAIVVLSMALTPVNLLLLKRFARPRAVSMDGVEPAQNLQGHVLIIGFGRVGQIACQAPLAHGAKLSIIDMDPEVIRAVEPYGFKVYYGDGARHDLLHAAGARHARTIIVCVNDKKAATRIVESTRQYCPQVKVLVRAFDREHALELVKHDADYIVRETFESSLLLGRQAVLTLGASSVEADAVTDEVRTRCRTFCPGNIRRSICRASVGSGKYRAH

SEQ ID NO: 67593 - protein, 267 aa, Aspergillus oryzae
MASILPRAGFRAFTALPRAVALPRVSLASKLPRAQPLAQPIARRFVSNIPQEQPRLRLGSTAPNFKAQTTRGEIDFHEFIGDSWAILFSHPADFTPVCTTELGAFARLKGEFDQRGVKMIGLSADKLDSHGEWVKDINEVGNTNVQFPIIADPDRKVAFLYDMIDQRDLDNIAEKGIPFTIRAVFIIDPAKKIRLTMLYPASTGRNSAEVLRVIDALQTADKKGIATPIDWTVGEDVIVPPSVSTEDAKKKFGEVRELKPYLRYTKA

SEQ ID NO: 67594 - protein, 255 aa, Haemophilus somnus 2336
MTERIDNYEQRFGGIGRLYGIDVLERLKQTHICVIGIGGVGSWVVEAIARCGIGQITMIDMDDICVTNINRQLPALTGNIGKLKTEVMKERVQLINPDCHVNIIDDFLSVENLAEYIHTGYDYVIDAIDNVRVKAALIAHCKRNKIPIITIGGAGGQTDPSQIRVADLSRSIQDPLLAKVRSVLRKEYHFPQNPKRKFVVDCVFSTQPLIFPKMADNCTTSATMNCANGFGAATMITATFGFFAVAKIINKLAKG

SEQ ID NO: 67595 - protein, 88 aa, Brassica napus
MDSYSSSSPPMGASPSPEALMEQIQAQLAEAYAKELIETMREKCFDKCITKPGSSLSSGESSCVSRCVDRYLEATGIISRSLFSQQRH

SEQ ID NO: 67596 - protein, 323 aa, Candida glabrata CBS 138
MRELTEEQRENIAIEQKLAVQSIRSFLQSKTSYDVLPVSYRLVVLDTALLVKKSLNVLLQNSIVSAPLWDSKTSRFAGLLTTTDFINVIQYYFSNPDKFDIVDKLQLDGLKEVEKAIGVDQLDTAYVHPSRPLYDACLKMLESRSGRIPLIDEDEETHREIVVSVLTQYRILKFVSLNCRETHLLQRPIGELGIISEQNMKFCHMSTPVIDVIQLLTQAGVSSVPITDENGVLINVYEAYDVLGLIKGGIYNDLSLSVGEALMRRSDDFEGVYTCTKNDKLSSIMDNIRKSRIHRFFVVDENGRLTGVLTLSDILRYILLGNN

SEQ ID NO: 67597 - protein, 515 aa, Arabidopsis thaliana
MVRTRGDSRRPTRAPANTRAVARTRSEARRAAPSAPATTPIVGRTRRDARRTAPTIISDDSDSSSDDAVPDPKAARSPVAVPSKQAAEAPPPPSHAPDDSPAPVSDLPPKTSTAPPINDPAPDLLRNAFSSRGRLPYDPSDRCSIHRHHQAERDAADPSIWTPPYEPLTIQFLTSQGVERYKDFKLRDPYEQRYVPRGPPEMRDMMKVIEDNHLLDTVAEIDPFVKEVIWEFYANFHIFNEETKKSKVFVRGKMYEFSPQMINKTFRSPAIKWHAKAEFERVTMSKHALAKYLSDGKVVTWKDLRTPVMPTHLAGLYLICCINWIPSKNNSNVTVDRAKMLYLLNERIPFNFGKLVYDQVEKAARSPGQIQNILPFPNLIYRVLMFQRVITLENYEKPGPHPKLFNPDVRGGIEHPKRRGEYLFGTSLPGDLRHVSTLLTTIATRIEGGDYGLVSSSSHSSQGVNADVEAQGLEPEADDDYVPPVDEGWSPENSDSFVNSLDVDNEEGYEDTQSS

SEQ ID NO: 67598 - protein, 367 aa, Desulfitobacterium hafniense DCB-2
MAFLVLQDGTAFEGERFGAWPEDKEQKVQAGEVVFNTSMSGYQEMITDLSYTGQILVLTHPQIGNYGWHDEENEADKILLRGLVVRELSQGEGSAHGDRSLEEFCRLHNIWGLKGIDTRALTRHIRNQGTLPGVFAQTLEQGKKYWQEYADISSAAEKEPHWVYQATVKESYEIPGSGPYVAVLDCGAKRNILRALQQRGLRIRVFPAWSSAEEILASSPKGVFISNGPGDPSGLPELIETVRTLLPQLPIMGICLGHQILALAAGGKTYKLPFGHRGGNHPVQDLRTGQTTMTAQNHGYAVAEESMAGTGFQIILRNLNDGTVEGMEHTQYPVYSVQYHPEGAPGPEENGMLFEGFFAAIGAGAAG

SEQ ID NO: 67599 - protein, 447 aa, Aspergillus oryzae
MTIDEFISSSHILHRSFSERPSKIFAGDGIRLMLKNGKTVIDASCGPSVSCLGHSQPEIFNAINAYLRNDIAYAYSGSPYTNDATEQLADMLLAHKPGGLSKAMFVNSGSEATDAALKLAPRRTNFIARKQSYHGNTIGALCVSGHESRREFYQDFMSPNVSFVDPCYAYRMKDQDESDEAFVQRLSRQFEDEILRVGPDRVAGFIAETVSGATLGCLPAVHGYFKAIRGICDRYDVLLILDEIICGMGKTGTMHAWEQEGIRGPDIQTIGKALGAGFVPLSGVLLHEKIFQALSSGSGGLAHGHTFQAHPLAYAAAIAAQKIIKRDNLIERCAYIGQKLETLLRKEIGPLPLVGNIRGRGLFWAVEFVLNKKAKTLFPGQVKFCSQVVKKSLDMALNILGNLGHTGKYQVDHILVCPLYTVMGSELGNIIPLLKIAIIETSRPFLT

SEQ ID NO: 67600 - protein, 374 aa, Methanosarcina acetivorans C2A
MFKFADELGPFKIIHVYEPSVGLKAVLVVDNVARGPAIGGVRIAPDVSTEECFRLARAMTLKNAAADLSYGGGKVVIYGDPKMPLEKKSQILRALASALRYTEEYIFAPDMGTDEVCMACIKDEIGRVVGLPCEVGGIPLDEVGATGWGLFHATEVALQYCDFELKGARVAVQGFGAVGKHAARFLTRKGAVLVGAADSQGTIHDLEGLDVDTLIRLKREGKSVLDYPGGEKLGCDEILSVPCDIWIPAARPDVINEGNVHLLKAKLVVEGANIPVTEGAEKILYEKGILYVPDFIANAGGVICAASEYQGATRCTAFGSIEEKVRGNTEQVLEAAKTKGILPREAAVELAVKRIKRAMRYRRWSIFSSAPGFV

SEQ ID NO: 67601 - protein, 297 aa, Salmonella typhimurium
MMNLKAVIPVAGLGMHMLPATKAIPKEMLPIVDKPMIQYIVDEIVAAGIKEIVLVTHHSKNAVENHFDTSYELESLLEQRVKRQLLAEVQSICPPGVTIMNVRQAQPLGLGHSILCARPVVGDNPFIVVLPDIIIDDATADPLRYNLAAMVARFNETGRSQVLAKRMKGDLSEYSVIQTKEPLDNEGKVSRIVEFIEKPDQPQTLDSDLMAVGRYVLSADIWAELERTEPGAWGRIQLTDAIAELAKKQSVDAMLMTGDSYDCGKKMGYMQAFVKYGLRNLKEGAKFRKSIEQLLHE

SEQ ID NO: 67602 - protein, 582 aa, Moorella thermoacetica ATCC 39073
MRHTKIVCTMGPASERVEVIKAMIRAGMNVARFNFSHGSHAEHGARMAAVRQAAAELGARVALMLDNKGPEIRLGEIQGEVTLKDGDQVTLTTEPIIGDARRLPVSFAGLPGDVRPGQIILLDDGLVELEVLATTATEIHCRVRHGDVISSHKGVNVPGAEISLPPFTEQDIKDLEFGLQQGIDFIALSFVRTAGDVLAVRRELEKRNARVAIIAKIENHAGVNNIHEILEVADGVMVARGDLGVEIPVEEVPLVQKKIIEACNLAGKPVITATQMLESMIHNPRPTRAEASDVANAIFDGTDAIMLSGETATGRYPVEAVATMARIARRAERGLPYGDLLTKKGLAAERTATDAISHASCTIAYELDAAAIITPTASGSTARRVAKYRPRAPILATSPNEKVLNQLCLVWGVEPLLVEPTSGTDEMVNAAVAAAILSGRVKQGDLVVITAGVPAGVPGTTNLLKVHIVGEVLVRGRGIGKEVTSGPVRLVKTAADAVARVKKGDILVTTETGPEFLPAMERAAAVITETGGLSSHAAVTGLSLGIPVVVGAKGATEKLTDDLVVTIDVVRGLVYRGQTRVL

SEQ ID NO: 67603 - protein, 269 aa, Vibrio vulnificus CMCP6
MRELDTPASDSYNQRFGGTRRLYGNSEVEILRAAHVCVIGIGGVGSWAVEALARTGIGELTLIDMDDVCVTNINRQIHAMTGTVGQSKIEVMAERVKLINPECKVNLIDDFITPDNQHEYLSKEFDYVLDAIDSVKAKASLLAYCRSNKIKVITVGGAGGQVDPTQIQVTDLTKTIQDPLAKKIKDTLRRHHNFPKNPARKFGIDCVFSTEQLKYPQADGSVCNVKSTAEGPKRMDCASGFGAATVVTATFGFVAVARIVEKLIQKHKN

SEQ ID NO: 67604 - protein, 473 aa, Lactobacillus sakei subsp. sakei 23K
MSQPQIGVIGMAVMGKNLALNIESRGYTVAIYNRTGAKTEAVIQDHSEKKLVASYTIEDFVKSLEKPRRIILMVKAGAGTDAVINELLPLLDKGDILIDGGNTFFGDTIRRNAELDKSGINFIGMGVSGGELGALEGPSMMPGGQKEAYDLVAPILEQMSAKAEDGQPCVTYIGPNGAGHYVKMVHNGIEYGDMELISESYNLLRNVVGLSVEEIADVFKEWNHGELDSYLMEITADILTRKDDLGTDKPIVDVILDAAGNKGTGKWSSQSALELGVPQSLITESVYARYISAMKDERVAASKILPAPTVAKLTEDKKELIEKIRQALYFSKIMSYAQGFEQMRVASDQYDWSLNYGEIAKIWRAGCIIRARFLQKITDAFDKKADLNNLLLDDYFLDITKKYQGAVRDIAALAIQQGVPAPGLTAAITYFDSYRSEVLPANLIQAQRDYFGAHTYERTDREGIFHYTWYKEQ

SEQ ID NO: 67605 - protein, 322 aa, Vicia faba var. minor
  misc_feature (259)..(259): Xaa can be any naturally occurring amino acid
MEGLATGSNERNELVRVRHGSDSGSKPVTNLNGQFCQICGDTIGLTAAGGVFVACHECAFPLCHPCYEYEIKNVSQLCPQCKTRYKTHKDGPQVKGDDDEDDVDGLRNEVKYGPGNNSKTGWQWDEDADLSSSSGHDSQLQNPHLTNGQLMSGEIACATSDTQSAQTTSGPLGQSGNVHSRPYADPKQPGLESDEEMRRVPDMGGESAGTSASHKGTGSTAGPERAQGTGEGQKKRGRSPADKESKRLKRLLRNRVSAXQARERKKAYLSDLETRVNDLEKKNSELKEKLSTLQNENQMLRQILKNTTASRRGGNSGTNNAE

SEQ ID NO: 67606 - protein, 3955 aa, Streptomyces antibioticus
MSPATPESQRPMTNEDKLRDYLKRVTAELHQTRQRLLEAESGSSEPLALVAMGCRYPGSVRSPEDLWRLAADGTDAISGFPTERGWDLDALYDPDPDKPGKIYVREGGFLHDAHHFDAEFFGISPREALAADPQQRLLLETAWETFERAGLDPESLRGSRTGVFTGIMYGEYGSRVMHQVPAGFEGYLVTGSSQSVASGRIAYTFGFEGPAVSVDTACSSSLVALHLAARALRDGECDLALAGGVTVMATAAGLLEFSRQRGLAHDARVKSFAASADGTVLAEGVGLLLVERLSDARRHGHPVLALLRGSAVNQDGASSQLSAPNGPSQQRVIRAALADARLTADQVDAVEAHGTGTSLGDPIEAQALLATYGQGRNPERPLWLGSLKSNIGHTQAAAGVAGIIKMVQAMRHGVLPRTLHLDEPTPHVDWSSGAVSLLTEARPWPETGRPRRAAVSSFGISGTNAHVILEQAPVEETKTSVSHGGPLTWVLSAKTEGALREQAARIRDLASGELSLADVGFSLATTRAHLEQRAAVIAEDRGGFLAGLEALVSGGEHPQLVRGSAAKASRTAFLFAGQGSQRPGMGRELYDSQPVFAQALDDVCALLDPHLDVPLRQVMFADEDSQEAGLLQDTLYTQPALFALETALFRLLEHLGVKPHHLVGHSIGEIAAAHAAGVLTLADACTLVAARARLLHDLPAGGAMTALQATEAEVLTALEGNDRVAIAALNAPNSTVISGDADAVAHIAATFAEQGRKVTPLHVSHAFHSPHLDPVLDDFRAVAETLSYDQPQIPIVSTLTGESAGPDDLTTGDYWTRQLREAVRFHPAITTLDATTLIELGPDTTLTALTRSMTDAVAVPLLHPHKPETHTLLTALTTAHTHGTPIDWTTIFTPHHPTAITLPTYPFQHHPYWLPHTAAHNVTAAGLSATAHPLLGAMTELPGNAHLFTGRISLDSHPWLADHAIEGTAVVPGTALVDLALHAAHHTGHNHIEELAVHAPLVLPERDRVRIRVTVDAAGDGRHELTIDSHPEGDLPAADAEWTRHAVATVTTVGRTGAAEAAFQSADWPPAQATPLDITDLYEGLAHRGYAYGEVFQGLRAAWRAGDSIYAEVALPRGVEATGYGVHPALLDAALHANTFAEQADDELRLPFVWSGVTLHATGATALRVRLTAPAPDTLSLSVSDPHGLPVATVESLTTRPIGDTLRASLYPGHRNSLFQVAWTTVPEPVVPTVGTAAWTLIGEATDTLITTEDDGSSTHSDLSSLVTALSNGTTAPSVLALASLPQQGGDPVTCAHRATEEILAVVQEFLRTDALASARLLIITRGAVAVGEGDCVHDLGMSAVWGLVRTAQSENPDRILLLDVDRSEVPVDLLDRAVAAGEPQLALRNGTLHAPRLTHADIPADATNPLDPDGTVLITGGTGTLGALTARHLITQHGARHLLLASRQGPEADGATELLQELDELGAHVTITACDTADPAQLADLLAAIPTEHPLTAVIHTAGITHDATLTTLTPEQLHTVLKPKVDAAWHLHHQTQHLHLTAFILYSSAAGILGNPGQANYAAANTFLDTLAHHRHTQGLPATSLAWGLWTQTSTITATLDPNHHTRLNRNGIQPLPTHQALTHLDTALTTPHPHYVPALLDLPALRAQGDQLPSLYRHLVPSYTNLATASSSWADRLAALSGEEQAQALLELVSTHTATVLGHAQGHTVDPHAAFQSLGVDSLTAIELRNRLTTATGLRLPATLVFDHPTPDHLARYIATRLPKASDHERIGTSRPTARQATEQDPIVIVGMACRYPGGVASPEQLWQLVAEGTDAITSFPTTRGWDLDALYDPDPDHPGTSYTRHGGFLHEAHHFDPDFFGMSPREALATDPQQRLLLETAWETFERSGLDPHSLRGSRTGVFTGIMYGDYGSRFQSHIPQGFEGYLGIGASASVASGRIAYILGLEGPAVTIDTACSSSLVALHLAAQALRNGECDLALAGGVTVMATPSTFIEFSRQRGLAPDGRCKPFAATADGTGWSEGVGLLLVERLSDARRNGHHVLAVLRGSAVNQDGASNGLTAPNGPSQQRVIHAALANAQLDPHEIDAVEAHGTGTTLGDPIEAQALLATYGQNRDPHQPLWLGSIKSNIGHTQAAAGVAGIIKMIQAMQHGTLPQTLHADQPSPHIDWTTGAVTLLTQQQPWPDTGHPRRAAISSFGISGTNAHIILEQPPELTAEDIKVTAEAPSGPLVWPLSAKTGEALREQAAQVRDLVSEDRTLVLADIGFSLATTRAHLEQRAAVVAEDRASFLDALEALTNGVEHPHLVRGSAGGASKVAFLFAGQGSQRPGMGRELYDSQPVFAQALDDVCALLDPHLDVPLREVMWAEEGTEQAALLEDTLYTQPALFALETALFRLLEHLGVKPHHLVGHSIGEIAAAHAAGVLTLADACTLVAARARLLHDLPAGGAMTALQATEAEVEEALHGHPGVTIAALNTPHSTVISGDSDGVNTIAARFKEQGRKVTPLHVSHAFHSPHLDPILDEFHAIARSLTYHQPSIPIVSTVTGEIAGPDDLTTPDYWTRQLRDPVRFHPALTTLNELNTTTHLELGPDTTLTTLTHATTDTTAIPLLHPHKPETHTLLTALATAHTHGTPLDWTTLYTPHHPSRIPLPTYPFQRHPYWLHHTPTPTDATDLGQTPTPHPLLAAMTELPDKAGYLFTGSLSLAAHPWLADHEVHGVTVVPGTALLDLALHAGRHTDAPRVEELTLHTPLTLSADDHARHLHVAVGAPEDTGARSLTIHSRPRPAMDDPSGDAERPWILHATGTLTADDSAAPAAAEGTGRPPATASPLAVDEVHAHLAGLGLSYGPAFQGLTAAWRHGDDLYAEVRLPDDLDTTGYGVHPALLDAALHVSAFIGSGEGDSARLPFSWSGISLHSTRARAVRVRLAVTGPQSVALAVTDGDGAPVITVAELTTRPVAAEQVVRDAGGQDSLLHVTWQPVVRADDDTLPKALTFLGDGLDLPVTEVAVDSYPDIDALVEAIDAEAPVPDTVVVLCADPDPSDAPSAAARRATHAALGLLQRFLTDDRLGGTRLALVTRRAVAAGDDEDVLDLGHAAVWGLVRTAQTENPDRFLLIDTDHAPGTTGTAPGTANSPHPLLLAVASTEPQTAIRDGHLLAPRLLRASAATDDDAGPTPHFSGSFTDRSWRLATAGTGTLDRFVHEHCLEAAQQLRPGQVRVSLRAAGLNFRDVLISLGMLPGHDAVIGGEGAGVVIEVGPGVSGLAPGDRVMGLFTTGLGPVAVADQRLVCRIPAGLDLVAAASLPVTFLTAYYGLFRLAGLRAGQRLLVHAATGGVGMAAVQLARHVGAEVFATASPPKQHVLRADGFAEDHIATSRTLDFERAFLDATDGQGVDVVLNSLAHEFVDASLRTLPKGGHFLEMGKTDLRDAGAVAAEHPGVTYQAYDLFGMVGTDPDLIREMFAELVPLFESGVLTPAPIRTWDIRRAGEAFRHLSQARHIGKLVLTVPAPLEPGGTVLITGGTGTLGALTARHLITRHGVRHLLLTSRRGPASESATELVRDLTALGADVEIVACDAADRRALGELLDSIPADRPLTGVVHTAGVLDDGIVPSLTAEHLDRVLRPKADAAWNLHELTRYKDLALFTLFSSAAGVLGNAGQGNYAAANTFLDALAQHRRARGLPAQSLAWGLWAQTSELTGGLDGADRARMARGGVLPLATEEGLALFDAACRSERAVLVPARLNLPALRRQASGSAPVAPMLDALVGPRPAPAAAGSGPLAAQLQQQLAGRSAAERGRLLLDAVRGFTASVLGHSGPAAVEEAKAFKDIGFDSMSAVELRNHLRTATGLRLPATVVFDHPTPAALAAYLGERLAPEEDTMQAPALTELARLQSAVLTDGLDAATRAKLVTRLREFLFRLDESGSPAEPASLDISDRMDTASDEEIFDFIENEL

SEQ ID NO: 67607 - protein, 538 aa, Oryza sativa Indica Group
MTERDRLGLRGLLPPNVVSSQQQIDRFMLDMQRLQKYARDGPSDTYPLAKWRILNRLHDRNETMYYKAEVLIDNIEEHAPIVYTPTVGLVCQNYSGLFRRPRGMYFSAEDRGEMMSMVYNWPADQVDMIVVTDGSRILGLGDLGVHGIGIAIGKLDLYVAAAGINPQRVLPVMIDVGTNNEKLLKDPLYLGLQEHRLEGEEYVAIIDEFMEAVFARWPNVIVQFEDFQSKWAFRLLQRYRKTYRMFNDDVQINALSLALTSAGIGVVNAASRTMARMLGNNEVAFESARSQFWIVDAHGLITEERTNIDPDARPFARRKSELGHQGLSEGASLVEVVKKVKPDVILGLSAVGGLFSKEVLEALKDSSSSRPAIFAMSNPTKNAECTPEEAFSILGEKIIFASGSPFSDVDLGNGKIGHSNQGNNMYLFPGIGLGTLLSGARVISDGMLQAAAERLASYMKEEEVLEGIVYPPISRIRDITKEVAAAVVKEAVAEDLAEGYRDMDARELARLSEVEETVEYVQQNMWSPVYPTIVYKKD

SEQ ID NO: 67608 - protein, 445 aa, Nostoc punctiforme PCC 73102
MVQLPPDILAQGVIAASAGNHAQGVALAANRLGTKAIIVMPITTPQVKVDAVRMRGGAVVLHGNTYDDAYSYARELEVEKGLTFIHPFDDPHVIAGQGTIGMEILRQYQQPIHAIFVAIGGGGLISGIGAYVKRLRPEIKIIGVEPVDADAMSQSLKAGHRVRLSQVGLFADGVAVREVGEETFRLCQQYVDEIILVDTDDTCAAIKDVFEDTRSILEPAGALAIAAAKAYAEREQIEGQTLIAVACGANMNFDRLRFVAERAQLGERREAIFAVTIPEERGSIRQFCECIGNRNLTEFNYRIADEKTAHIFVGVQIQNRADAAKMVETFEAQGFETLDLTDDELTKLHLRHMVGGHSPLAQNELLYRFEFPERPGALMKFVTSMSPAWNISLFHYRNNGADYGRIVVGIQVPPHEMEEWQAFLDNLGYRYWDENKNPAYKLFLG

SEQ ID NO: 67609 - protein, 225 aa, Lactobacillus sakei
EFGVKRIVFSSTAATYGEPKAIPIKESDPQVPTNPYGESKLMMETMMKWADKAYGIKFVALRYFNVVGAKPDGSIGEDHHPETHLLPIVLQVAAGKRDQLSIFGDDYDTPDGTNVRDYVHVLDLADAHILAFEYLKDGHDSNAFNLGSSTGFSNMEIVEAARKVTGKAIPVTMAPRRAGDPSTLIAASDKARETLGWAPKYDNMEAIIETAWNWHLNHPNGYADR

SEQ ID NO: 67610 - protein, 392 aa, Synechococcus sp. RS9917
MKAMILAAGKGTRVQPITHVIPKPMIPILQKPVMEFLLELLKEHGFKEVMVNVSHLAEEIENYFRDGQRFGVEIAYSFEGRIEDGELIGDALGSAGGLKKIQDFQPFFDDTFVVLCGDALIDLDLSEAVRRHREKGAIASLVTKRVPRDQVSSYGVVVTDEQDCIRAFQEKPKVEESLSDTINTGIYIFEPEIFAHIPSGQPFDIGSDLFPKLVELGSPFYALPMDFEWVDIGKVPDYWQAIRSVLQGEVRQVGIPGKEVRPGVYTGLNVAANWDTIKVQGPVYVGGMTKIEDGATILGPSMIGPSCHICEGAVIDNSIIFDYSRIGPGVQLVEKLVFGRYCVGKNGDHFDLQEAALDWLITDARRQDLVEPSPQQKAMAELLGTDLTTAAN

SEQ ID NO: 67611 - protein, 5718 aa, Streptomyces antibioticus
MANEDRLRGYLKRVTADLHQARQRLNDIESRNHEPIAVVGMACRFPGDTRSPQDLWNIVASGTETMSEFPTGRGWHLAELYDPDATARGKSSTNLGHFIHDADEFDAQFFGISPREALAMDPQQRLLLETAWEAVENAGLAPTALHGTDTGVFAGVAGQEYVSLLQEDAGASEGYLLTGMIASVVSGRLAYALGLEGPAVSVDTACSSSLVALHLAVRSLRNGECGMALAAGATIMATPGIFVEFSRQGGLAPDGRCKSFAASADGTAWGEGVGVLVLERLSDARRQNHRVLAVVRGSAINQDGASNGLTAPNGPSQQRVIRAALADARLTADQVDAIEAHGTGTSLGDPIEAQALLATYGQDRDPEQPLWLGSIKPNIGHTQAAAGVASIIKMIEALRRGELPRTLHADEPSPEVDWSAGAVSLLTEARPWPETGRPRRAAVSSFGISGTNAHVILEQAPLEESTEEAPVAVSPGGPVAWVLSAKTEGALREQAARIRDLASGELPLADVGFSLATTRAHLEQRAAVIAEDRADFLAGLEALACGGEHPQLVRGSAAKASRTAFLFAGQGSQRPGMGRELYDSQPVFARALDEVCALLDPHLDVPLREVMWAEEGTEQAALLEDTLYTQPALFALETALFRLLQHLGVTPQYLVGHSIGEIAAAHAAGVLTLADACTLVAARARLLHGLPTGGAMTALQATEAEVLTALEGNDRVAIAALNAPNSTVISGDTDTVAHLAALFAEQGRKVTPLHVSHAFHSPHLDPVLDDFHTVAATLTYHQPRIPIISTLTGEPAGTCDLTTPDYWTRQLREAVRFHPAITTLDATTLIELGPDTTLTALTRSMTDAVAVPLLHPHKPETHTLLTALTTAHTHGTPIDWTTIFTPHHPTAITLPTYPFQRQSYWLNKPLSNGKAGTFGLEAAEHPLLSASLELPDGEVQVFTGRLSTATHPWLAQHTVHGSAIVPGTALLDLVLHAARHVGTPCVEELMLQAPLVVPERDAVHLQVQVDTVDGGGRRRLTLHSRVASRPEAGWVRHGSATLSDAPAVVPEPSAVWPPAGAAVLDTAGLYDRLADLGLGYGPVFRGLTAAWRHGDGLCAEVRLPQDTDTTGYGIHPALLDAALHSLALAVDADTAHLPFSWAGVHLYATGAEALRVRLTPTDGHTFRLTATDPHGVPVVAIEALTTRPVSAEQVAVTSSGSRQDSLFGLVWAPVTGADSADAVGSIAFVGGADERFAADGAVRHFAADGAVGRFADLAALRDAVAAGAPVPDVVVAVLDALGTEAGSVVRRVHEATAGALSLVQEWLAEESFGSARLALATTGAVGTRHGEAPAGPDGLAFSAVWGLVRAVQSEHPDRLLLIDLDGELTSQENLLAALAAGVVGEPQLAVREGRLFAPRMVRAGAAEGALTPPSGERAWRLGVRTQGALENLELVTGPAAEAPLESGQVRIDVRAAGLNFRDVMMVLGMYPGDLAIGSEGAGVVLEVAADVTGLRPGDRVMGLFAGAMGPVAVADRAMVVRMPKRLTFSQAAAIPVAFLTAYYGLADLARVRPGQRLLVQAAAGGVGSAAVQLARHWGVEVFGTASPGKWDRLREAGLDADHVANSRTLDFERAFLDATDGQGVDVVLNSLAHEFVDASLRMLPRGGVFLEIGKTDIRTPGEIAERHPGVDYRPFDMGEAGPERIQTILTELVRLFESGALRPPAVTSYDVRHAREAFRALGQARHSGKLVLTMPGALTVPGQGPRAAAPGAVDPDGTVLITGATGALGRLVARHLVTAHGVRHLLLLSRSGPSAPGADELVAELSGLGGQVTLRACDAADRESLAAALRDVPAGHPLTAVIHAAGVLDDGAAEALTPQRLASVLRPKADAAWNLHELTASADLSAFICFSSLSGLLGAAGQANYAAANGFLDALAQHRRAQGLPAASLVWGLWEAPDGMAGGLDRADLARLERAGVPALTAEQGLALFDAHDVGSALVILARLDPAALRARADKGALPALLSRLAGRRSPRPLTPSAPAGAESPLTTWARRLAPLSAAERERTLVDLVRGEAAAVLGHSGPEAVESGRAFKEAGFDSLTAVELRNRLNTATGLRLSPTLVFDHPSPTALAAHLLTELLGSTDATPSASLTGTPALTTAGADEPVAIVGMACRFPGAVRSPADLWRLVAEGEDAIAAYPGGRGWDVDELYDADPDTAGKTYTLKGGFVRDVDTFDADFFGITPREALAMDPQQRLLLETAWEALERAGIDPGTLRGSDTGVFAGVSAAEYLSLQHEGADELAGYLLTGNTASVASGRIAYTFGFEGPTYTVDTACSSSLVALHLASRALRAGDCAMALAGGATVMATPGLLVEFSRLRGLAPDGRCKSFAASADGTGWGEGAGMFVLERLSDARRNGHRVLALLRGSAVNQDGASNGLTAPNGPSQQRVIQAALADARLTAGQVDAVEAHGTGTSLGDPIEAQALLATYGQDREPEQPLWLGSIKSNIGHTQAAAGVAGVIKMVQAMRHGVLPQTLHVDEPTPHVDWAAGAVALLDETRPWPETGRPRRAAVSSFGISGTNAHVILEQAPLEESTEEAPVAVSPGGPVAWVLSAKTEGALREQAAHIRDLASGELPLTDVGFSLATTRAHLEQRAAVIAEDRADFLAGLEALACGGEHPQLVRGSAGGASKTAFLFAGQGSQRPGMGRELYDSQPVFAQALDDVCALLDPHLDVPLREVMWAEEGTEQAALLEDTLYTQPALFALETALFRLLQHLGVTPQYLVGHSIGEIAAAHAAGVLTLADACTLVAARARLLHDLPAGGAMTALQATEAEVLTALEGNDRVAIAALNAPNSTVISGDADAVAHIAATFAEQGRKVTPLHVSHAFHSPHLDSVLDDFRAVAETLSYDRPQIPIVSTLTGEAAGPDDLTTGDYWTRQLREAVRFHPALTTLDATTLIELGPDTTLTALTRSMTDAVAVPLLHPHKPETHTLLTALTTAHTHGTPIDWTTIFAPHHPTAITLPTYPFQRQSYWVNKPTASGNARTLGLNSTEHPFLGAALELPDANGHLFTGRLSTNELPWLADHVVLGVTVVPGTALLDLALHVAQRTDAPHIDELALQSPLVLNEDHAAQLHITVGPRSDGGTRPLSIHSRPYDTTGLDGEAAPWTLHATGVLTSTPAEQPTTTLTTWPPSDATPLDTTDLYDRLNDLGLTYGPTFQGLKAAWKHDNDLYAEVRLPHDTDTTGYGIHPALLDAALHTTALTETNDGDTARVPFSWSDVTALTDGIIQDVTALRVHLSTSAANGTTLRITDDTGAPLMVVASLTSRPVSGDQLGTQAQLPCGALYEVQWTPFTEPTPTGANAVTWAVLGEASLVDAENADTPAFPGLTEFRRALDAGAPAPEVLFASLTSRDGVDDVVEEVHRLAARALGLTREFLADSAWESTRLVFVTRRAVPLPADEGHHDLGAAPLWGLIRSAQSEQPGRFGLVDVDEGPCAGDVLASLANADEAQLVRRGARWFVPRLVRAADAESDTSAAELNPNGTVLITGGTGTLGAAAARHLATQHGVRHLLLASRRGPEADGATELHDGLTELGAHVTITACDTADPAQLADLLTTIPTEHPLTAVIHTAGITHDATLTTLTPEQLHTVLKPKVDAAWHLHHQTQHLHLTAFILYSSAAGVLGNAGQANYAAANTFLDTLAHHRHTQGLPATSLAWGPWADTSAVTATLDTTNRSRIARSGMLSLPTDQALALFDAALADARPHLMPALLDTVALRAQTDQLPTLFRQLVPTRAKTRASASRWAARMATLSTDEQRRAVLDLIATHTATALGHPHTHTVDEQQSFQALGLDSLTAVELRNRLTAATGLRLPATLVFDHPTPHALAVHLHAQLTTAQGVMAQPSGAGASLTRARAHDDEPIVIVGMACRYPGGVTSPEQLWQLVAEGTDAITSFPTTRGWDLDALYDPDPDHPGTSYTRHGGFLHDAHHFDPDFFGMSPREALATDPQQRLLLETAWETFERSGLDPHSLRGSRTGVFTGIMYGDYGSRFHHDIPKGFEGYLGTGSSYSVASGRLAYAFGLEGPAVSVDTACSSSLVALHLAAQALRNGECDLALAGGVTVMATPSTFIEFSRQRGLAPDGRCKPFAATADGTGWSEGVGLLLVERLSDARRNGHHVLAVLRGSAVNQDGASNGLTAPNGPSQQRVIHAALANAQLNPHEIDAVEAHGTGTTLGDPIEAQALLATYGQNRDPHQPLWLGSIKSNIGHTQAAAGVAGIIKMIQAMQHGTLPQTLHADQPSPHIDWTTGAVTLLTQQQPWPDTGHPRRAAISSFGISGTNAHIILEQAPVEEGSATTSPGDGPMAWPLSAKTEDALREQAARVRDLASGELALADVGFSLATTRAHLEQRATVVAEDRASFLSALDALASGGEHPQLVRGSAAGASKTAFLFAGQGSQRPGMGRELYDSQPVFAQALDDVCALLDPHLDVPLREVMWAEEGTEQAALLEDTLYTQPALFALETALFRLLQHLGVTPHYLVGHSIGEIAAAHAAGILTLDDACTLVAARARLLHDLPAGGAMTALQATEAEVEEAVHGHPGVTIAALNTPNSTVISGDSDGVNTIAARFKEQGRKVTPLHVSHAFHSPHLDPILNEFHATARSLTYHQPSIPIVSTVTGEIAGPGDLTTPDYWTRQLREPVRFHPALTALNATTLIELGPDTTLTALTRSVTDAVALPLLHPDKPENHTLLTALATAHTHGTPIHWATVSAPHHPTTVDLPTYPFQHRPFWLHHTPTTANASRIGQTSTTHAVLAAAVELPGDAHLFTGRLSLDTHPWLADHTLHGTTIVPGTALLDLVLHAADHTGSEHVEELTLHSPLVLPDDKALRLRLHVEPDGESEDTKPAPRQRLTLHSQAEDAAPGTPWDLHATGVLTSTPAEQPTTTLTTWPPSDATPLDTTDLYDRLNDLGLTYGPTFQGLKAAWKHDNDLYAEVRLPHDTDTTGYGIHPALLDAALHTTALTETNDGDTARVPFSWSDVTLHTTGATSLRVHLTPSGSNAATLVFADQNGTLVATIGALATRALAAKELGAPAALPHSLFRLTWDPVTEPPSAPRATWAVLGADATELATALGGDQPPAPLYPRLTDLVHAVESGEPAPSVIALACGSDADADPVTATHELSERALLVVREFLAADAFKTSRLVIVTRAATAVSDEETVRDLPASSVHGLIRTAQSENPDRILLLDTDGLSSSATVLHAALAAGEPQLALRNGTLHAPRLTHADIPADATNPLDPDGTVLITGGTGTLGALTARHLITQHGARHLLLASRQGPEADGATELHDELTELGAHVTITACDTADPAQLADLLTTIPTEHPLTAVIHTAGITHDATLTTLTPEQLHTVLKPKVDAAWHLHHQTQHLDLAAFILYSSAAGILGNPGQANYAAANTFLDTLAHHRHTQGLPATSLAWGLWTQTSTITATLDPNHHTRLNRNGIQPLPTHQALTHLDTALTTPHPHLTPIGLDLRALRDIADDGLLPSMLRKLVKPTARRTAQHGDSAMLLQRLASLSGEERDAFLLDLVRTHIALVLGHATPLLVDPEKGLLDMGFDSLTAVELRNRVNAATGLRLPPTLVFDYPTAKALAGHLHAELAPGDTSGPTHQSGLVDDTAMRRVINSIPVSRIREAGLMEALLRLADGTGEPGADAQDAQGTQDAQHQDLIKSADVDDLIRLALGDDSA

SEQ ID NO: 67612 - protein, 217 aa, Glycine max
MDPKNVKSDLVLILDYGSQYTHLITRRIRSLSVFSLCISGTSSLSTIADLNPSVVILSGGPHSVHTPDSPSFPDGFLQWAQSNGVTVLGICYGLQLLVQRLGGDVRVGDKQEYGRMEICADKPSALFGPEKVGKRQVVWMSHGDEAVALPDGFHVVARSDQGAVAAIENPPAKLYGLQYHPEVTHTEDGMETLRRFLFDVCGVGAGWKMEDVMEEEI

SEQ ID NO: 67613 - protein, 3936 aa, Streptomyces antibioticus
MNEDKLRDYLRRATADLRQVNQRLQEVESKSREPIAIVSMACRFPGGVRSPEDLWRLLASGADALSGFPISRGWDTEALFDADPARSGKTYVSEGGFIADAHEFDAEFFNINPREALAMDPQQRLLLETSWEVFERAGIDPESLRGSRTAVFAGTNGQDYTRGLLSGTESVEGYLATGVSASVASGRISYVFGLEGPALTVDTACSSSLVALHLAAQALRNGECDLALAGGVTVMATPSIFIEFSRQRGLAPDGRCKPFAAAADGTGWGEGVGLLLVERLSDARRNGHHVLAVLRGSAVNQDGASNGLTAPNGPSQRRVIRAALDNARLTPDQVDAVEAHGTGTTLGDPIEAEALLATYGQDRDPDQPLWLGSIKSNIGHTQAAAGVAGIIKMVEAIRRGVLPQTLHVDEPTPHVDWSAGAVCLLTEARPWPDTDRPRRAGVSSFGISGTNAHIILEQAPAEEPHEQPQAVSPGGPSAWVLSARTEDALREQAARIRDLADDDQLPLADVAFSLATTRAHLEQRAAVVAENRGDFQAAFEALASGGEHPQLVRGSAGGASKVAFLFAGQGSQRPGMGRELYDSHPVFAQALDDVCALLDPHLGVPLREVMWAEEGTEQAALLEDTLYTQPALFALETALFRLLQHLGVTPHYLVGHSIGEITAAHAAGILTLDDACTLVAARARLLHGLPTGGTMTALQATEAEVQQALQDHPGVTIAALNTPHSTVISGDTDAVTHLAALFAEQGRKVTPLHVSHAFHSPHLDPVLDDFHTVAATLTYHQPRIPIISTLTGEPAGTCDLTTPDYWTRQLRETVRFHPALTTLNTTTCLELGPDSTLTTFTQSTTDTTAVPLLHPHKPETHTLLTALATAHVHGSPLDWTTIFAPHHPSRIPLPTYPFQHRPYWLHHTPTLTNATDLGQTPSPHPFLGAIAELPNITHLFTGRLSLSDHPWLADHSLQGIAVLPGTALLDLALHAAHHTGHNHIEELTLHAPLVLPERAAVRLRVTVEPSDDGQEDGPELRRLAVHSQGAAAEAGGEWTLHATGVLTTTAAAPADLLDEPFGDAWPPAGATPLPVDEVYPRFADLGLPYGPAFQGLKSAWRHGDDLYAEVQLPDDTDTTGFGIHPALLDAALHTTALSSDEATGPRLPFSWSGITLHAVGASAVRVRLTRRSADTVAVTLADATGGAVLSIDALTVRTLDAGRMAALEGARRANPSYRVEWASLVLRENGNEHDDASGAAPRGDLGWAVVGGMFPGLAAGLDAGGGAVRAAPDLDALFQSAGSESPLPGTVVVCLGGQDGPAEPRVRAHEIAEDLRRLLSAWLADERTVSCRLVLVTDGAMAVHAGERVRDLAAAAAWGFVRVAQSEQPGRFVLVDVDGGADVWASLVDGLASGEPQFAVRDAGVFVPRLAVVDDKGVLAPGGAGPWRLDVTEAGTVENLALVPYPESEQPLAEGQVRVAVRAAGLNFRDVLMTLDMYPGPVAIGSEGAGVVLEVGPGVVDLRPGDRVMGLLRGAMGPLTIADRRLLAPVPDGWSFAQAASVPIVYLTAYYALSDLAELRPGQRLLIHAATGGVGMAATQLARHWGAEVFGTASRPKWAAMRAQGYDEAHLADSRTLAFERAFLEATGGAGMDVVLDSLAQEFVDASLRLLPGGGRFLEMGKTDVRDADEVAARHPGVSYRAFDMIEAGPERIAEMLADLGELFAQGVLRPLPVTAFDVRQAPQAFRLMGQARHVGKLVLTVPPALDPDGTVLITGGTGTLGAVAARHLVTRHGARHLLLAGRRGPSAPGATELHEELTELGAHVTLTTCDVSDPGQLAHLLAGVPADHPLTAVVHTAGVTDDATLATLTADQLHTVLRPKVDAAWHLHRQTRHLDLAAFVLYSSAAGVLGNPGQANYAAANTFLDALAQHRHAQGLPAVSLAWGPWAEASAITAALDSTNRARIGRSGMVPLESGEACVHFDAGWAGVEALVVPARIDAGALRGMADAQALPPMARGLLRAVPQRARSAAAGGGSKLRAKLAGRDEADQRRVLLDLVLGHVGVVLGHSDAGSLNPELPFQSLGFDSLTAVELRNRLTVATGLRLPATLIFDHPTASALAAHLCERVAAVEPESGRVAARAEAGAADEPIAIVGMACRYPGGVRSADDLWRLVAEGRHGVSGLPTDRGWDLERLVDPDPEWSGTTYADRGGFLDDADLFDAEFFGMSPREALATDPQQRILLETAWETLEHAGLAPAGLRGSRTGVFVGMASQHYAVGAEQSSGGLDGYLLTGTTTSVASGRVAYTLGFEGPAITVDTACSSSLVALHLAARALRDGECDLALAGGVAVMASPGIFIEFSRQRGLAPDGLCKPFAACADGTGWGEGVGLLLVERLSDALREGHQVLAVLRGSAVNQDGASNGLTAPNGPSQQRVIRAALDAAGLASGQVDAVEAHGTGTTLGDPIEAQALLATYGQDREPERPLWLGSIKSNIGHTQAAAGVAGVIKMVQAMRHGVLPRTLHVDAPTPHVDWSAGEIELLAEERAWPETGQPRRAAVSSFGISGTNAHIILEQAPALDALEPGQAGDGVVALPVSGAGEAALRAQALRLRAHVEALPEVAPVDVAHALATTRSVFAHRAVVVGRDRAELLDGLAALGAGEARPGLVAGVAEPAPGRTVFVFPGQGSQWAGMALDLLADSQVFARRLRECADAVARYADWDVVEVLRQAPGAPDLERVDVVQPVLFAVMVALAELWRSAGVEPDAVIGHSQGEIAAAHVAGALSLDDAARVVTLRSRALLALAGTGAMAAVPLPAGDVARELERWDGRVGVATVNGPAATVVAGDPDSVHALVDEWRARGVRARTVPVDYASHSPHVEALREELLEVLAPVEPRPSRVPFYSTVTGGLLDTGALDAEYWYRNLRQTVRFGDTVQALLGSGHRLFVEASPHPILTVGVQQGVDEAGVAATVVGSLRREQDGPREFVTALAAAQVHGAPVEWARVLPAASGRRVPVPTYAFQRERYWLEPSPAAGDVAGVGLVAGGHALLGAAVELAGDDGWVLTGRVSLRTHPWLADHAVLGTVLLPGTALADLVLHAARHAGCDRVEDLTLLAPLVLAGHDGVRLQVVVGAPDEAGRRPVGVHARAESAGRHDGWTRHATGVLAAPGTSAARPGELRVWPPDGAEAVAVGEVYDRFAAVGLDYGPAFQGLRAAWRRGAEVFAEVDLPADADADGFAVHPALLDSALHAMLLGADGVEPEIRLPFAWSGLSLHAVAARALRVRLAPAGEPGAVSVEVADESGVPVASVESLGLRPVTGEQLAALRAPAPGGSLFRVEWLPRPLSGEESTGWAALDDGTGVIRDCRYAAVTHEGIAGLREALDAGGAVPPLVVAPSWPDGTVDPAEAAHATAEYHLRLVQDWLADERLASSRLVMLTHGAIASPDGEDTSALATSAVWGLVRSLQAEHPGQFGLLDVDDDPASLAALGRAMAAGEPQGALRRGEFVVPSVSRAASREEGAAAPVFAAGGTVLVTGGTGTLGAVVARHLAAEHGVRRLLLASRRGEDAEGAPQLRAELAGLGAEVTFAACDAANRERLAEVLDAIPADRPLTGVVHAAGVIGDATIASLTPGLLHSVLRPKVDAAWNLHELTRHLELDAFVLFSSTTGVLGSPGQGNYAAANAFLDALAEHRHALGLPVTGLGWGLWARSSGMTGHLDEADLGRMARGGLVPLATGEALALFDTALAAGAGEPVLLPVRLDVQGLRERAAAGLLPPVLRGLVRAPARRVDAAGPSLAQRLAGLDEQEQYRLVLDTVRGHIAAVLGHSSPHQVDAGRPFQELGFDSLTAVELRNRLGLVTGVRLPATVVFDHPTAAALAGHLRDLLAPAGTGTVQHLMEELDRLEEALAARDGDGDTAVGRRLRALAAKYGASPGAEAVTERFEEASAEEVLDFIDRELRR

SEQ ID NO: 67614 - protein, 512 aa, Propionigenium modestum
KKIQDLQKKKEKIALGGGIKRIEKQHASGKMTARERLAYLFDEGTFVEMDAFVQHRCTNFGMDKQDLPSESVVTGYGMVDGRVVYAFSQDFTVTGGALGEMHAKKICKAMDMAGKVGAPVVGLNDSGGARIQEAVDALSGYGDIFYRNSIYSGVVPQISAILGPCAGGAVYSPALTDFIFMVDQTSQMFITGPQVIKTVTGEEVTAEQLGGAMTHNSTSGCAQFISQDDKACIDDIRRLISFLPSNNMEKAPEFGCEDDLNIQFPELDALMPDNPNKAYNMFDVITKIVDNGDYMEYQPHYSKNIITCFARVNGKSVGIIANQPQVMAGCLDIDSGDKCAKFIRTCDAFNIPLLTIVDVPGFLPGVTQEYGGIIRHGAKILYAYSEATVPKVTLITRKAYGGAYVAMCSKSLGADVVLAWPTAEIAVMGPAGAVNIIFRKDIKDAKDPAATTKQKLDEYTTEFANPYQAARRGLVDDVIEPKTSRQRIVDAFNMLEGKREKLPAKKHGNIPL

SEQ ID NO: 67615 - protein, 391 aa, Thermoanaerobacter tengcongensis MB4
MADVILRNMNIKRILDGHPWVYRTEIDRIEGDYIPGDIVNVLTHKKEFIGKGYINLKSMISVRILTRDPEEEIGEEFFRRRIKRAWEYRKKVMEDLNSCRVVFGEGDFLPALIVDKFGDYLVIQTLSLGIDKYKETIVKLLVEILNPKGIFERNDVNVREIEGLPQQKGFLYGKFDPVQQFKENGIKFWVDMENGQKTGYFLDQKENRRAIQNYVKGAEVLDCFSHTGSFAVHALHYGAKRVEIVDISEEALEMAKKNVELNGYQQRAEFIRENAFDLLRRYDREKKKFDTVILDPPAFTKSKETVKDALRGYKEINLRALKIIREGGFLITCSCSQHIRPDMFLNTVKEAASDAKRTIRLVEQRTQAKDHPILLASEETQYLKCLILQVF

SEQ ID NO: 67616 - protein, 271 aa, Staphylococcus epidermidis RP62A
MTELYLKKLDEYICQWIRGLDNIIPRLVEKMETSTKKDRFDLVTNVDKQIQNHFQNFLQEHYPTHQLLAEEKDNSDITPYEGHLWIMDPIDGTSNLVKQQEDYCIIIGYFIDGEPKLSYIYDYPHQRLYRAIAGIGAYENNQLMTMPKRIGLREAIISFKPQVLKEETVQSLFQSAFDFRSIGSCGLDSIRVIKGQFGAHINTNPKPWDISAQFLFVRELGLIMTQINGEPLDFSKAGPFIISNPGCYDDMIRILNEGRGYSKSSHHIERG

SEQ ID NO: 67617 - protein, 493 aa, Arabidopsis thaliana
MGETAAANNHRHHHHHGHQVFDVASHDFVPPQPAFKCFDDDGRLKRTGTVWTASAHIITAVIGSGVLSLAWAIAQLGWIAGPAVMLLFSLVTLYSSTLLSDCYRTGDAVSGKRNYTYMDAVRSILGGFKFKICGLIQYLNLFVIAIGYTIAASISMMAIKRSNCFHKSGGKDPCHMSSNPYMIVFGVAEILLSQVPDFDQIWWISIVAAVMSFTYSAIGLALGIVQVAANGVFKGSLTGISIGTVTQTQKIWRTFQALGDIAFAYSYSVVLIEIQDTVRSPPAESKTMKKATKISIAVTTIFYMLCGSMGYAAFGDAAPGNLLTGFGFYNPFWLLDIANAAIVVHLVGAYQVFAQPIFAFIEKSVAERYPDNDFLSKEFEIRIPGFKSPYKVNVFRMVYRSGFVVTTTVISMLMPFFNDVVGILGALGFWPLTVYFPVEMYIKQRKVEKWSTRWVCLQMLTVACLVISVVAGVGSIAGVMLDLKVYKPFKSTY

SEQ ID NO: 67618 - protein, 316 aa, Oryza sativa Japonica Group
MLLHHRLLPRLLLSPSTPVTTTLLVHRTSLFPTRRILSPCCSALSQVAAAPETVDHSDGDEPQGDVQVQLPLDRLFVPPGASVSAGDAEAVTARVLKGSNIVLGPYARGDANVIAADFVKSSVRPDDCPRDGLPEFALVGRSNVGKSSLLNSLVRRKRLALTSKKPGKTQCINHFKVNDSWYLVDLPGYGYAAAPQEARTNWDEFTRNYFLGRENLVSVFLLVDASIPAKKIDLDYASWLGQNKVPMTLVFTKCDKRKKKKNGGKRPEENVENFQSLIREYFEAAPPWIMTSSVTNQGRDEILLHMSQLRNYWLKH

SEQ ID NO: 67619 - protein, 288 aa, Burkholderia xenovorans LB400
MVGMTADLGKYTDLHIFGKEFPERYYQMGMAEQLLMGAAAGMAHEGAQPFVTTYAVFATRRAYDFMHQAIAEDNLDVKIICALPGLTTGYGPSHQAAEDLALMRAMPNMTVIDPCDALDTEQMVPAIAAHNGPVYARLLRGNVPAVLDEYDYQFELGKAKLLRDGAEVLIISSGIMTMRSLEVAKLLQADKVGVGVLHVPTIKPLDTETILREARRTGRMVVVAENHSVIGGLGEAVATTLLTAGVTPTYRQIALPDQFLAAGALPTLHDRYGISTSVMAENIKGWLG

SEQ ID NO: 67620 - protein, 355 aa, Zea mays
MVMQRFSWPYGGRSASLCGSFTGWREYPMGLVGAEFQVVFDLPPGVYQLAVLDTQLPVKQAFKIMHDEGLALVPLWDDHQGTITGMLTALDFVLMLRKLQRNIRVTGNEELEMHPISAWKEAKLQFYGGPDGAAMQRRPLIHVKDSDSLADVALTIIRNEISSVPIFKCMPDSSGVPFLNLATLQGILKFLCSKLQEQAGGCSLLHNQLLSIPIGTWSPHTGRSSSRHLRTLLLSSPLNTCLDFLLEDRVSSIPIVDDKGALHDVYSLSDIMALAKNDVYARIELEQVTVQNALDVQYQVHGRRQCYTCLQTNTLLEVLEGLSIPGVRRLVVIEQSTRFVEGIISLRDIFTFLLG

SEQ ID NO: 67621 - protein, 123 aa, Chlamydomonas reinhardtii
MAMIVRRPMLTARAPARVAVAPLRTRVISHFKVTFKTPKGEKTIDVEADKYLLDAAEEAGMDLPYSCRSGGCSTCCGKLESGTVDQSDQNMLDEDQLKQGFVLTCVAYPTSDIVILTDQESKL

SEQ ID NO: 67622 - protein, 403 aa, Vibrio vulnificus CMCP6
MFDVQAIRQQFPALAQQVNQNELVYLDSAATTQKPQCVIDAITQYYSSQNANVHRGSHSLTASATSQFEAARDCVAHFIGAQSSKEIIWTRGATEALNLIAQTYARSTLQVGDEILVSEMEHHANIVPWQMVAEQTGAKVVKIPMTADCQLDIESFKTLMNERVKIVAVAQTTNVTATRQPIESIIELAHQHGAIVVVDGAQGIVHEPVDMRTLDADFYVFSGHKLYAPAGIGVLYGKLALLEAMPPWHGGGKMVEKVSFEKTTFSALPGKFEAGTPNVAGAIALAKAIEWYQGFARDEVESHLHQLQSATYRALREMEDIRVIGYQNNASVITFVMDGVHHQDIATLLDQQGIAVRAGHHCAHPLMDALGVKGTVRVSFAIYNTMQDVEKLISALTTAISIL

SEQ ID NO: 67623 - protein, 255 aa, Oryza sativa Indica Group
MAARKFFVGGNWKCNGTGEDVKKIVTVLNEAEVPSEDVVEVVVSPPFVFLPQVKGLLRPDFSVAAQNCWVRKGGAFTGEISAEMLVNLQVPWVILGHSERRALMGESSDFVADKIAYTLSQGIKVIACIGETLEQREAGTTMEVVAAQTKAIAEKISDWTNVVLAYEPVWAIGTGKVATPAQAQEVHDGLRKWLVTNVSPAVAESTRIIYGGSVNGANCKELAAKPDVDGFLVGGASLKPEFVDIIKSATVKSSA

SEQ ID NO: 67624 - protein, 579 aa, Western X phytoplasma
MSYLVLYRKHRPKNFDGMVGQEVVIKTLKNAIKLQKIHHCYLLSGNKGVGKTTLAKILAKAINCQNPQGQDCCNECEFCLVVHQKANLDVIEIDGASYNGVDEIRELKDTVQYKPHLLKYKVYIIDEVHVLSSNAFNALLKLLEEPPLNVVFILITSELAKIPKTILSRTQHFHLPNLTDEEIKTKLNPIVEEEKILITDEALTTIAAYSDGSMRDALNLLDKISSYKINLIEKKDIEKMLGVISESKINQLAEYLVQPDINQMIAFLELILKPNVQISPFLDDLIDFFQKLLLEHVTNPQENTNLFRLLTNSKRNEFFEILLILKQNIIHFPTKKNSLILNFIKIHNLFFDKNIIIKKTSIAAKNTNTVVKNHNWNNNVSYSNNDLPCTKKEPQKSYLAKKKEIVTEEAIESENNLIKHIKKILLNQDDKTTTLLKKRWANLKTYSDNLELEASAKVLSEAKLLMIGRNKEMLLACSDMNNYKNLLNVNVKKNIKKLFNSKKTIINDYFVILPKHWDELIKVAYDKYQTTNNPMDVDLSHLDNSFYEQNSLVKIEQNELELIKLAREYFGFDTVKIKI

SEQ ID NO: 67625 - protein, 341 aa, Sporothrix schenckii
MDNYQKLEKVGEGTYGVVYKARDLTAGGRIVALKKIRLEAEDEGVPSTAIREISLLKEMRDPNIVRLYNIVHAEGHKLYLVFEFLDLDLKKYMDSLPVSDGGRGKALPEGTGTRLHTLGLGDDIIKKFMSQLCAGIRYCHSHRILHRDLKPQNLLINKEGNLKLADFGLARAFGVPLRTYTHEVVTLWYRAPEILLGGHQYSTGVDMWSVGCIFAEMAMRKPLFPGDSEIDEIFKIFRLLGTPTEDVWPGVTTYPDFKASFPRWVQDTETPICPTLDPMGQELLELMLVYDPASRLSAKQACNHPYFDDLEKALPGTAAAAARQHTTTAAAGGAYNGSGYH

SEQ ID NO: 67626 - protein, 182 aa, Zea mays
GTLEAGRGKVSSPPGPGLPSSLSPPLKHPRADGSPPRPLGLRRDRGWAGGWGSSGGGRCCGSSPSLPRPSPSPSPWKPTRATLIRSTGLNMKVCTVIIIAQCLLWALWAVMTRHPSRLKIIFVAIGGAAAVLLEASDIPPRWGYVDGRAICLAVAIPLSYLWWSFAKEDAEMRTSAILKKAR

SEQ ID NO: 67627 - protein, 487 aa, Pseudomonas aeruginosa PAO1
MTDLNTSQGQQLRRVLKPRHLNMIAIGGSIGTGLFVASGATVATAGPGGALLSYALIGLMVYFLMTSLGEMAAYMPVSGSFCTYGSRFVEDGFGFALGWNYWYNWAVTIAAELVAAQLVMSFWFPEVPGIYWSAIFLGIMFGLNVISARGFGESEFWFALIKVVTVVIFIGVGLATIFGIMHGVESPGFSNFTMGDAPFVGGFQAMVGVAMIAGFSFQGTELIGIAAGESENPRKNIPIAIRQVFWRILMFYILAIFVIGMLIPYTDPNLLKNDASDISVSPFTLLFERAGFAAAAGVMNAVILSAILSAGNSGMYASTRMLYNLALEGKAPRLFSRVSRSGVPRNALYATTLVGALCFLTSAFGDSTVYTWLLNTSGMCGFIAWLGIAISHYRFRKGYLAQGGRLEDLPYRAKLFPFGPLFAFALCMVITLGQNYQALVGERIDWIGLLATYISLPLFLAIWLGYRWKKRARFVRYHEMDVSPTNT

SEQ ID NO: 67628 - protein, 289 aa, Vicia faba var. minor
HHSPLPQSPQHGYCCCRRSSLFSSSINTVKSSRSSNRMFASVVIPQSSVEPLCIGTTISSQKLWMPRFYVAVAQEEAVVAVDDEEKVVVEEEEKENEEGQGEKENGEEIVAEEDTRTKLYFGNLPYSVDSAKLAGLIEEYGSAELVEVLYDRDTGKSRGFAFATMTCVEDCKAVIENLDGKEFMGRTLRVNFSDKPKAKESLYPETEYKLFIGNLSWKVTSEILTEAFQEHGTVVGARVIYDGETGNSRGYGFVSYANKSEMEAALTIMNDVELEGRALRVSLAQGKRS

SEQ ID NO: 67629 - protein, 147 aa, Triticum aestivum
MPLVSLRAKLNTLLAVMYASGTLDEQFKQLRAMEEDGGAPPGFVAEAVTLFIREADRILTELAALMKQRVVDVDKADALLRQLKGSCISIGAKQLSVSCTYFRQFYKEKPKGCLFVLTLLRNEFYDVRNKFQTMMHLEQQIEACSPK

SEQ ID NO: 67630 - protein, 470 aa, Desulfococcus multivorans
MSEKKARKETVSRQAMPEQAPEIRRRNFAEVPTGYTAETAVIEAGRCLQCKKPSCVEGCPVNVDIPGFIARIAEGDFKGAIRNLWTRNSLPAVCGRVCPQEIQCEGQCVLNKKGAPVAIGNLERFAADWARENNTGELPPRKASTGKKIAVVGSGPSGLTVAGDLIVKGHEVTVMEAFHKPGGVLVYGIPEFRLPKAIVAHEVDFLERLGVHVACNMVVGRTVTVDELFQEGYDAVYVGVGAGLPRFMNIPGENLIGILSANEYLTRANLMKAYKFPEVDTPIPMGKNVVVLGAGNVAMDAARTAMRLGADSVKIVYRRSRDEMPARTAEIHHAEEEGIEFFLLTNPVQYLGNDQGRLTGMECLKMELGEPDDSGRRRPVPISGSNFEMACDLVIVAVGSGANPLLTQSTEDMTLNRWGYIAADPETGKTTKRGVWAGGDIVTGAATVILAMGAGRKAADSIHEYLTWGW

SEQ ID NO: 67631 - protein, 389 aa, Xanthomonas axonopodis pv. citri str. 306
MRILVTGGTGYIGSHTCVELAQRGHEVCIVDNLSNSSERVLDHLQHLMGFRPEFHRMDVRAPELADLLIGKRIDAVLHFAALKAVGESVREPLLYFNNNVTGTLALLRAMRTAKVCNLVFSSSATVYGDANRSPIDESAPLKAINPYGRTKLMMEEMIGDLSAAWPDFNAALLRYFNPVGAHPSGYLGEDPRGVPNNLMPYIAQVAVGRREALQVFGDDYPTDDGTGVRDYLHVMDLARAHVDAIDYLQRQRKGLVVNLGTGRGYSVREVAAAFARASGRRIPLSIAPRRDGDVAVYFASTALANRLLGWTAEYDLDRMCRDTWRWQSMYPDGYAGSRLPRPRTAAAVPEREGARELPAPAPRLSPGPDTRRRSEPVSTLVVATGFSRV

SEQ ID NO: 67632 - protein, 334 aa, Desulfitobacterium hafniense Y51
MTIRIGINGFGRIGRNVFRAAYGRENIEIVAVNNRSTGEILPHLLKYDSVHGIFPAQIQHTEDGFTVDGQLVKVVSHTDPGDIPWGELGVDIVIESSGKFNNGPACQKHLNNGARKVVISAPAKEEDITLVMGVNEEIYDPQKHHIISNASCTTNCLAPVAKVIHENFGLKRGLMTTVHSYTNDQQILDQSHKDLRRARAAGLSIIPTTTGAARAVALVLPELKGKLNGFSMRVPTPNVSVIDLVAEIEKNTTIEELNGVLRHASENKLKGILDYTDLPLVSSDFNGSSASSIVDGLSTMVMEDNLIKVISWYDNEWGYSCRVVDLVEYVSRQI

SEQ ID NO: 67633 - protein, 313 aa, Aspergillus nidulans FGSC A4
MEQLNVGGPLSRWWSHTTTTYSPTTIEFFGSAAVLFIGFWVPSLIFTWMDTLGPKHIPWRKIQAPARQPQYAAVKKGLVNSLQNQLLTSVLHLAYLGMLHFFTSGAKTTIYNVDSALPSPTRMARDIVISIVLQDIIFYHSHRGLHHPKIYRHIHKKHHEFTTPIALAALYAHPVEYFLSNILPVALPPALLGAHVVTFWFMLTWALLLAIIAHCGYELPPIYGWNMEVHDMHHELFVGNFGTIGFCDVLYGTRLTDSKATRVARDRLKEDTTEDTITAKNISSSAFNPLQRNGLGLEQGDWQGFFSHHTRHH

SEQ ID NO: 67634 - protein, 388 aa, Pyrenomonas salina
MYKTVLVGVLSVAAGANAFQMGSSFVPRMGGQAETARRATMTGPVMAEDPVKCGINGFGRIGRLVARIMIKDPETNLIHVNAGSATPDYMAYQFKYDSIHGRFDGAVVVDGEDLVIDGQRVITTRQRDPKDIGWDKTGVEYLCESTGVFLTSEKAQAHIDGGCKKVIFSAPAKDDSLTVVMGVNPDDYKGQTDFVSCASCTTNGLAPLVKCINDKFGIEEGLMTTIHAMTATQAVVDSSSRKDWRGGRAASGNIIPSSTGAAKAVAKVIPDVKGKLTGMAFRVPTIDVSVVDLTCKLKKETTYEEICNEVKKRAAGDMKGVLGYCDEPLVSTDFESESISSTFDAEAGIMLNPSFVKLVAWYDNEWGYSTRVKDLMVHMAKVDAKVSA

SEQ ID NO: 67635 - protein, 594 aa, Desulfococcus multivorans
MTENESQEIVLKGLGVAPGICIGKAYLVDKEGVNVVKKYYIAEADLHKEEIRFKSAVSRARQELAAIIQETPKELRQHTAILETHMVLLQDKLLYGQTLDTIQRFRYNAEWALKNVVDELKAMFQNMSEPYFRERGADIVHVSDRIMRNLVGGDAVNIRDIDKRVILVAKDLSPAETSQIQLERIKGLVTDGGGIASHTGIIARTLEIPAVLGLNNATQIIRNDDFIVVDGSAGLLIIHPTEQTLMEYEERAARYERHRALIARESRMPAKTLDGISIQVMGNIELPEEVVAVRDYGGNGIGLYRTEFQYLGRRGFPTENDLFDKYRDVVEVMTPRPVTIRTLDINGDKALPGQSGNGEANPVLGLRAIRYCLKKPEIFKTQLRAILRAALYGNVRIMFPMISCCEEVRQAKTLLKEAAESLAAEGIEFEYNVDVGIMVEVPSAVAIADMLADEVDFFSIGTNDLIQYALAIDRGNRYVSHMYRPLHPAIIRMIKTVVDVGHQKGIKVYMCGEMAGDPIHLPVLLGLGLDELSMNPQSIPLVKNAIRKLSIKESRAFMYRIFKDKKEGQIESFLKKAYAGVLFDLDIDEDEIAV

SEQ ID NO: 67636 - protein, 570 aa, Oryza sativa
MAIALRLAAAPLRLRLVSPAPPAIGGAGDGGRRGGGGAARIGVLGRARCRRRRGGGGRLEVAAAAADDSARCRAKGVGAAAAAAETLGGIGVGGGDQLSVVMKFGGSSVSSAARMREVAGLILAFPEERPVVVLSAMGKTTNLLLLAGEKAVGCGVIRVSEIEEWNLIKDLHIKTVEELALPRSVIHTMLDELEQLLKGIAMMKELTLRTTDYLVSFGECMSTRIFAAYLNKIGVKARQYDAFDIGFITTDDFGNADILEAAYPAVAKRLHGDWIRDPAIPIVTGFLGKGWKSGAVTTLGRGGSDLTATTIGKALGLREIQVWKDVDGVLTCDPNIYPNATTVPYLTFEEAAELAYFGAQVLHPQSMRPAREGDIPVRVKNSYNPKAPGTLITKQREMDKVVLTSIVLKSNVTMLDIVSTRMLGQFGFLAKVFSIFEDLGISVDCVATSEVSISVSLDPSKIWSRELIQQELDHVVEGLEKIAVVHLLQQRAIISLIGNVRRSSLILEKAFQVLRKSGVNVQMISQGASKVNMSLIVHDSEAKQCIKALHQAFFEDDVLTEVEEEALHMS

SEQ ID NO: 67637 - protein, 320 aa, Bacillus subtilis
TKGGIRFHPNVTEKEVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANNR

SEQ ID NO: 67638 - protein, 322 aa, Bacillus subtilis
TKGGIRFHPNVTEKEVKAVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANN

SEQ ID NO: 67639 - protein, 122 aa, Magnaporthe grisea 70-15
MDRKDPMVGTGLVGAPACGDVMKLQIKVDNGTITDAKFKTFGCGSAIASSSYLTELVKGMRIEDAAKIRNTDIANNLHLPPVKLHCSMLAEDAIRAAIADYHTKNPPTNLGKSEVKTLEMEK

SEQ ID NO: 67640 - protein, 195 aa, Western X phytoplasma
MIKKSVFIKSIQGPIDCPVPRLSEVFLMGRSNVGKSSFINALTNKKKLALFSKTPGKTTTVNYFLLNDSFYLVDSPGYGYSKRNKTFKQSVFPMINNFLQNNYFVKIIFQIIDFKVGPTKMDLDIYHNLREYNLPVFLILNKKDKVLKNQVINQMQRIKKEFGAFEENIPMFLLSCKNKDGLNEIVNLIYDKINT

SEQ ID NO: 67641 - protein, 267 aa, Pseudomonas putida KT2440
MFLSELYRYPVKSGQAQSLKASPVGLLGLQGDRRWMVVEEENGRFLTQRAWPQLGQIDASDDDSGQLLLQAPGQAPLRVPVPPADDALRGVTIWRDTLRVPDAGDAAAAWLSELLGKAVRLVHCPEQRARYLPNGYGLNSDRAAFPDGFPLLLIGQGSLDELNRRIGRPMSMRRFRPNLVVQGAEPFAEDGWKRIRIGSLVFRVLKPSVRCIFTTIDPVTGERSADREPMATLKTFREKEGDVLFGQNLAVDGSGWLEVGMEVEILE

SEQ ID NO: 67642 - protein, 233 aa, Desulfitobacterium hafniense DCB-2
MDIYGSLSAVRQRIQQAAVKSGRDPSAIKLLAVSKTMSAGTVQRAYEAGQRSFAENRVQEWQDKVTQLPADCEWHLIGRLQTNKVKYLDERINLIHSLDRLSLLETLESQGAQRNIIWPTLVQVNIARDSQKAGLLAEEVEDFLREAAGCQHIQVYGLMTIGALGASPEDTQGFFRELRLLKERLQQKNLPHVNLKELSMGMSQDFGWAIQEGSTIIRVGRQIFGERIDLNHE

SEQ ID NO: 67643 - protein, 320 aa, Ustilago maydis 521
MPIPTVRLASGLELPRLAFGTGTALYNSDAAKQVTMALDSGFRFIDGAEVYANEASMGAGIESFLASSGLKRNDIYVLTKVGKEGMKDLQSAIKVELQKLKVDQLDSYLLHLPPRGQDGLPSNVDAWKELEKIKQAGLTKSIGVSNWLASDIQQLLDAGLSVPDINQIEFHNNSPRTFLEPPPHFVSFQHPYVYSHEEYTKLLALQKKHGIVTMTYSALAPFYKSALPEDGPLNKALTAIAAKNDKRTTANVLLRWALQRSEGIITTTTSKESRAKEYLDQLDSNNDAQLKLSEDELQEIDQAGKAHGVEKFYMAPYLKP

SEQ ID NO: 67644 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPIDKIDPTHSYVKDIGDLSKHTLDKIKHFFETYKDLEPNKWVKVKGFEN

SEQ ID NO: 67645 - protein, 113 aa, Brassica napus
MSRRRHIIVINILVVGENKNKTKKVFFFLSLQLDRDHSVFFSGVIMTTSKGLADRKIEKFDKNITKRGFVPETTTKKGKDYPVGPILLGFFVFVVIGSSLFQIIRTATSGGMA

SEQ ID NO: 67646 - protein, 441 aa, Kluyveromyces lactis NRRL Y-1140
MGKVAELLSHPLELKAALKLKFLRKPLFPDVVIEESADLTRCHELLKLTSRSFAAVIMELHPELRNAVMLFYLVLRALDTVEDDMTIDPKIKIPVLREFDSKLDLPSWYFDGNGPNEKDRAVLVDFPCILNELHKLKPEYQRVIKEITGKMGNGMADYILDENFNLNGLQTVADYDLYCHYVAGLVGDGLTQMLVLAGFGSNDLYDENVHLYEDMGLFLQKTNIIRDYAEDLADGRSFWPKEIWSLYAEKLSDFAKPENTQQGLYCINHLVLNAMTHIESVLHYLASIHEQSSFQFCAIPQVMAIATLSLVFANPKVMHENVKIRKGTTCYLILKSRTLRGCVEIFQYYLRDIKKRLTVEDPSYLKLNIQISKIEQYIESMYQEQLPLGVKPQETLIYKKVLDRTEYDSKVAVIEEDEEFKFNLGFTMFLTFIAAVYFYSK

SEQ ID NO: 67647 - protein, 132 aa, Helicobacter pylori
SNIKYELDKESGVLMVDRVLYGAQNYPANYGFVPNTLGSDGDPVDALVLSDVAFQAGSVVKARLVGVLNMEDESGMDEKLLALPIDKIDPTNSYVKDIDDLSKHTLDKIKHFFETYKDLEPNKWVKVKGFEN

SEQ ID NO: 67648 - protein, 343 aa, Bacillus anthracis str. A2012
MPPYLLYKSSIANWLGKKTANWTVLYPANFTMLNMEGEIRMKRWQMEWLLVSVALVWGANYTIGKYGVAYMSSIQFNSLRFLVASPVLLLITFLMERSLRIERKDWLRLVAVGIVGTTMYQTMFMLSVKYTSATNASLLIAMSPIFTGILAVLHKQERFSMKVQIGSIVAFIGAAFVLLTGHTGGATYEYAWLGNIIGLVAAIAWGWYPILAQPLITKYSAMRVTSWSTLIGIVPLVIYCLFNVNSLTWPVDTLSWGSLAYSIIFATIFGLAMWYVGISQIGSTKVMVYMYLVPLFAVIFAAVTIGEQINMMQLVGGLIIFVGLYVVKKGGIKKPALNLKKVS

SEQ ID NO: 67649 - protein, 327 aa, Oryza sativa Indica Group
MGGGSIRAAAKAAMIGGYRSASAVRRAVLPASPAPQTAPSAAGEGRKAASTYAAIDDWVIPDREVFGPVPTHEEAMAATLDLKESFQFDKSAQLEPLPSGDLDVPTKVGQEGLVHSETPQDLVHSETQGLVDLGASQDLVHSETSQGLVHSESSQGLIHSKTSEHEDNHEISLVSSGAPGRVVQAFTMLQDSPEAQEVVASLASDQNVWNAVMRNEKVMKFYKTYATKLNEDEVEGSESDSVQNSSELGSAGEAFMCYVEKMKALVSEMMTNLSSIMQDLVATSDEGQSKGKLKTMILDSKKDFANAPSAFVLLAIASIMVVLLKRA

SEQ ID NO: 67650 - protein, 438 aa, Coccidioides immitis RS
MAKRRTKTRTHIKPAPQGGTSNLKNGAASINRSPKSMVIRMGAGEVGPSVSQLVKDVRSMMEPDTASRLKERRGNKLKDYTVMTGPLGVTHLLLFSKSSTGNTNLRIALTPRGPTLHFRVESYSLCKDVTKAQKHPRVSSKSHMSPPLLVMNNFMTSQSEEDTSSKKIPKHLESLTTTVFQSLFPPISPQATPLSSIRRIMLLNRELPSASNGIDQDSYVLNLRHYAITTKRLDISKRIRRLDPREQRRKDKKDRTVPNLGKLNDVAEYLLDPSAAGYTSASETELDTDAEVEVMESTTRKVLNKKELQRMKAGEKKSKTIPSPNVEKRAVKLVELGPRMRLKLMKVEEGLCGGRVMWHALVNKTQAEADKLEETWEQRRKEKELRRQIQKENVEKKKKAKANDGQAADAEDKMDEAGDSEMWDSEDFSEHEEHDDED

SEQ ID NO: 67651 - protein, 387 aa, Xanthomonas axonopodis pv. citri str. 306
MLALNYHGSRDVRVETVPGPLLVERDDLILRVTATAICGSDLHLYRGKIPDLRPGDILGHEFMGIVEEVGPDVTAVKPGDRVVIPFVVACGRCFHCVLQEFSACETTNTGKGAALNHKDMRPPAALFGFSHLYGGLSGGQAEYVRVPKANVGPLAVPDALHDEQVLFLSDILPTGYQAVVNAGVKQGSTVAIFGAGPVGLMAAACCRMLGAERVFMVDRHAYRLDFASRTYGVIPINFDEVDDPADVIVSQTNGRGVDASIEAVGFEAEGSAIETALTNLKLEGSSGVAIRQCIAATRRCGVVSVPGVYAGFIHAFMFGDAFDKGLTFKMGQTHVQKHMPHLLECIGNGQLKPSAIISHRMSLADAARGYDLFDKKQDDCRKVVLTP

SEQ ID NO: 67652 - protein, 379 aa, Prochlorococcus marinus str. MIT 9303
MIASSRNSALLVLADGTVLEGEAFGHRGAAMGEVVFNTGMTGYQEVLTDPSYSGQLVTFTYPELGNTGVNLDDQESSRPHARGVIARQLSPTPSSWRCQQSLQTWLEEQRVVGISGVDTRALVRHLREVGAMNGVISSDGSTPKQLMELLQQAPSMEGLNLADQVSTKDPYSWRSTCAVGFDQRLKRHIDSPYRVVAIDFGIKRAILDRLVAHGCEVTVLPASSDLATVLSSQPEGVFLSNGPGDPAAVTGGIALVKDLLNKVDIPLFGICLGHQIIGLAMGGRTFKLAYGHRGLNHPCGTTGQVEITSQNHGFALDASSLSQVSVVVTHLNLNDRTVAAIAHRDRPVFGVQYHPEASPGPHDADHHFAHFVELMADRR

SEQ ID NO: 67653 - protein, 487 aa, Synechococcus sp. RS9917
MAAAAPASAGTKGVVRQVIGPVLDVEFPAGKLPKILNALRIEGTNATGQQVALTAEVQQLLGDHRVRAVAMSSTDGLVRGMEAVDTGTAISVPVGEATLGRIFNVLGEPVDEQGPVNATATAPIHREAPKLTELETKPKVFETGIKVIDLLAPYRQGGKVGLFGGAGVGKTVLIQELINNIAKEHGGVSVFGGVGERTREGNDLYEEFKDSGVINADDLSKSKVALCYGQMNEPPGARMRVGLSALTMAEHFRDVNKQDVLLFIDNIFRFVQAGSEVSALLGRMPSAVGYQPTLGTDVGALQERVASTVEGSITSIQAVYVPADDLTDPAPATTFAHLDATTVLNRALASKGIYPAVDPLDSTSTMLQPAVVGDEHYRTARAVQSTLQRYKELQDIIAILGLDELSEDDRRTVDRARKIEKFLSQPFFVAEIFTGMPGKYVKLEDTIAGFNQILAGELDHLPEQAFYLVGNIDEVKAKAEKINAESK

SEQ ID NO: 67654 - protein, 240 aa, Glycine max
  misc_feature (152)..(152): Xaa can be any naturally occurring amino acid
MEGANWKITEEEAGPSSSSGIASNKQQNPPETFHHQHHRKEAAAEEEETEEEEEDDVDHHNNSTFVPGPLLSLKDQIEKDKEDESLRRWKEKLLGCMESDLDGQIHPEVKFHSIGIISEDFGEVITSLSVDESQNGHILFTLREGSHYQLKXLKFSVLHNIVSGLTYCNTVWKGGLQVDQSKGMLGTFAPQKEPYVHALKEDITPSGVLARGVYSAKIKFEDDDRRCHMELKYSLEIKKR

SEQ ID NO: 67655 - protein, 94 aa, Zea mays
MASGGKVSFKVTLTSDPKLPFKVFSVPEAAPFTAVLKFAAEEFKVPPQTSAIITNDGVGINPQQSAGNVFLKHGSELRLIPRDRVGAYEMFRDI

SEQ ID NO: 67656 - protein, 323 aa, Bacillus subtilis
TKGGIRFHPNVTEKEVKAVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKRGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIRAKIVVEAANGPTTLEGTKILSDRDILLVPDVLASAGGVTVSYFEWVQNNQGFYWSEEEVEEKLEKMMVKSFNNIYEMANNR

SEQ ID NO: 67657 - protein, 593 aa, Physcomitrella patens
MGNTCVGAASKAGFFEFPQERGSPSPSVTPKGTQPEEPAAKPNNPSPEERRKSGAGVEQEARAELKPQLSLTIQAPAVIRIAPTVYPSAANRRQENCVVPAMRRAGLNLIPGLSFTHSVLQRQTENLKDLYRLGRKLGQGQFGTTYLCVEKATGREYACKSIAKRKLISQEDVDDVRRELHIMHHLSGHPNIVTIKGAYEDQMAVHLVMELCAGGELFDRIIQRGHYSEAQAAELCRVIVGVVETCHSLGVMHRDLKPENFLLSDQSEGAALKTTDFGLSVFFKPGEVFTDVVGSPYYVAPEVLRKHYGPEADVWSAGVILYILLSGVPPFWAETEQGIFEQVLKGELDFVSEPWPSISDSAKDLIRRMLDPNAKRRLKAHQVLSHPWIGEEGVAPDRPMDPAVQSRLKQFSAMNKLKKVAIRVIAELLSEEEIAGLREMFKMIDTDHSGTITFEELKSGLERVGSNLVESEIRQLMDAADVDQNGTIDYGEFLAATLHLNKIEREENLFAAFSWLDKDNSGYLTVDELQQACSKYNMGETSIEDLIREVDQDNDGRIDYNEFVMMMRKGNGAVGRTTLRNSLSLSDALMNPQ

SEQ ID NO: 67658 - protein, 472 aa, Hordeum vulgare subsp. vulgare
MDVPLASKVPLPSPSKHEQCNVYSHKSSSKHADLNPHAIDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLEDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 67659 - protein, 313 aa, Staphylococcus epidermidis RP62A
MTKVYFNHDGGVDDLVSLFLLLQMENIELVGVSTIGADCYLEPSLSASLKIINRFSDVEINVAPSYERGKNPFPKEWRMHAFFMDALPVLNESCIPKRCKASEDEAYIDIIRKVKSCDEKVTLLFTGPLTDLAKAIKYDNSILKNIEKLVWMGGTFLDKGNVEEPEHDGTAEWNAFWDPEAVKVVLDSDMNVDIVALESTNQVPLTMEVRQMWADKRQYLGVDFLGTSYAAVPPLTHFVTNSTYFLWDVLTTAYVGSPNLVESTKLKIDVVSQGPSQGRTFQSEYGREVQVITDVNKQAFFNYITDLAKKIES

SEQ ID NO: 67660 - protein, 219 aa, Oryza sativa
  misc_feature (65)..(65): Xaa can be any naturally occurring amino acid
  misc_feature (170)..(170): Xaa can be any naturally occurring amino acid
LFSSSAARTLLSPAAPPVPRRGVVRPARCSGAKVCTVSNRGDSLAICRVVNGMWQVSGPSWGRYXRDAAVDAMLRYARAGLSAFVTAVADGPAEDLYGLFINRVRRERPPELLEEIKGLTKWVPPPVKMTRSYVEDNINRSRKRMDVSALDMLQFHWWDYANPGYLDALXHITDLKEEGKIKTVALTNFDTDRLQIILENGIPIVSNQVYFTYPLWIFF

SEQ ID NO: 67661 - protein, 320 aa, Bacillus subtilis
TKGGIRFHPNVTEKEVKALSIWMSLKCGIIDLPYGGGKGGIVCDPRDMSFRELERLSRGYVRAISQIVGPTKDVPAPDVFTNSQIMAWMMDEYSRIDEFNSPGFITGKPLVLGGSHGRESATAKGVTICIKEAAKKKGIDIKGARVVVQGFGNAGSYLAKFMHDAGAKVVGISDAYGGLYDPEGLDIDYLLDRRDSFGTVTKLFNDTITNQELLELDCDILVPAAIENQITEENAHNIQAKIVVEAANGPTTLEGTKILSDRDILLVPDVLASAGGVTVSYFEWVQNNQGFYWSEEEVEEKLEKMMVKSFNNIYEMAKNR

SEQ ID NO: 67662 - protein, 628 aa, Physcomitrella patens
MGNVSGRQSKNRGQQGGMSQEGSADTRFKSESERPRAEGSNQRSSATSSSRGASTHPNQGGSARPASTGSAHTGSAHNASTHHNQGGSTRPASTGSTHTGSSHNASTHSNQGGSTRPASTGSSHGESGHSARPSSGTAPAERPRVPMAAPRPRSVSNVGVLGKPLVDIRQTYSLGKELGRGQFGVTYLCTHKETGEKLACKSIAKRKLIAKEDIEDVKREVQIMHHLSGTPNIVDLKGVYEDRHSVHLVMELCAGGELFDRIIAKGHYSERAAADLCRVIVNVVHRCHSLGVFHRDLKPENFLFASKDEDAPLQATDFGLSTFFKLGEVFRDIVGSAYYVAPEVLKRNYGPEADVWSAGVIVYILLCGVPPFWAESEQGIFDAVLKGHIDFESEPWPRISSGAVDLVRNMLNPNVKERLTAYQVLNHPWMQEGGDASDEPLDNAVLDRLKNFSAANKMKKLALKVIANSLSEEEIVGLRELFKSMDTDNSGMVTFEELKQGLIRQGTGLKEADIRKLMEAADVDGNGKIDFHEFISATMHMNKTEKEDHLWAAFKHFDTDNSGYITHEELQEALENSGMGDPQAIQEIIREVDTDNDGKIDYDEFVAMMRKGNPDTEDGVMVVPPRHR

SEQ ID NO: 67663 - protein, 486 aa, Oryza sativa Japonica Group
MAARVPGGGGAAAAAEAEARLRLARLADKFHAVYAARPALFARSPGRVNLIGEHIDYEGYSVLPMAIRQDMIVAIRRAEGKEVRVANVDDKYPICVYPADPDKEIDIKNHKWGHYFMCGYKGVYEYCRSKGIDMGGPVGLDVVVDGTVPTGSGLSSSAAFVCSATIAIMGVLEKNFPKKEVAQFTCQSERHIGTQSGGMDQAISIMAKPGFAELIDFNPIHATDVQLPPGGTFVIAHCLAESKKAETAATNYNNRVVECRLAAIVLAIKLGMETKKAVSSVTTLSDVEGLCVSFAGKEGSSDPGVAVKKLLHEESYTTEEIEKITGQSLTSIFQSSQTSLDVLRAAKHFKLFQRAFHVYSEARRVYAFRDTVLSKLSAEDMLQKLGDLMNESHYSCSVLYECSCPELEELVKVCRDNGALGARLTGAGWGGCAVALVKEGIVPQFILNLKETYYKSRIDRGVINQKDLGLYVFASKPSSGAAIFKL

SEQ ID NO: 67664 - protein, 601 aa, Salmonella typhimurium LT2
MEGADLLTAGVLFLFAAVAAVPLAARLGIGAVLGYLLAGIAIGPWGLGFISDVDEILHFSELGVVFLMFIIGLELNPSRLWQLRRSIFGVGAAQVLLSAAVLAGLLMLADFLWQAAVVGGIGLAMSSTAMALQLMREKGMNRSESGQLGFSVLLFQDLAVIPALALVPLLAGSADEHFDWFKVAMKVLAFAVMLIGGRYLLRPVFRFIAASGVREVFTAATLLLVLSAALFMDALGLSMALGTFIAGVLLAESEYRHELENAIDPFKGLLLGLFFISVGMSLNLGVLYTHLLWVAASVVILVVIKMLTLYLLARLYGIRSSERMQFASVLSQGGEFAFVLFSTASSQRLFQGDQMALLLVTVTLSMMTTPLLMKGIDKWLSRRLNGPEENDEKPWVEDDKPQVIVVGFGRFGQVIARLLMANKMRITVLERDIGAVNLMRKYGYKVYYGDATQVELLRSAGAEAAESIVITCNEPEDTMKLVALCQQHFPHLHILARARGRVEAHELLQAGVTQFSRETFSSALELGRKTLVSLGMHPHQAQRAQLHFRRLDMRMLRELIPEHSDMVQISRAREARRELEEIFQREMQQERRQLDGWDEFE

SEQ ID NO: 67665 - protein, 335 aa, Myxococcus xanthus DK 1622
MRGSVIGSGSFGTALANVLAVNCEEVRLWGRESSVVEAINTQHENPTYLKGIPISERVRATNDLQEALVGSELVVLATPSHATREVVAKAQAYLPRHVPIVTVSKGIENGTLLTMTELLEDCLPEEFHPYLAVLSGPSFAKELARRMPTVVTIASHWDKVALRCQKALQTETFRSYTSTDVVGVQYGGALKNVIAIAAGMADGLGMGHNARAAIITRGLAEITRLAVRKGANPLTLSGLSGMGDLVLTCTGELSRNRHVGMELGKGRKLPDILADMKEVAEGVKTARSAHELELKTGVELPICHQVYLIAHEGKSARTAVVDLMTRQPKSELAGV

SEQ ID NO: 67666 - protein, 389 aa, Haemophilus somnus 2336
MSVIKMTDLDLAGKRVFIRADLNVPVKEGKVTSDARIKATIPTLKLALEKGAKVMVTSHLGRPTEGEFKPEDSLQPVVDYLKGAGFNVRLAQDYLNGVEVNEGEIVVLENVRVNKGEKKNDPELSKKYAALCDVFVMDAFGTAHRAQASTYGVAEFAPVACAGPLLAAELEALGKALKEPQRPMLAIVGGSKVSTKLTVLDSLSKIADQLIVGGGIANTFIAAEGHNVGKSLYEADLIPEAQRLSKVTNIPVPVDVRVGTEFSETALSTEKSVADVSGEESIFDIGDKSAEQLADIIRNAKTILWNGPVGVFEFPNFRKGTEIVSNAIAEATANGAFSIAGGGDTLAAIDLFGIKDKISYISTGGGAFLEFVEGKVLPAVEILEKRANG

SEQ ID NO: 67667 - protein, 316 aa, Physcomitrella patens subsp. patens
MLQNIAVASSAATSVARFRSIAAAPSSQRVALGQSHLGSAKVFFTPARIGSRSSSHRAATQVVALKDPSSQDNLKRAVAKKAIELVKSGMVVGLGTGSTSSMAIEELGNLIQANKLKDIVGVATSYQSKVLARQFGVKTVDLNDVNHIDIAFDGADEVDSGMSLIKGGGAAHTMEKVVDSIAKECVILIDETKVVKTLGLSFPVPVEVLPFALAPVLRALAALGGQPEIRTALRKDGPVITDLGNMVVDVRFPEGVKDPAEMETKINMIPGVIDNGLFINVAHKVLVGTKDGDETSVVEFAEFVSSMKSSTEGVSA

SEQ ID NO: 67668 - protein, 635 aa, Salmonella typhimurium LT2
MIVFSSLQIRRGVRVLLDNASATINPGQKVGLVGKNGCGKSTLLALLKNEISADAGSFTLPGTWQLAWVNQETPALPQPAIEYVIDGDREYRQLEAQLNDANERNDGHAIASIHGKLDAIDAWTVRSRAASLLHGLGFSNDQLERPVSDFSGGWRMRLNLAQALICRSDLLLLDEPTNHLDLDAVIWLEKWLKSYPGTLILISHDRDFLDPIVDKIIHIEQQTLFEYTGNYSAFEVQRATRLAQQQAMYESQQERVAHLQSYIDRFRAKATKAKQAQSRIKMLERMELIAPAHVDNPFHFSFRAPESLPNPLLKMEKVSAGYGDRIILESIKLNLVPGSRIGLLGRNGAGKSTLIKLLAGELEPLHGEIGLAKGIKLGYFAQHQLEFLRADESPLQHMARLAPQELEQKLRDYLGGFGFQGDKVTEETQRFSGGEKARLVLALIVWQRPNLLLLDEPTNHLDLDMRQALTEALIDFEGALVVVSHDRHLIRSTTDDLYLVHDKKVEPFDGDLEDYQQWLSDVQKQENQADNAPKENNANSAQSRKDQKRREAELRTLTQPLRKEITRLEKEMEKLNAQLAQAEEKLGDSSLYDPSRKAEMTECLQLQASAKSGLEACEMAWLEAQEQLEQMMQND

SEQ ID NO: 67669 - protein, 466 aa, Streptococcus agalactiae 2603V/R
MDAKTKYKAKKIKAVFFDIDDTLRVKDTGYMPPSILKVFKALKDKGIVVGIASGRARYGVPKEVQDLNADYCVKLNGAYVKDKDKNIIFHRPIPAEYVEQYKKWADTVGIKYGLAGRHEAVLSDRDDLVNDAIDIVYSDLEVNPDFNKEHDIYQMWTFEDKGDSLHLPEPLAEHLRLIRWHDHSSDVVLKGTSKALGVSKVVEHLGLKPENILVFGDELNDLELFDYAGLAVAMGVSHPEAQKKADFITKKVEEDGILYALEELGLIEKELTFPQVDIENTEGPVAVIKTNHGDMTVKLFPDHAPKTVANFIGLAKQGYYDGIIFHRIIPDFMIQGGDPTGTGMGGESIYGESFEDEFSEELYNVRGALSMANAGPNTNGSQFFIVQNTKIPYAKKELERGGWPTPIAELYAGQGGTPHLDRRHSVFGQLVDQSSFEVLDEIAAVETGSQDKPLEDVVILTIEVKE

SEQ ID NO: 67670 - protein, 350 aa, Microscilla sp. PRE1
MKLKKVVTFGEIMLRLAPPGFLRFSQASSFDVIYGGGESNVAVSLANYGVPVDFVTRLPKNDIGECALMEMRKRGVGTDHIVWGGDRLGIYFLETGAVSRGSKVVYDRAHSAMAEIQSGMVDWKKVFAGAEWFHWTGITPAITQSAADVCLEAVKAASDLGITISTDLNYRAKLWKYCSAEKREEIMTELTSHCDIVLGNEEDAEMHFGIKPEGISVQTEGHNVKAEAFLSVCQQMMKKFPKAKKVITTLRGSISASHNTWAGVLYDGEKMYETRQYQITDIVDRVGGGDSFMGGLIYGLLKYPEDDQNALDFAVAASCLKHTIKGDANLVKVEEVEKLMGGDASGRVAR

SEQ ID NO: 67671 - protein, 334 aa, Prochlorococcus marinus subsp. pastoris str. CCMP1986
MKSYQINTINNLHKISVAPMMDCTDKHFRMIIRKISSKALLYTEMIVAQSLIYTDKKERFLDFNSEEHPLSIQFGGDNPKMLEEAAKMAQDWGYDEINFNVGCPSPRVCSGNFGASLMKEPIKVAKCIESLKNNCSLPVTIKHRIGVDEEDSFDKLDSFVKEIANAGADRFTVHARKAILKGLNPKQNRTIPPLKYDVVRKLKKNNPKLIIEINGGFTNIDQCIEALNDLDGVMIGRSAYKYPLRWSEIDQKIYGESTKSKKASEIIFSLVPYIEKHLKNEGKTWDICKHLINLVEGIPNAKVWRNEISTKSIRQELSIDYLSKKASELQKMGF

SEQ ID NO: 67672 - protein, 715 aa, Pseudomonas putida KT2440
MIYEGKAITVKALESGIVELKFDLKGESVNKFNRLTLNELRQAVDAIRADASVKGVIVRSGKDVFIVGADITEFVDNFKLPEAELVAGNLEANRIFNAFEDLEVPTVAAINGIALGGGLEMCLAADYRVMSTSARIGLPEVKLGIYPGFGGTVRLPRLIGSDNAIEWIAAGKENRAEDALKVGAVDAVVAPELLLAGALDLIKRAISGELDYKAKRQPKLEKLKLNAIEQMMAFETAKGFVAGQAGPNYPAPVEAIKSIQKAANFGRDKALEVEAAGFAKLAKTSVAESLIGLFLNDQELKRKAKAHDEIAHDVKQAAVLGAGIMGGGIAYQSAVKGTPILMKDIREEAIQLGLNEASKLLGNRVEKGRLTPAKMAEALNAIRPTLSYGDFANVDIVVEAVVENPKVKQAVLAEVEGQVKDDAILASNTSTISINLLAKALKRPENFVGMHFFNPVHMMPLVEVIRGEKSSDVAVATTVAYAKKMGKNPIVVNDCPGFLVNRVLFPYFGGFAKLVSAGVDFVRIDKVMEKFGWPMGPAYLMDVVGIDTGHHGRDVMAEGFPDRMKDERRSAVDALYEANRLGQKNGKGFYAYETDKRGKPKKVFDATVLDVLKPIVFEQREVTDEDIINWMMVPLCLETVRCLEDGIVETAAEADMGLVYGIGFPPFRGGALRYIDSIGVAEFVALADQYADLGPLYHPTAKLREMAKNGQRFFN

SEQ ID NO: 67673 - protein, 164 aa, Prochlorococcus marinus subsp. pastoris str. CCMP1986
MNQFFSRRSFILIPIMSILKFILQPKKVLAAFAASDDDWNLSKEDWKNKLSPESYYILREEGTERAFSSQLNNEKRKGIFYCAGCNQPLFTSDTKFDSGTGWPSFWDPIQGSVETKVDFKLIVPRTEYHCSRCGGHQGHVFNDGPLPTGKRYCNNGLALKFIAE

SEQ ID NO: 67674 - protein, 232 aa, Glycine max
RVRLMASSDSWMKEYNEAVKLADDINGMISERSSFPASGPETQRHASAIRRKITILGTRLDSLQSLLSKVPAKTEKEMNRRKDMLANLRTKVNQMASTLNMSNFANRDSLLGPEIKSDAMSRTVGLDNSGLVGLQRQIMKEQDDGLEKLEETVISTKHIALAVNEELNLHTRLIDDLDQHVDVTDSRLRRVQKNLAVLNKRTKGGCSCLCMLLSVIGIVGLVVVIWLLVKYL

SEQ ID NO: 67675 - protein, 227 aa, Coccidioides immitis RS
MSSLTSGSPVTLQCFSLCSSSMGMGRVRESIPESYPLRKYYLAFGYFGLASWIFSMIFHTRDFPLTEKLDYFAAGASVLYGLYLAIVRIFRFDQVRPRLKPTLLRWWTILCCGLYLAHVSYLSFWTWDYSYNMTANVAVGITQNLLWTWFSISRYRKYMKGWTAWPGMIVAWLILAMSLELLDFPPAWGLVDAHSLWHLGTVVPTIWWYTFLVKDAQDDLMGQRLKA

SEQ ID NO: 67676 - protein, 355 aa, Methylococcus capsulatus str. Bath
MPTAKAYAAFSADSALAPFVLQRRDPLPQDIRIGILYCGVCHSDLHQARNEWNATTYPCVPGHEIVGKVLEVGRSVTKFKPGDTVAVGCMVDSCRTCPNCVDALEQHCEHGPVFTYNSPDPHGGGMTFGGYAESIVVDEAFVLRIPDGLDLAAAAPLLCAGITTYSPLRHWKVGAGQRVGVVGLGGLGHMALKFAHTFGAETVLFTTTPDKAEDARRLGADEVVVSRDPEAMARQAGRFDFILDTVSAPHDIDAYLNLLRRDGTLTLVGVPPQGVQVMPFSLIGGRRRLAGSLIGGIRETQEMLDFCGEHGIVCDIELIPIQGINDAFERMLKSDVKYRFVIDMATLNGESSGGR

SEQ ID NO: 67677 - protein, 399 aa, Ustilago maydis 521
MPSQKPRILIPGGAGYIGSHVALVTLLTRKYRVTESMLDRIAMVDRWLMKSRCASTRSVLDNYHNAFPTAVKRLEQIAIDELPEGASQQDKDDCKVDVFKGDLRSKQDIAKVFGSYSGDDKIWGVILCAALKAVGESSEIPIDYYDVNVGGLVNLLKVMHDNGCNRLVYSSSATVYGTPPKVPIPESTRLAPESVYGRTKWMSEIIIRDVCDAYPEFRAIGLRYFNPAGAHKSGKIGEDPRGKPGNLLPLLAQMAVGKYREGGLKVFGNDYPTPDGTCVRDYIHIEDLAGGHVNAVEALDRDEIFAEDKIETKGKYRAFNLGKGVGMSVLNMVDAMKKVSGYEFPYSIVERRTGDVPDLTADPSLAEKELGFKATKNLDDMAQDLWRWQSGNPQGYGEQ

SEQ ID NO: 67678 - protein, 552 aa, Yarrowia lipolytica CLIB122
MDISEFLSEGDVEMQQLSEDNGRHVGHSRDISHDANLSPHPSRDFPRESTTSSIPSRLNMTDFLTSVAPDTAEPAVPNTACTLVGDHVASSSGSNNTNHVTPTDSPGGGDEGGFMSTSANSETQRMSGVFKTSKPGHGVNDHVNMDFYTPPTTAGPPTRGSPESVPTTAASTFPLRKRTRAHLRARDKSDGPAPSSRGTSDRLWSWVFLKQPLSLPEHNYQAHLGNNVFLIGGRFLSARQKPLNIAVLCVILILGGLYYGFVAPWTWNHISPAIPAVFTYIFLLCVASFLRASFSDPGILPRNIHLTDRIADGSIPNEYSVEPGIDAFDPRKNTTSLSCFKQPESSENLVYLKYCSTCKIWRPPRASHCSDCDNCVDFHDHHCIWLNNCVGRKNYRYFVAFVMTGGLCGLYIVGNSIAHVICYKRHMHMTIAESLRHRPMPLVMIFLGFLGAGYPLALVGFHLWIASRGESTHEFVSMNPVTKHVVDGHVGVTLSKCKVMGSHDGFKRFSDAVLAVVCARLCAHVSPHSNPVTKQTTPQGVQKSTFRHWKRF

SEQ ID NO: 67679 - protein, 431 aa, Oryza sativa Indica Group
MAPRSSPAIGGGGGGRVAVDLYPFLRVYEGGHIERLVRSTAAVAASHDDGTATSAAVRPATRDGVATRDVVVDEDTGASARLFLPGGGGEGRRLPLVLYFHGGAFVTGSAFGRLFHRTASRRSTPCPAAFADGWAALRWAASLADPWVARYADPTRLFLAGESAGATIAHNVAARAAGPDGDDVDIEGVALLQPCFWGARWLPSEEAAAAGWRDDEPPMLAPGRLDALWPYVTGGAAGNDDPRIDPPAEDVSSLPCRRALVAVAEKDVLSERGRRYAAQLRGGGREVTLVESEGEDHCFHLYRPARPSAVELMDRVAQFISPASSCLQAEELHLHGRHRTLCHGNATAAAATRSGAPRRQLVVSGGPTTAKLGRPKTKVCGGPACKAQTALCLGPRGMGKAQRHGFVGMGGPMPSGTNKYSVSSAALRVLC

SEQ ID NO: 67680 - protein, 542 aa, Synechococcus sp. RS9917
MNVPNTSEKSFRHSGGVAPVVLTILDGWGYREGSDHNAIRSAQTPVMDALWHAYPHALIEASGAHVGLPDGQMGNSEVGHLTIGAGRIIRQELVRISETVRNGQLGEREALRELAADLRRSGGTLHLLGLCSDGGVHSHVDHLCGLLRWAAAEGLERVAIHAITDGRDTPTDSAPRYIRQVEEAIHSCGVGELASLCGRYWAMDRDHRWERTSKAHALLTDPTLPSSGLSAAEAVAASYAQGTTDEFLEPVRLNDRCLRDGDGLVVFNFRPDRARQLVQALCLEHFDGFERGHHPRLNVVTFTQYEADLPVAVAFPPESLDQLLGQVVAEHGLKQYRTAETEKYPHVTYFMNGGIEQPLDGEDRHLVPSPRVATYDQAPAMAAASLTDSCIAAIEKGVYSLIVINYANPDMVGHTGVMAAATEAIQAVDHCIGRLLDAVGRMGGTMLITADHGNAEVMQGPDGQAWTAHTTNPVPVILVEGERRKVPGLGNAIQLRDNGGLADIAPTLLQLLDLPKPDAMSGASLIEAIDALASRSRLPQPV

SEQ ID NO: 67681 - protein, 258 aa, Xylella fastidiosa Ann-1
MTQSRWRLDGRTALITGASTGIGLAVARELLGLGADVLLVARDADLLGRVRDELAEEFPERELHGLAADVADDVDRRAILDWVEDCSNGLHVLINNAGGNVTRAALEYTEDEWREIFEINLFSAFELCRYTQPLLACHASTAIVNIGSVSGLTHVRSGVPYGMSKAALHQMTRNLAVEWAEDGIRVNAVAPWYIRTRRTSEPLSDLYYYEQVIERTPMRRIGEPEEVAAAVAFLCLPASSYVTGECIAVDGGFMRYGF

SEQ ID NO: 67682 - protein, 77 aa, Oryza sativa Japonica Group
VYAVHFKCNKRLLREYPNLFNYTKDIYQIPGISSTVNMEHIRKHYYGSHPSINPYGIIPAGPNIDYNAPHDRERFSA

SEQ ID NO: 67683 - protein, 354 aa, Aspergillus nidulans FGSC A4
MAPSINEIPISDSPSACRVGINGFGRIGRNVLRVALARNDIQIVAINHTCTSVQDLIYLIRYDSSMGKLSPDIPIHAISETQISVNGRPIALTSERDLKKLNWAALGAEYVVECTGKFTKRELAQDHITYGGAKRVVISAPSSDSPTYVYGVNADEYRANEETRVISCASCTTNCVTPVLKVLQREFGIAQGFLTTVHAATKSQTVLDGYSKKNRRLGRSVFDNIIPTTTGAAKAIASVLPELTGKVTGASIRVPTPNVSLIDLTVSTETPTSLAEILAAFRRAAKNELAGVLSVSDEVLVSSDYLGDSHSAIVDAAACSELNPTFFKIMAWYDNEWGYSSRLLDLTRHIAHNE

SEQ ID NO: 67684 - protein, 535 aa, Ralstonia solanacearum GMI1000
MPTLETKLNPRADDFKANADAMRALVADLRDKVARIARGGGDDARAKHLARGKLLPRERVQQLLDPGTPFLEFSQLAAHGMYDDAAPGAGIITGIGRISGRECVIVCNDATVKGGTYYPMTVKKHLRAQEIAEQNHLPCVYLVDSGGANLPNQDDVFPDRDHFGRIFYNQANLSAKGIPQIAVVMGSCTAGGAYVPAMSDESIIVKEQGTIFLAGPPLVKAATGEVVSAEDLGGADVHTRLSGVADYFANNDAHALAQARGIVAHLNRRKPEQVQIHAPVEPRYAAEELYGVIPTDTRKPFDVREVIARIVDDSAFDEFKARYGTTLVCGFARIWGYPVGIIANNGILFSEAALKGAHFIELCCQRKIPLVFLQNITGFMVGRKYENEGIAKNGAKMVTAVATAQVPKFTVIIGGSFGAGNYGMCGRAYSPRFLWMWPNARISVMGGEQAASVLATVRRDGIEARGGHWSTDEEAAFKAPIREQYERQGHPYYASARLWDDGVIDPADTRSVLGLGLSASLNAPIGEMNFGVFRM

SEQ ID NO: 67685 - protein, 332 aa, Coxiella burnetii
MVLGEPQILGQMKQAYLLARRIGAVGSELGRLFPAVFAATKRIRSETAIGANPVSIAYAVVQLAKRIFSHLNQCQILLIGAGETIELVFSHLYNQGARHFFIANRTLTRAKQIAEPYHAQAIRLSDIPTYLPKVDIVISATMSQLPLVGKGAVESALRQRKRRPLFMADLALPRDIEPETAQLEDVYLYNIDDLQTLIAQNRQTREAAAKQAEAMVEMQAIHYMRQLQVHKAGDTIRRFRERVEMLRDQELEKALAHFQRTNDPKAVIAHFAHNLTNKILHQPTTKLRQAAYEDQVQLLLSAKELFDFMKPSLIEKLKTLILSLFRNRRFIK

SEQ ID NO: 67686 - protein, 154 aa, Brassica napus
  misc_feature (51)..(51): Xaa can be any naturally occurring amino acid
  misc_feature (112)..(112): Xaa can be any naturally occurring amino acid
  misc_feature (124)..(124): Xaa can be any naturally occurring amino acid
  misc_feature (139)..(139): Xaa can be any naturally occurring amino acid
  misc_feature (142)..(142): Xaa can be any naturally occurring amino acid
  misc_feature (147)..(147): Xaa can be any naturally occurring amino acid
  misc_feature (149)..(150): Xaa can be any naturally occurring amino acid
  misc_feature (152)..(153): Xaa can be any naturally occurring amino acid
MATVTSNTPPKSFSSSSSISNPLKPLTPKSPSLRFPPRNNHHHHRLSINAXVSPPPSDTPSPDYRFEILSESLPFIQKFRGKTIVVKYGGAAMTSPELKASVVSDLVLLACXVGLRPILVHGGXGPDINRYLKQLNIPXEFXEGLRXTXXTXXE

SEQ ID NO: 67687 - protein, 526 aa, Coprinellus congregatus
MFKFAVLSQFVALALAAIGPQADLFIGNANVAPDGFQRSAALAGTDANSMVFPGPVIQAFKGETFNINVRNRLADPSMLRTTSIHWHGFLQAGSAWADGPVGVTQCPIAPNRDFLYTFATARQAGTFWYHSHHRSQYCDGLRGAMVVYDPEDPHRSLYDVDNEDTIITLADWYHPPGPVLETLNVATANSTLINGKGRYPTGPTTPLAVVGVTAGKRYRFRLVSISCSPFFTFSIDGHRMTIIEADGESTQPLVVDSIDIHAGQRYSFVLEANQPVANYWIRSNPNRGNRGFAGGLNTAILRYVGAPDADPVKPSDVDVPVPALPLVETNLHPLENPAAPGPPALGGEGVTAIELQIGLQGREWTVNGATFHEPNEPILLQTLNGKQMNELLPNQGSLFPIPRNSVIELTMPGGGAGSPHPMHLHGHMFSVIRSASNSTPNFVNPVRRDVVSLGSNTADRVTVRFVTDNAGPWIMHCHIDWHLVHGLSVVFVEDIEGISDSQRVAEDHPWRQLCPIYEQEKPDNEP

SEQ ID NO: 67688 - protein, 433 aa, Burkholderia xenovorans LB400
MSLNNDAAFWRNARQHLIRYGGTFEPMIIERAQGSFVYDADGRAILDFTSGQMSAVLGHSHPDIVSVIKEYAGKLNHLFSGMLSRPVVDLATRLAEITPDGLDRALLLSTGAESNEAAIRMAKLVTGKYEIVGFAQSWHGMTGGAASATYSAGRKGVGPAAVGSFAIPAPFPYRPRFERDGQYDYLAELDYAFDLIDRQSSGNLAAFIAEPILSSGGIIELPEGYMAALKRKCEERGMLLILDEAQTGIGRTGTMFACQRDGVTPDILTLSKTLGAGLPLAAVVTSAQIEERAHELGYLFYTTHVSDPLPAAVGLRVLDVVEREGLVARANLMGERLRRGLLDLMERFECIGDIRGRGLLLGMEIVKDRRTKEPADGLGAKITRECMNLGLSMNIVQLPGMGGVFRIAPPLTVHENEIDLGLALLGQAIERSL

SEQ ID NO: 67689 - protein, 504 aa, Candida glabrata CBS 138
MPEVFEEINIPQIGRSYKQPIGIFIDNEFVPSSNGEKIETINPATEEVITSFYAATEDDVDKAVKSARESYENVWFKISPAEKRDMLLKLADLIEEEKPLLAALETLDAGKPYHTNAMDDIDQIIHLTKYFAGATDKFTQGKTIPIDHEKLVYTLKSPYGVCGMIIPWNYPLAMASWKMQGCLAAGNTLVIKPAENTSLSLLYLAQLFKKAGFPKGVVNVVPGKGSVVGNSLGLHMDVDKISFTGSTKVGSSILELAGKSNMKDVTLECGGKSPAVVFQDADIDNAIEYIANGIFYNSGQNCTANSRVYVQEDIYDDFIKRFTEHTKENWKFGSKCDPFDKDCTVGPVVSEKQFETVNDYIRHGKEEENLQIHQTVEKCDCKGYFISPTIFTDVPQGSKLMKEEIFGPVVVVAKFKDYKEAIKLANDTNYGLASMVFTKNISVANWFARDIKSGTVWINSSNEEDPTVPFGGFKQSGIGRELGETGVESYMQIKTVHLNMSEKI

SEQ ID NO: 67690 - protein, 522 aa, Oryza sativa
ISTMQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCLLRECTIGHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 67691 - protein, 308 aa, Streptococcus agalactiae 2603V/R
MSKIYNSITDLIGNTPIIQLHHIVPEGAAEVYVKLESFNPGSSVKDRIALAMIEDAEQKGILKAGDTIVEPTSGNTGIGLAWVGKAKGYNVIIVMPETMSIERRKIIQAYGAQLVLTPGSEGMKGAIAKAKEISAEQNAWLPLQFNNQANPEIHEKTTGREIIETFGEKGLDAFIAGVGTGGTITGVSRALKKVNPDVAIYAVEADESAILSGEQPGPHKIQGISAGFIPETLATDSYDHIIRVTSDDAIETGRIIGGLEGFLAGISASAAIYAAIEVAKQLGKGKKVLALLPDNGERYLSTSLYDFE

SEQ ID NO: 67692 - protein, 324 aa, Synechococcus elongatus PCC 6301
MTAQAPTVICLGEMLWDCLANDRDLPAEQVQSWTPWPGGAPANVATALVKLGVQSGLITCLGSDPEGDRLFQVLQDNGVAIAAVQRHPRLPTRQVQVLRTAQGDRQFGGFGAIACDQFADTELQAEQLPQAWFRLAKVLCLGTIPLAYPSSAIAAQQALTWANQQGMTVLLDVNWRPSFWPDPSLAPDRIRAILPQIQQLKLAREEAEWLFDTVDPATIQARQPQLQAVLITDGDRGCHYWVAGWQGHCPSFPVKAIDTTGAGDAFVAAWLAQNTQMDFQWTSAEQVQTAIRWASAAGALTTLNPGAIAAQPTSDAIQSLLSKT

SEQ ID NO: 67693 - protein, 328 aa, Bacillus cereus G9241
MVERLYGHHFHLQDEYFGGSAIDLNGQPLPQRTLAACLASDAVLLGAVGGPRWDSAKERPEKGLLALRKGLGVFANVRPVTVESATAHLSPLKKADEIDFVVVRELTGGIYFSYPKERTDEVATDTLTYHRHEIERIVSYAFQLASKRKKKVTSIDKANVLESSKLWRTVTEEVALRYSDVELEHILVDAAAMELIRNPGRFDVIVTENLFGDILSDEASVLAGSLGMLPSASHAEKGPSLYEPIHGSAPDIAGKNKANPIAMMRSVAMMLGQSFGLTREGCAIEEAISAVLKSGKCTADIGGTETTTSFTKAVMQEMEEQALVGRGR

SEQ ID NO: 67694 - protein, 340 aa, Prochlorococcus marinus subsp. pastoris str. CCMP1986
MTLRVAINGFGRIGRNFMRCWLSRGAYTNIEVVGINVTSDPKTNAHLLKYDSVLGKLDGVDIQYTDDTFVINNKTIKCFSDRNPMNLPWKDWGVDLVIESTGVFNTDIGASKHLEVGAKKVILTAPGKGSGVGTYVVGVNADQYKHSDYDILSNASCTTNCLAPVVKVLDQTFGINKGLMTTIHSYTGDQRILDNSHRDLRRARAAATNIVPTSTGAAKAVALVYPEMTGKLTGIAMRVPTPNVSAVDFVFESSKSVTSQEVNNALKESSLGSMKGIIKYGDEPLVSSDYAGTNESSIVDSDLTMSIGDNLVKVLAWYDNEWGYSQRVVDLAEIVAQKWE

SEQ ID NO: 67695 - protein, 290 aa, Bordetella bronchiseptica RB50
MAPMNSQPSVIAPACEADAERRFGGLARLYGPDAPAALRGAHVAVAGLGGVGSWTAEALARCGVGALTLIDLDHIAESNVNRQIHALSDTLGQAKIEAMAQRIGQINPACAVTRVDEFVAPDNVMQVLGGPYAAIVDCTDQAAAKIAMILHARQRGVPLLLCGGAGGKTDPLALRAGDLSEAVNDALLAKLRNKLRREHGFPRASDANGKVRKRVPRMGVRALWFDQPAILPDAWTRAVEGEDDMGAAGTRAAPQGLSCAGYGSVVTVTAAMGLAAANEVLRWVVGKSGA

SEQ ID NO: 67696 - protein, 295 aa, Prochlorococcus marinus subsp. pastoris str. CCMP1986
MTNLSSPITAKNKFLIFGGGFSGDYFAKSIRKLGCIALASSRSISNEPNSFIFNSEDNSIPEDSIFEGATHILSCIPPDKNGNDPVLKRLKNKIKKLSLKWVGYLSTTGVYGNTHGDWVCEEDQPNPFQERSQRRLNCEREWINSNLPIQIFRLPGIYGPGRSTLEAIRTKKIKVIDKENQVFSRIHVADIANAIIYLIQNKNNLDFHQIINIADDEPCSQIEVIRYSYQLLGLEMPKKILFEEAKKDLSPIAQSFWKENRRVSNKLLCKKLGYKLIYKNYKAGLNNCLLKLNHE

SEQ ID NO: 67697 - protein, 303 aa, Arabidopsis thaliana
MILLMDYNLYLISVVVDGDPYIECKDTRLVVWNPYWGLTRWIEPRYSHHLIGCARFSYALGYVGNISCRSHKLLRFIDYFFHGPELEWYEIYDFESGLWTTLDVTPHWCISLGSHGISIKGNTYWSAITRNSRSHGLTIYDHDHIICFDFTSERFGPLLPLPLNAEYYGDVILSSVKEEKLAVLQQQNRANPYMFDIWITINIEPGHVLWTKFLKVDMETVMETPFKSSESFFIDEKNKIVMSFDETLNPYTISIFGEAGYYRVVNLEQHANTWSRSQMCTYVPSLLQIKQLPLIQVEKCFII

SEQ ID NO: 67698 - protein, 464 aa, Pseudomonas putida KT2440
MAVYNYDVVVLGSGPAGEGAAMNAAKAGRKVAMVDDRRQVGGNCTHLGTIPSKALRHSVRQIMQFNTNPMFRAIGEPRWFSFPDVLKSAEKVIAKQVASRTGYYARNRVDVFVGTGSFADEQTVEVVCPNGVVEKLNAKHIIIATGSRPYRPADIDFHHPRVYDSDTILSLSHTPRKLIVYGAGVIGCEYASIFSGLGVLVELVDNRGQLLSFLDSEISQALSYHFSNNNITVRHNEEYERVEGLDNGVILHLKSGKKIKADALLWCNGRTGNTDKLGLENIGIKVNSRGQIEVDEAYRTTVPNIYGAGDVIGWPSLASAAHDQGRSAAGSIVDNGSWRFVNDVPTGIYTIPEISSIGKNEQELTQAKVPYEVGKAFFKSMARAQIAGEPQGMLKILFHRETLEILGVHCFGYQASEIVHIGQAIMNQPGEQNNLKYFVNTTFNYPTMAEAYRVAAYDGLNRLF

SEQ ID NO: 67699 - protein, 371 aa, Petroselinum crispum
MANPGDGQYTDFPAIQTHGGQFIQYNIFGNLFQVTKKYRPPIMPIGRGAYGIVCSIMNTETNEMVAVKKIANAFDNYMDAKRTLREIKLLRHLDHENVIAITDVIPPPLRREFTDVYIATELMDTDLHQIIRSNQGLSEEHCQYFLYQLLRGLKYIHSANIIHRDLKPSNLLLNANCDLKICDFGLARHNTDDEFMTEYVVTRWYRAPELLLNSSDYTVAIDVWSVGCIYMELMNRKPLFAGKDHVHQMRLLTELLGSPTEADLGFVRNEDAKRFILQLPRHPRQPLRQLYPQVHPLAIDLIDKMLTFDPSKRITVEEALAHPYLARLHDIADEPICTKPFSFEFETAHLGEEQIKDMIYQEALAFNPDCA

SEQ ID NO: 67700 - protein, 406 aa, Gibberella zeae PH-1
MAEPIRGKRAQDAVAPTPQNTPATAAPISSHAQQPGVASIKEEDLDRAAAASVFAQNPKLIQMIQGRLGSLVGQSSGYIESLPAPVRRRVAGLKGIQKDHSKLEAEFQEEVLQLEKKYFAKFSPLYEKRSAIINGKSEPTEDEIKAGEEDDEEVDDDDAATKSETKSDVPDNVSGIPEFWLSAMKNQISLAEMITDRDEAALKHLTDIRMEYLDKPGFRLIFEFAPNDFFSNTTITKTYYYQNESGYGGDFIYDHAEGDKIDWSPGKDLTVRVESKKQRNKNTKQTRIVKKTVPTESFFNFFSPPKAPTDDDDEDAESDIEERLELDYQLGEDIKEKLIPRAIDWFTGEALAFEEISDDELDGADFDDDDDEDEDDLSEENDDEEESDDDDESGKPKQEAAECKQS

SEQ ID NO: 67701 - protein, 99 aa, Synechococcus sp. RS9917
MASYKVTLINESEGLNKTIEVPDDQYILDAAEEQGIDLPYSCRAGACSTCAGKITAGTVDQSDQSFLDDDQIEAGFVLTCVAYPTSDCTIKTHAEEELY

SEQ ID NO: 67702 - protein, 482 aa, Pseudomonas putida KT2440
MLQVPLLIGGQSRPASDGRTFERCNPVTGEVVSQAAAATLADADAAVAAASAAFPAWAALAPGERRSRLLAGADLLQARAAEFIAAAGETGAMANWYGFNVKLAANMLREAAAMTTQITGEVIPSDVPGSFAMALRAPCGVVLGIAPWNAPVILATRAIAMPLACGNTVVLKASELSPAVHRLIGQVLHDAGIGDGVVNVISNAPQDAPAIVERLIANPAVRRVNFTGSTHVGRIVGELAARHLKPALLELGGKAPLLVLDDADLDATVEAAAFGAYFNQGQICMSTERLVVDSCIADAFVDKLAVKIAGLRAGDPQASTSVLGSLVSAAAGERIKALIDDAVAKGARLVSGGQLEGSILQPTLLDNVDASMRLYREESFGPVAVVLRAEGDEALLQLANDSEFGLSSAIFSRDTSRALALAQRVESGICHINGPTVHDEAQMPFGGVKSSGYGSFGSRTAIDQFTQLRWVTLQHGPRHYPI

SEQ ID NO: 67703 - protein, 455 aa, Oryza sativa Indica Group
MPRTSVVESPGCPPLRALTTDILGLIKVVEARTKPAGVAKVVETWGAPDAPRAVLAASLADRAVDPVSVRDLPLFLPAVLAVARKNGVVELLNPLNGETLAGVNAAAGRAAPADSSAEEDPLATLHLFRRHALDSSMLGTFLACTEKGKAYVKSVAKENASSDMAVGPSSSWDVSNSGTVQFSSVDAGESYAMFGGKGIEVNLWDITSCSKIWSAKSPRGNSLQIFTAPWFTAGTFLCKDDHRKIVACTNNHQVRLYDTASQRRPVISVDFRESPIKAVAEDPNGHAVYIGTGRGDLASFDMRTELTLACTLFPGKLLGCFVGKCSGSIRSIVRHPELPLIASCGLDSYLRIWDTNTRQLLSAVFLKQHLTAVVIDSYFSTEELEETKSKQPDPVGAEVRKERKEKKNRTSEMDEDETRMLDHDDSDSEMHTSKRKKSGEKSKGMKKKSKKQQVA

SEQ ID NO: 67704 - protein, 1015 aa, Pseudomonas putida KT2440
MTDLSHPAPRFSASDAEGLAKDFFNVTGTATPLDGERDRNYRLETGVDAGWILKIVNASEPRVESEFQTALLDHLAVHGAHLGVPHLRASVTGDYLPSVASSTGEQHAVRLVSWLAGTPLAKARRSLALMRNFGQALGELDRALQGFMHPGAVRNLDWDLRHAARSRSRLHCIKDPDRRAVAERFIARFEQTVQPKLASLRAQVIHNDANDWNILVDAETPRSVTGFIDFGDAVHTVLIAEVAIASAYAILDMDDPIGAAAALVAGFHEKYPLQAQELDVLFNLIAMRLVISVTFSASRQDQTDDNPYLAISEAPAWRLLEQLDSMNPRLATGILRKACGFDAIEGAGEVRRWIADNHKSFADLVRPSAAILDKVIAPFGDASHEMTIASAQQRPADATRWWNEFSAAHKAPLGIGPWGEVRAVYTDSAFESRFIKGQHRTLHVGVDLLMPAGTPLYAPIAGTVRSVEVEPDPLGYGGLVMLEHTPPGCPPFLTLWGHMAHEALSRLKAGDKLEAGDLVGYMGSDHENGGWIPHLHLQLVTDTQLRACEVIGVGEPAYREAWADLFPDASALAGIPPETYSQQGMTKAQIITRRKELLLPNLSISYTDPIKFVRGDGVWLIDNFGRAYLDCFNNVCHLGHSHPDVVEALTRQAALLNTNTRYLHDNIVEYAERLTGTLPKGLCVASFGCSGSEANSLMLRMARNYTGSDQAIVLDWAYHGTTQELIDLSPYKYKRKAGKGRAAHVYEAVVPDSYYAPEHWPVEAHGKRFAESVAEQLDAMRKAGKRPGFFIAESIPSVAGQVFLPEHYLKEVYAMVRAEGGLCLADEVQVGFGRVGSHWWAFETQGVVPDAVSMGKPIGNGHPMSAVVTTREVADAFNNGMEYFNTFAGNPVSCAVGLAVLDAIERDQLKENALSVGHYLLEGLRKLQQQFDVIGDVRGLGLFLGIVLVTDRKSKAPATALARKVADGARERGVLIGTEGPHDNVLKMRPSMIFSRANADFLLEVLKDSFTAALK

SEQ ID NO: 67705 - protein, 140 aa, Glycine max
  misc_feature (45)..(45): Xaa can be any naturally occurring amino acid
  misc_feature (78)..(78): Xaa can be any naturally occurring amino acid
  misc_feature (106)..(106): Xaa can be any naturally occurring amino acid
  misc_feature (132)..(132): Xaa can be any naturally occurring amino acid
LSTATRAGMVAPFTGLKTMAGFPTSKTNNDITPRASNGGRVSFFXERTPDGKNEVDTLRHLPDDDDAQLAKEPATVLXKGWIPWLEFEKEDGFVYREHKRAPGYYXGRYWTMSDTETFGRTDRSPVLKRLSXGNTGYPQA

SEQ ID NO: 67706 - protein, 495 aa, Catharanthus roseus
LLFCFILSKTTKKFGQNSQYSNHDELPPGPPQIPILGNAHQLSGGHTHHILRDLAKKYGPLMHLKIGEVSTIVASSPQIAEEIFRTHDILFADRPSNLESFKIVSYDFSDMVVSPYGNYWRQLRKISMMELLSQKSVQSFRSIREEEVLNFIKSIGSKEGTRINLSKEISLLIYGITTRAAFGEKNKNTEEFIRLLDQLTKAVAEPNIADMFPSLKFLQLISTSKYKIEKIHKQFDVIVETILKGHKEKINKPLSQENGEKKEDLVDVLLNIQRRNDFEAPLGDKNIKAIIFNIFSAGTETSSTTVDWAMCEMIKNPTVMKKAQEEVRKVFNEEGNVDETKLHQLKYLQAVIKETLRLHPPVPLLLPRECREQCKIKGYTIPSKSRVIVNAWAIGRDPNYWIEPEKFNPDRFLESKVDFKGNSFEYLPFGGGRRICPGITFALANIELPLAQLLFHFDWQSNTEKLNMKESRGVTVRREDDLYLTPVNFSSSSPA

SEQ ID NO: 67707 - protein, 450 aa, Streptococcus agalactiae 2603V/R
MKVVKFGGSSLASSQQLYKVLNIIKSDYTRRFVVVSAPGKRYEEDLKMTDALIQYYQNYINGKDIVKDQTWIINRYQEIISDLSLGSTIAEEITRSIEQLASLPIENNQFLYDCFLAAGEDNNAKLVATFFNQNDIPARYVHPNEAGIIVTKEPCNARIIPGSYDKIENLCLYNEVLVIPGFFGVTEDNQICTFSRGGSDITGSLIAAGIKADLYENFTDVDGIFAAHPGVVKNPHAIPELTYKEMRELAYAGFSVLHDEALLPAYRGRIPLVIKNTNNPQQPGTKIVLKHTRSNIAVTGIASDSRFASINVSKYLMNREVGFGRKVLQILEDLNISFEHMPTGIDDLSIVLREKELTPIKEQEILNYLTRKLEVDYVDIQHNLSTIVIVGENMKSQIGVTATATQALSREKINITMISQGSSEVSIMFVINSKDEKRAIKALYETFFQK

SEQ ID NO: 67708 - protein, 378 aa, Microscilla sp. PRE1
MKIKTRIMSLKSKAAIATGDGAFIIDTTEVSSPQPDEVLVRIRAAGLCHTDHDSLRWGKSIVMGHEGAGVVEQVGNQVDALAPGDKVILNWATPCMQCYQCQEGNQHICENHSPVAAGANGHTPGHAHLEGTQWQGKPIERSFNIGTLSEYTLVKASACVKMDGDIPMSSASIISCGVMTGYGSVVNSARLTAGSSSVVLGTGGVGLNVIQGCRISGASKIIAIDINPQRLEMAKVFGATHTILADKNDLGLMQASEEVKKLTSGRGADYAFECTAISALGAAPLAMIRNAGTAVQVSGIEEEITIDMRLFEWDKLYINPLYGKCRPQLDFPKLESLYHKGELKLDEMITRTYQLEDLQQAFDDMLSGKNAKGVIVFD

SEQ ID NO: 67709 - protein, 492 aa, Arabidopsis thaliana
MSDFSSSVKLKYVKLGYQYLINNFLTLLLIPVIATVAIELLRMGPEEILSVLNSLHFELLHILCSSFLIIFVSTVYFMSKPRTVYLVDYSCYKPPVTCRVPFSSFMEHSRLILKDNPKSVEFQMRILERSGLGEETCLPPAIHYIPPTPTMESARNEAQMVIFTAMEDLFKNTGLKPKDIDILIVNCSLFSPTPSLSAMIINKYKLRSNIKSYNLSGMGCSASLISVDVARNLLQVHPNSNAIIISTEIITPNYYKGNERAMLLPNCLFRMGGAAILLSNRRSDRWRAKYKLCHLVRTHRGADDKSYNCVMEQEDKNGNVGINLSKDLMTIAGEALKANITTIGPLVLPASEQLLFLSSLIGRKIFNPKWKPYIPDFKQAFEHFCIHAGGRAVIDELQKNLQLSGEHVEASRMTLHRFGNTSSSSLWYELSYIEAQGRMKRNDRVWQIAFGSGFKCNSAVWKCNRTIKTPTDGAWSDCIERYPVFIPEVVKL

SEQ ID NO: 67710 - protein, 585 aa, Ustilago maydis 521
MSLSQHIDPEELIEQAADHPILGLLEHPAGKHARAYHSGAHAGRYVTEPIPKYKIPQKGTDAEATYELLSSELSLDGKPTLNLASFVHTWMPKEATKLMSETMMVNLCDQDEYPATMSFHNRAVSMLADLWKAPTEKDENGKRKPAMGVATTGSSEAIMLACLAAKKRWQHRMKAQGKSFKEPGPNMVFGSNAQVAIEKFARYFDVEERLVPVSHESRYCLDINKAIEMVDENTICVVVILGSTYTGHYEDVEGMSKLLDEYESKTGISIPIHVDGASGAMVAPFATPELKWSFEIARVASINTSGHKFGMVYPGLGWVLFRDNEQVPKELIFELHYLGSVEYSFGLNFSRPAHPVIGQLFNFINLGFEGYRRVMQSDLQNARLLSRALENSGLYQVLSEIHKPVSSPSAATGAAALIQQAGSKLTSSTQSHEQLNQHSAEMYRPGLPVVSFRWSEDFRKRNPNLEQRWMQTLLRAKGWIVPNYNLSPDLEHIDILRVVVRENLSETMIEQLVYDIITITQSLEKQANDGGFRHLAELTSSKHDDSTAAKDAEKSTGHHNAAHDKHRGGLPKDSGVQAKGYAKQC

SEQ ID NO: 67711 - protein, 402 aa, Daucus carota
MVATTLESPRVETLAGSGIQLIPKEYVRPKDELISITNIFEEEKSDEGPQVPTVDIADILSEDKAVREKCYERIKDAAVEWGVMHLVNHGISNELMDRVRVAGQAFFAEPIGEKEKYANDPGTGMIQGYGSKLANNASGQLEWEDYFFHLVYPEEKADLSIWPKRPQDYIPATREYAKELRGLATKLLSALSFGLGLEEGRLEKEVGGMEELILQMKINYYPKCPQPELALGVEAHTDVSALSFILHNTVPGLQLFYGGKWVTAKCVPDSIIVHIGDTLEILSNGKYKSILHRGLVNKEKVRISWAVFCEPPKEKIILKPLPETVTEAEPPLFPPRTFAQHMAHKLFRKSQEAIDDSKKVQPQEQNNAETDIPQPEEQQKTEESNPQKIEILKPGEEASSSP

SEQ ID NO: 67712 - protein, 422 aa, Pseudomonas aeruginosa PAO1
MAFIALGINHKTASVAVRERVAFTPEQMVEALQQLCRLTTSREAAILSTCNRSELYLEIDHPTADDVLAWLADYHRLTLDELRACAYVHQDEDAVRHMMRVASGLDSMVLGEPQILGQMKSAYAVAREAGTVGPLLGRLFQATFSTAKTVRTDTAIGENPVSVAFAAVSLAKQIFSDLHRSQALLIGAGETITLVARHLFEQGVKRIVVANRTLERASLLAEQFGAHAVLLSEIPEELANSDIVISSTASQLPILGKGAVERALKQRKHKPMFMVDIAVPRDIEPEVGELDDVYLYSVDDLHEVVAENLKSRQGAAQAAEELVGSGVAEFMQRLRELAAVDVLRAYRQQAERLRDEELGKAQRQLANGADPAEVMAQLARGLTNKLLHAPSVQMKKMSAEGRIDALALAQELFALDEGAPRH

SEQ ID NO: 67713 - protein, 389 aa, Daucus carota
MVATTLESPRVETLAGSGIQLIPKEYVRPKDELISITNIFEEEKSDEGPQVPTVDIADILSDDKAVREKCYERIKDAAVDWGVMHLVNHGISNELMDRVRVAGQAFFAEPIGEKEKYANDPGTGMIQGYGSKLANNASGQLEWEDYFFHLVYPEEKADLSIWPKRPQDYIPATREYAKELRGLATKLLSALSFGLGLEEGRLEKEVGGMEELILQMKINYYPKCPQPELALGVEAHTDVSALSFILHNMVPGLQLFYGGKWVTAKCVPDSIIVHIGDTLEILSNGKYKSILHRGLVNKEKVRISWAVFCEPPKEKIILKPLPETVTEAEPPLFPPRTFAQHMAHKLFRKSQEAIDDSKKVQPQEQNNAETDIPQPTEQQKTEESNPQKI

SEQ ID NO: 67714 - protein, 384 aa, Prochlorococcus marinus subsp. pastoris str. CCMP1986
MAIQQKLSLMIPGPTPVPEKVLQALGRHPIGHRSKDFQDLMEITTKNLQWLHQTKNDVLTITGSGTAAMEAGMISTLSKGEKVICGVNGKFGQRWVKVAKEFGLEVIKIEAEWGKPLDPKDFKTILEKDDKKEIKAVILTHSETSTGVINDLKTISSHIRNHKKALSIIDCVTSIGACSVPVDDWELDVVASGSQKGYMIPPGLSFVSMSDKAWQASENSNLPKFYLNLKSYKKSLLSNSNPYTPAVNLVFALDESLKMMKDEGLDKIFKRHERHKLAVSEAAKTLNLKLFADENHLSPAVTAIQIEDIDAEQFRKNIKNKYDILLAGGQDHLKGKIFRVGHLGYINDRDIITVIAAIGNTLVEQNIISTDTAGKALKIASCHL

SEQ ID NO: 67715 - protein, 528 aa, Prochlorococcus marinus subsp. pastoris str. CCMP1986
MSKKLLKKERDPSILILDFGSQYSELIARRIREADVFSLVVSNFTSVKEIQDINPKGIILSGGPSSVYEDNAPKCDAKIFDLGIPILGICYGMQLMVKELGGEVTPAINKAEYGRAPINIDCESDLLSNVQDKSIMWMSHGDSINNLPEGFIKISHTENTLHAAISNKQKKLFGVQFHPEVIHSEFGMTVIKNFVYSIAKCKADWTTETFLEETIPRIKQQVGDKRVLLALSGGVDSSTLAFLLNKAIGKKLTCMFIDQGFMRKGEPEFLMEFFDKKFHIKVEYINARERFIDKLNGITDPEEKRKIIGREFIRVFEEESNRLGPFQYLAQGTLYPDVIESAGTNLDPKTGERIAVKIKSHHNVGGLPKDLQFKLVEPLRKLFKDEVRKVGGALGLPDEIIKRHPFPGPGLAIRILGDVSHEKLNCLRDADWIVRDEIKKAGLYNDIWQAFAVLLPVKTVGVMGDKRTYAWPIVLRCVSSEDGMTADWSRIPYETLERISNRIVNEVEQVNRVVFDITSKPPGTIEWE

SEQ ID NO: 67716 - protein, 313 aa, Pseudomonas aeruginosa PAO1
MSKMMVFTGNANPDLARRVVRQLHIPLGDVSVGKFSDGEISVEINENVRGKDVFLIQPTCAPTNDNLMELVVMADAFRRSSATRITAVIPYFGYARQDRRPRSARVAISAKVVADMLTVVGVNRVLTVDLHADQIQGFFDIPVDNIYGSPVLVDDIEDQRFENLMIVSPDIGGVVRARAVAKSLGVDLAIIDKRRPKANQSEVMHIIGDVEGRTCVLVDDMVDTAGTLGHAAKALKEHGAAKVIAYCTHPVLSGRAIENIEKSVLDELVVTNTIPLSAAAQACGRIRQLDIAPVVAEAMRRISNEESISAMFR

SEQ ID NO: 67717 - protein, 453 aa, Zea mays
MKERGGSRAAVDERYAQWKSLIPVLYDWFANHNLVWPSLSCRWGPQFEKATYKNRQRLYLSEQTDGSVPNTLVIANCEVVKPRVAAAEHISQFNEEARSPFVKKYKTIVHPGEVNRIRELPQNSKIIATHTDSPDVLVWDVEAQPNRHAVLGASESRPDLILTGHQENAEFALAMCPAEPYVLSGGKDKFVVLWSIQDHISALGDSSSSPGASGSKQSGKIANEKESPKVDPRGIFHGHDSTVEDVQFCPSSAQEFCSVGDDACLILWDARTGTDPAVKVEKAHSGDVHCVDWNPLDVNYILTGSADNSVRMWDRRNLGSGGAGSPIHKFEGHKAAVLCVQWSPDRASVFGSSAEDGFLNVWDHEKVGKKKNSNVPAGLFFQHAGHRDKIVDFHWNSSDPWTIVSVSDDGESTGGGGTLQIWRMSDLIYRPEDEVLTELENFKAHLASCAPRN

SEQ ID NO: 67718 - protein, 278 aa, Glycine max
MKENYSYQSYPDSGESSPRSREIDFESPPPWDHQNYKAKFICSYGGKIHPRSHDNQLSYVGGDTKILAVDRSIKFPAMLAKLSALCDAQDNNITFKYQLPGEDLDALISVTNDDDLDHMMHEYDRLYRASARPSRMRLFLFPSDTPPSPPPASAPPDTVIKPNNVDFLFALEKNVAVPAPPPPQPPPVSVKFNDPLPEPVAPQPEYRSRLNFNPAVSDPSAIQRQLHQLQIAENEKASYWRKNEDNYPAGDYYVQKMPEKFPPANFPASAPGYWPEKH

SEQ ID NO: 67719 - protein, 401 aa, Triticum aestivum
MDYMNGPGRNHLFVPGPVNIPDQVIRAMSRQNEDYRSPAIPALTKTLLEDVKKIFKTTTGTPFLFPTTGTGAWESALTNTLSPGDRIVSFSLGQFSLLWIDQQQRLGFSVDVVESDWGYGADLGALESKLRTDSQHTIKAICIVHNETATGVTNDLHAVRKLLDAYRHPALLLVDGVSSICALDFRMDEWGVDVALTGSHKALSLPTGLGIVCASPQALEAAKTAKSVRVSFDWEDYLEFYRMGTYWPYTPSIQLLYGLRAGLDLLFEEGLDNVIKRHTRLGTATRLAVAAWGLKNCTAKEENFSDTVTAVVVPPYIDSSEIVKHAWKRYNLSLGLGLNKVAGKVFRIGHLGHLNELQLLGCLSGVEMVLKDIGYPVKLGSGVAAAAAYLSNSTPLIPSRI

SEQ ID NO: 67720 - protein, 366 aa, Pseudomonas aeruginosa PAO1
MGFNCGIVGLPNVGKSTLFNALTKSGIAAENFPFCTIEPNSGIVPMPDARLNALAEIVKPERVLPTTMEFVDIAGLVAGASKGEGLGNKFLANIRETDAIAHVVRCFEDDNVIHVSNSVDPKRDIEIIDLELIFADLDSCEKQLQKVARNAKGGDKEALAQKALLEKLIPHFTEGKPARSLLKNLGDEEKRLVRSFHLLTSKPVMYIANVAEDGFENNPHLDVVKAIAEEEGAVVVPVCNKIEAEIAELEDGEEKDMFLESLGLEEPGLNRVIRAGYGLLNLQTYFTAGVKEVRAWTVRVGATAPQAAGVIHTDFEKGFIRAEVVAYDDFIQFKGEQGAKEAGKWRLEGKDYIVKDGDVMHFRFNV

SEQ ID NO: 67721 - protein, 502 aa, Vitis vinifera
  misc_feature (437)..(437): Xaa can be any naturally occurring amino acid
  misc_feature (465)..(465): Xaa can be any naturally occurring amino acid
MGGSRVQVNKAHKTRFSSKSSRQVHKTSLQEKSRITKPGSNVAKGAKAARLQRNKMIRDQKRAAILKEKRASSGSTSPPRVIFVETGIALTISELGFDNSMYYMLLQVIFGLSASVNVNSVEDDLLTLLSSKGNEPVFSTVASSEYKLRTTVGYCTMFSSAGYMVLKAPHGDLSSCIEMVKVADLIAFVASASCSCEEGTSNYYIDSFGTQCLSVFRALGLPSTVVLIRDLPPEQKQRHELKKMCSSSLSSEFPEDCKFYPADTKDELHKFMWLFKEQRLSVPHWRNQRSYLMAQKVDLVPDDCNSGNCTLLLTGYLRAHGLSVNQLVHISGAGDFQLSKIEILKDPFPLNARKGQDLMDSDELNDEQVIRSLAPDKLKQEPLIIENVPDPLAGEQTWPTEAEMAEADRNQKQKNLKKRILPRGTSEYQAAWIVDDXDVEDSDRSDDDDAGDGMVLDENESGLPXHEGNNNFDLDDDQASLSLDSRDNDEQTDVDSVMMVSS

SEQ ID NO: 67722 - protein, 821 aa, Moorella thermoacetica ATCC 39073
MKAIIMAGGEGSRLRPLTCKRPKPLVPVANRPVMEYCVDLLRELGIKEVGVTLQYLPQLIEEYFGDGSDFGLHLHYFVEDKPLGTAGSVKNAAAILDETFVVVSGDALTDFDLRPAIARHKESGALATLVLTAVDNPLEYGVVITNPDGSIRSFLEKPSWGEVFSDRVNTGIYILEPEVLELIPEGRPFDFSKDLFPRLLKEKRPLYGVTLSGYWCDIGNLTQYRQAQEDILRGRVKVRVVGQDKGGGVVMGEGVEIAPGARIEGPVLIGGACHIATGAVVGPFTVLGPYTRVEEGATVRRSVLWDNVYTGEGANVRGAVVCSRASLQRRVQVYEGAVIGDGTQVDAGAEVRPEVKVWPEKTLGRETVVHESLIWGRGVARPLFVGSQAPGYLHGDLTPFQVTRLGMAYGASFPPGTTVGLSTFAGGAGEMLYKALAAGLMAAGVQVADLGRLLTPIHRFAVRSLGLDGGCHIKRDAAERDKVWLHLVNSRGHDLNPAAVRKIENLYWREDGRRVQEVPASIYFPGLEGAYRDWLLATLGDHGLKKRALRVALGGQGQVAGVAGTILQDAGAEVIRLDLDPAKTWQAVQEDLPYFAGEIRRYGADLGAALDSNGEELILFTGEGRRVAPAQQMTLLARVYLETHRGASLVLPVTAPRVLEQVAGGLHGRVERVKGHPGIYHEAMARADGETALGQQHLQLDALAALVHILDWLASREESLDSAVAALPPVYTASRTVACPWEAKGRVMRTLISEEPADGVELLDGVQVRHGKGWSLVLPDGETPHYHIYSEAFSQEAAEELAGFYEERLKELIAREKSKGR

SEQ ID NO: 67723 - protein, 389 aa, Arabidopsis thaliana
MTMMSDLTQDLVEEILSRVPITSLGAVRSTCKGWNALSKERILCIGEPKQQFLGFMMLDYRLCSMRFNLHGILNEDFVSISMYQVETSQVFYCAGLLLCVTREKSSRLIIWNPYLGQTRWINTKTTKTGYNTYALGCDNNKNHKILKVFCDDYQCYYEIYDVKSNSWSAFNVTDPNWHIDYDICALVNGNTYFLTKERILVEDSDEDEDEVETPEILICFDFTAERFGKFLHLPFQFDIDFGDTGGLSCVKEEKLAVLLKRYDQNVIEIWVTTKIEPNVVFWKPFLKVDIETVLGALLDFQLDSFFIDEEKKLAVVFSSNKSKCYKTAYIIGEDRYLKEVDLGECKPLRSPIVCFSSYVPSLVQINQIAVPKRRENKRKRKSKGKGREV

SEQ ID NO: 67724 - protein, 284 aa, Escherichia coli
AGKPTDKPNLVCGPVQISWHKFARYWDVELREIPMRPGQLFMDPKRMIEACDENTIGVVPNFGVTYTGNYEFPQPLHDALDKFQADTGIDIDMHIDAASGGFLAPFVAPDIVWDFRLPRVKSISASGHKFGLAPLGCGWVIWRDEEAVPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEM

SEQ ID NO: 67725 - protein, 213 aa, Zea mays
RPGKCPSSVFLLCRLPSSTPLPSPHHLQPRLSTAAQASLRLRSARAADVLKSKGKSADGSWLWCTTEDSVYDAVKSMTQHNVGALVVVKPGQNKSIAGIVTERDYLRKIIVQGRSSKSTKVGDIMTEENKLITVNPDTKVLQAMQLMTENRVRHIPVIDGTGMLGMVSIGDVVRAVVAEHREELNRLNDYIQGGYGRRVQRRPPPIAVSEVRL

SEQ ID NO: 67726 - protein, 225 aa, Salmonella typhimurium LT2
MKQYLIAPSILSADFARLGEDTAKALAAGADVVHFDVMDNHYVPNLTIGPMVLKSLRQYGITAPIDVHLMVKPVDRIVPDFAAAGASIITFHPEASEHVDRTLQLIKEHGCKAGLVFNPATPLSYLDYVMDKLDVILLMSVNPGFGGQSFIPQTLDKLREVRRRIDASGYDIRLEVDGGVKVNNIGEIAAAGADMFVAGSAIFDKPDYKKVIDEMRSELAKVTHG

SEQ ID NO: 67727 - protein, 335 aa, Haemophilus somnus 2336
MKTLGQFIVEKQAEYPNAKGELSGILSSLRLVAKIIHRDINKAGLTNNIIGNSGVENVQGETQMKLDLFAHNTMKQALITREEVAGFASEEEENFVAFDTERGRNAKYVILTDPLDGSSNIDVNVAVGTIFSIYRRVSPIGTPVTLEDFLQPGHKQVAAGYIVYGSSTMLVYTTGNGVNGFTYDPSLGVFCLSHENIQIPPNGKIYSINEGQYLKFPMGVKKYIKYCQEKDKSTDRPYTSRYIGSLVSDFHRNMLKGGIYIYPSATTYPKGKLRLLYEGNPMAFLAEQAGGIASDGKDRILDIQPKELHERVPLFVGSREMVRKAEEFMREFSEE

SEQ ID NO: 67728 - protein, 244 aa, Streptococcus agalactiae 2603V/R
MQLKDKNIFITGSSRGIGLAIAHQFAQLGANIVLNGRSEISEDLIAEFADYGVKVIAISGDVSSFEDANRMIKEAIASLGSVDVLVNNAGITNDKLMLKMTVEDFESVLKINLTGAFNMTQSVLKPMTKARQGAIINISSVVGLTGNVGQANYAASKAGLIGFTKSVAREVAARGIRVNAIAPGFIESDMTDVIPEKMQEAILAQIPMKRIGKGKEVAQVASFLAEQEYLTGQVIAIDGGMTMQ

SEQ ID NO: 67729 - protein, 258 aa, Ralstonia solanacearum
SVKNAAVNVPYGGAKGGIRVDPRKLSSGELERLTRRYTSEIGIIIGPNKDIPAPDVNTNAQIMAWMMDTYSMNEGSTATGVVTGKPIALGGSLGRREATGRGVFVVGSEAARNLGIDIKGARIVVQGFGNVGSVAAKLFHDAGAKVIAVQDHKGIVFNGAGLDVDALIQHVDHNGSVAGFKAETLSADDFWALECEFLIPAALEGQITGKNAPHIGAKIVVEGANGPTTPEADDILRERGILVCPDVIANAGGVTVSY

SEQ ID NO: 67730 - protein, 180 aa, Brassica napus
MQPSGLKETQLNNNNNNQKVHPQPMEQQQSINQNPEAMEALISNLFGNISSLKSAYIQLQSAHTPYDPDKIQEADKVVISELKSLSELKHLYRENNPKPVCVSPQDSRLAAEIQEQQSLLKTYEVMVKKFQSEIQNKDSEIKQMMEKIEEANQKRLKLEKNLKLRGMGDGGGGGGMEFLT

SEQ ID NO: 67731 - protein, 336 aa, Pseudomonas putida KT2440
MSLETASTPHTTRPEPSRRFSVAPMMDWTDRHCRFFLRLLSRQTLLYTEMVTTGALLHNDAHRFLRHDASEHPLALQLGGSVPADLAACARLAEEAGYDEVNLNVGCPSDRVQNNMIGACLMAHPALVADCVKAMRDAVSTPVTVKHRIGINGRDSYAELSDFVGQVREAGCRSFTVHARIAILEGLSPKENREIPPLRYDIAAQLKRDFPDLEIVLNGGIKTLDECQAHLETFDGVMLGREAYHNPYLLAEVDQQLFGSDAPVVSRSEALAQLRPYIVAHMESGGAMHHVTRHILGLAQGFKGARRFRQLLSADIHKAAEPLAVFDQAVELLQGR

SEQ ID NO: 67732 - protein, 458 aa, Methylococcus capsulatus str. Bath
MQERAPVIGSIAEVHGPVVVIACQTLPPLRQALYSRIDHETYLFEVHQHLDESHVRAVTLHRTTGLKRGMVVHDLGAPLQVPVSTACLGRLVNLFGEPLDNGPPLPDSEYRDAHRPPAPLAESRAAGETLETGIKVIDLLCPFARGGKTGLFGGAGVGKTVLIMEFMHAVSALHRGVSVFAGVGERIREGHELWRELAEAGVLDKSLLVYGQMDESPGVRFRVGLTALTYAEYLRDTLHTEVLFLIDNVFRFVQAGSEISSLLGRMPATVGYQPTLATEVAEIEERITSTAAGAITSVQAVYVPADDMTDPAVAAILSHLDTTVVLSRVQAGKGIYPAIDPLASTSRLMDRHVIGDRHYGIAQGVREHLARYRELEDIITMLGIEELSPQDRLLVLRARKLQRYLTQPFFVTAQHTGLAGVSVPLDATLGDCEGFLTGRYDDLAEEDCYMRGTLGRGS

SEQ ID NO: 67733 - protein, 426 aa, Phalaenopsis sp. SM9108
MAFSVGLTRFIVSSHPKTAKEILSSPAFADRPIKESAYELLFNRAMGFAPFGDYWRNLRRISSTYLFSPRRVSSFEKQRSEIGEGMVRDMKRMMERNGVVEVRRMLHYGSLNNIMLTVFGKKFDFAKDEGLELELILKEGYELLGIFNWGDHLPLLGWLDLQGVRRRCRTLVAKVNVFVKKIIDEHKRRANGVGIDEGEGEDFVDVLLGLEEKDRLSESDMVAVLWEMIFRGTDTVAILLEWTLARMVLHPDIQSKAQVEIDSVVDSSRPVLDSDIQRLPYLQSIVKETLRMHPPGPLLSWARLAIHDVPVDGHMIPAGTTAMVNMWAITHDECNWAEPNKFNPDRFIDEDVNILGSDLRLAPFGSGKRVCPGKTMALAAVHLWLAQLLKSFKLLPSRNGVDLSECLKMSLEMKNPLVCVAVPRFE

SEQ ID NO: 67734 - protein, 1042 aa, Oryza sativa
MDVVWPHGHGVWGSSSASRRSAMLHGSLDIWIHEARNLPNMDIVSKTVVDILGTKKKKKAANGAMTSDPYVTVQLASATVARTYVVNDDENPVWAQHFLIPVAHEAPAVHFLVKDSDVFGAELIGEVVVPAEQLEAGEHVEGVYPVLDPAAGKPCAPGAVLRLSVQYIPVARLTMYHHGVTPGPDFAGVPNTYFPLRRGGRVTLYQDAHVPEGSLPEIRLGNGALYRQGQCWHDVYDAISQARRLIYITGWSVFHTIQLVRDGGAGVSLGDLLKRKSQEGVRVLLLVWDDPTSRNVLGIQMEGYMGTRDEETRRFFKHSSVQILLCPRSAGKRHSWVKQQKTVILDADAGNHKRKIVAFVGGLDLCGGRYDTPTHPLFRSLQTLHKDDYYNPNFAVLDAQGPREPWHDLHSKIDGPAAYDVLTNFEERWLKASKRSGVKKLSKANNDTLLWIGRIPDIASIDDEVYSSDNDPERWDVQIFRSIDSNSVKGFPKNPREATSANNLIPIEIALKIANKIYANERFSAYIVIPMWPEGNPTGAPTQRILYWQDYLNFFCLGNREAGGSPSTCRGSSSANNPQDQAKKNRRFMVYVHSKGMIVDDEYVIIGSANINQRSMEGTRDTEIAMGAYQPQYTWANMLSAPRGQIYGYRMSLWAEHIGAVEESFSCPESLECTRQVRHIGEQNWRQFASSEVSEMRGHLVKYPVSVARDGKVKPLPGCAAFPDLGGNICGTGRVYTASRRRSQAAAHGLQPLPGCREDRTLKGESSESNGDEGITSRVAKSLHSLMPPKRKRAAAMETAGGDAAPPPQQQRRNKSSAANKGKKGGASGGGGGGRWPPVKPKKDLQVNRLKGTHLLTVPNFFTSAEAKAFVDIAENIGFTHQGSLGPLKGEAYRDNDRISVTDPLLAQTIWESGINKIFEDISISGKVATSLNPNIRFYRYTEGQRFGRHIDESVDLGDGSRTLYTLLIYLSGKGSAKESSGQALVGGETVFYDHRGGVVAEVAPVQGLALLHLHGAKCMLHEARVVKKNIKYVLRSDVVFA

SEQ ID NO: 67735 - protein, 299 aa, Geobacillus thermoleovorans
MARTVNSITELIGDTPAVKLNRIVDEDSADVYLKLEFMNPGSSVKDRIALAMIEAAEKAGKLKPGDTIVEPTSGNTGIGLAMVAAAKGYKAVLVMPDTMSLERRNLLRAYGAELVLTPGAQGMRGAIRKAEELVREHAYFIPQHLKRANPEIHRLTTGKEIVEQMGDQLDAFVAGVGTGGTITGAGKVLREAYPNIKIYAVEPADSPVLSGGKPGPHKIQGIGAGFVPDILDTSIYDGVITVTTEEAFRGPRAAREEGILGGISSGAAIHAALKVAKELGKGKKVLAIIPSNGERYLST

SEQ ID NO: 67736 - protein, 433 aa, Arabidopsis thaliana
MRVIPEEGDVFSSSKSNGSSMGIELQPDLVSFGTLAAEMIPTTMDSPEVEDEEFDLDRPTDGFASIPQAIEDIRHGKMVVVVDDEDRENEGDLIMAASLATPEAMAFVVKHGTGIVCVSMKGEDLERLELPLMVTRKDNEEKLRTAFTVSVDAKKGTSTGVSARDRAQTILTLASKDSKPEDFNRPGHIFPLRYREGGVLKRAGHTEASVDLTVLAGLEPVSVLCEIVDDDGSMARLPRLRQFAQENNLKLISIADLIRYRRKRERLVEFTAVAPIPTMWGPFKAHCFKSLLDGVEHIAMVKGEIGDGKDILVRVHAECITDDIFGNSSGGKQLAIAMRLIEENGRGVFVYLRGPESKGIDLSHKPRTYNTNSDQAEGVSFPVASREYGIGAQILRDLGVREMKVMTNNPAHYVGLKGYGLSISGKVPLITTP

SEQ ID NO: 67737 - protein, 348 aa, Oryza sativa Indica Group
MDVLRKQASKFKEQVAKQQQAVIKQFSTTGYEHSDAVVIDEVELQRHQQLEKLYTSTRSGRDFQKDIVRAAEGLVSIGIRHVEVGTKFSEDCYRYGGESSASDEALAKAASLYGGALRNVEKEYEEFNRILSSQTIDPLRAMAAGAPLEDARGLAQRYSRMRHEAEILSAEIARRKQRVREAPVAEHTTKLQQSESKMIEHKASMAVLGKEAAAALAAVESQQQRITLQRLVGMVEAEKLFHLRLAAILDDVEAEMSSEKQKRESAPPTIHSHKRAEKAQYFLAEAVHNFNGTTEKELSLIVGDYVVVRQIAPNGWAEGECKGVAGWFPAAYVERRENIPPNKVFPQA

SEQ ID NO: 67738 - protein, 380 aa, Neptuniibacter caesariensis
MGPGPSDVSPRVLAAMARPTIGHLDPEFIRMMDEVKGMLKKLFKTENELTLPVSAPGSAGMEACFVNLVEPGDKVIVCQNGVFGGRMKENVERFGGECILIQDEWGTPVDVEKVKAAFAENDNVKALAFVHAETSTGVRSDAKSLCQIAHDNGALAIVDAVTSLGGIDVDVDGWGIDAIYSGTQKCLSCPPGISPVSFSDKAVEAVKNRKTAVPSWFLDKNLVMGYWGGSGKRAYHHTAPVNSLYALHEALVMMEEEGLENAWARHQKLHNALRAGLEAMGIGFLVNEESRLPQLNSVLIPEGVDDAAVRTALLQNYNLEIGAGLGNLAGKVWRIGLMGTACTQRNVMLCLDALENTLAAMNAPIKTGVAAQAAAAVLAE

SEQ ID NO: 67739 - protein, 256 aa, Gibberella zeae PH-1
MADKIQDSHTTPVGPAYRTHQQKPSATVSVDVNLDNVHVLPQTPQLIALLSMIRSKETERADFIFYSNRIIRLLVEEGLNHLPVIEHTVTTPIGRTYNGLMFQGKICGVSIMRAGEAMEQGLRDCCRSVRIGKILIQRDEETAQPKLFYDKLPEDIADRWVLLLDPMFATGMTTSRHVPQTARGSATMAVQVLKARGVPEEHILFLNLIASPEGVKNFSAKFPRLRVVTAFIDEGLDEKNYIVPGLGDFGDRFYTI

SEQ ID NO: 67740 - protein, 507 aa, Gibberella zeae PH-1
MAANDQQSDMLEALQEIQRTQALLVNAVESLSGRSIDEATGDHAKNNNGDLGSGEDANDGETPSVELPIASGDKLKAPAPPSTAQRQQGLTSRIILTTYPKQIGINPLPMDWGNSDPVKRGPIVVSRAATSIRRRNAVGGYLAHGGSYSIYYALAVASKELDSDHRPDFTNTEPAANIGPFPQWGDHKKIVAMDPWGHLAPWLFKDTIEKDNVDIRPTIAITKAHMKLPELAESVKAGRLVPDGKVCLNDQGELAVTKFAVEPVWYLPGVAERFGIDEATLRRSLFEHTGGSYPELITRGDIKVFLPPIGGLTVYCFGDPAKMSDESVKLSLRIHDECNGSDVFGSDICTCRPYLIFGIEEAVKEAQNGGSGVVIYFRKEGRALGEVTKYLVYNARKRGADRASDYFKRTENIAGVKDMRFQALMPDILHWLGIKKIDRMLSMSNMKHDAIVGQGIPIHERVELPEELIPADSRVEIDAKITAGYFTTGKRMTTEELQAVQGRIWEE

SEQ ID NO: 67741 - protein, 316 aa, Pseudomonas putida KT2440
MHEHDVLCFGETMAMFVAEQAGDLAGVGQFGKRIAGADSNVAIGLARLGFKVRWLSRVGDDSLGRFVLDSLRCEGLDCSGVEVDANYPTGFQLKARSEDGSDPAVEYFRRGSAASRLSAAMVSPVWLQARHVHATGIPLALSDSCRALSHALLDGMRAAGRSISFDPNLRPSLWPDQSSMVREINALAAKADWVLPGLEEGRLLTGQHTPADIAAFYLDQGVELVVIKLGDAGAYFRSAKGEGQVAPVPVSRVVDTVGAGDAFAVGVLSALLEGRPVAEAVARGNWCGSRAVQSRGDMEGLPLRHELEAYDLRRSA

SEQ ID NO: 67742 - protein, 182 aa, Neptuniibacter caesariensis
MKLPNILTSLRILLIPVFVLVFYLPYDWAPLATGCVFAIAGFTDWLDGFVARKLNQTSPFGAFLDPVADKLMVAISLALLVESYNNIWITIPAIVIIGREIVISALREWMAEIGQRASVAVSYIGKLKTALQMLAIMLMVVTEPYTNISWAGIVALYLAAILTLWSMYQYLRAAWPVLSEEM

SEQ ID NO: 67743 - protein, 573 aa, Oryza sativa Indica Group
MAAAGRVPGVALATRLPRRRVPRCPPCRRLSHPLPLRSQEPSSASSKKRPPLRRGKISPQLPVPEHIPRPSYVGSNRPQELSSVRQIHSAEGIAGMRAACKLAARALDFAGTLIKPSVTTNEIDREVHNMIIEAGAYPSQLGYGGFPKSICTSLNECVCHGVPDSTQLQTGDIMNVDVNVFLNGYHGGASRTFVCGEVDDSIRHFLKAAEECLEKGITVCRDGVNYKKIGKKISKLAYFYGYYVVDRFVGHGIGPIWHSEPLILHHANDNSGRMVEGQTFTIEPILTMEKAETVTWEDGWTTVTADGSWAAQFKHTVHMWQDYRSQAEELIDEICDESSVPGEWLVRRVCGSLEFYESRRPAAALPLSRSISGEEYEDLMPVMTGWLGDLASGTITVESPAVAGPVLLGCRHHRARPSQSQLCDVCCLPQLSRGGRLAAGRGARGSGAAWFKKPKTTFRREIMGELLVMSWDCRCGCFRRPPAVAAEVVLLLDRRPRRCFFPFSPGVRVGAMSSPEIQKLADEVCSAAAQSVPSVCYCSASFVDLRHIWYGYELEYWTIGERRRAIASLQRSA

SEQ ID NO: 67744 - protein, 436 aa, Bacillus anthracis str. Ames
MRDYLIKPLVGQPYPMISHGKGVYLYDQNGNKYFDGSSGAITAGIGHGVKEIADVIKKQAEEIAFVYRSQFTSEPAEKLAKKLSDLSVGDLNWSFFVNSGTEANETAMKIAIQHFQERGIQGKHKILSRWMSYHGITMGALSMSGHPLRRQRFVSILEDYPTIPAPYCFRCPVQKVYPTCQLACATELERSIERIGAEHIAAFIAEPIIGAAGGAVVPPKEYYKVIKDICSHYDILFIADEVMTGLGRTGAWFAMEHWGVEPDIMTLGKGLGAGYTPMAATVVSDRVMEPILRGSRSVMSGHTLSANPLSAATALAVIEYMEKHNLPEKTAEKGEYLIKGLQKVQQQSTIIADVRGKGLLIGVELQPFSKASELISVAAKNGLLLYQAVSGQAGKEDSALLVAPPMTTTYSELDELLSIFAKSVEEMMQKGGHSIA

SEQ ID NO: 67745 - protein, 383 aa, Cryptococcus neoformans var. neoformans B-3501A
MVFGLLCRWACNICSYLYPAYASYKALSIHPESSPEAMAQVERWLMYWAVVGTWTAVEAIIGWTITWMPFYSLIKTFVFLSLSLPQFEASTYIYRSHLSPFFQEHEQDIDAFLASSRSRAGFALVESVGWIWQKAKAQLNITLPDEQLQAAAMLAQNQGQGRPNEGGYPAQDVHQPPTLSDPASGALQTALHFVSNYAGRYMPVALTALSAAAASAKGQADESQGGASSSITPQSRATQMPQQMTMPVPVPTPPVHQQQSDPSLRSRAFMHASSNNSAGQYPSLNNLKQQQQYQALSSARSPPQGFSGRSASGPAGPARMSQSSSRSSDESLGSRYEGYEQIGKDELQEMNNSRSRTQGKKNWFGWGGPAGMNDDRDDRDKID

SEQ ID NO: 67746 - protein, 400 aa, Coprinopsis cinerea okayama7#130
MTLAAPKINSVGNVVASVDPPEDSGSGNFLVVSNGPNSAPLTGTNINVRRNTLHATLSTTLANLDMNKETKLELRNEDLVDIHDLGQGNGGSVKKVEHTPTKMIMAKKTVLIDAKPSVRKQILRELHIMHDCRSDYIISFYGAFLADNNICICMEFMDKGSLDGIYKKIGAIDIDIVGKIALAVLEGLTYLYDVHRIIHRDIKPSNILCNSRGQIKICDFGVSGELINSIADTFVGTSTYMSPERIQGAQYTVKSDVWSLGISLIELALGRFPFSQSDSDESDDEFSDASDYEGTLSPQPAGSVSLADLPPPKPRRQKNANGNGSTTKKDKRKSKGHIVNEPAPRLTPEGRYPKAAESFIDACLLKDPDARQTPKDLLKHEWIENARMSSVDVEAWANTF

SEQ ID NO: 67747 - protein, 543 aa, Burkholderia xenovorans LB400
MTALQPDTVQLWPDEVYLIGCAGAPRGNPDPAGASAEKVGFKAYNLLRMAELGLPVPPAFVLGTHYCRDARAREIATASTVWEPGLQELERTTGQRFGDPRQPLLLSVRSGAPVSMPGMMDTLLNVGLCDTTLAGMLRQTGNPRLVWDTYRRLVASYGELVAGVPSSIFEAEYAAFAGTRDEHGLDFTELRELTHRCLAAYERAAGQPFPQDPQVQLANAIGSVLASWQSDRACAYRKQCGISDAIGTAVTVQTMVFGNAGGRSGAGVGFTRDPVSGEPTLWVDFLFNAQGEDVVSGRRSARGHEELAQAMPAAWKALQDAATRLEHALGDMQDVEFTVQDARLYMLQTRNGKRTPQAAARIALDLLDEGVISAEVARERTAALKPAALTRTRIVASGDRPLTPLAHAASASNGVAAGEIAFDEARARMRHAAGASVVLVRRDAETDDIAALEVAAGLLTQRGARTSHAAVVARQLGKVCLVGCTGLRLDESARTLQLGDTVLHEGDEVTLDGNDGAIYAGTARTVIEPMAELQARLERLRAP

SEQ ID NO: 67748 - protein, 165 aa, Bacillus sp. PS3
MAFENKIVEAFIEIPTGSQNKYEFDKERGIFKLDRVLYSPMFYPAEYGYLQNTLALDGDPLDILVITTNPPFPGCVIDTRVIGYLNMVDSGEEDAKLIGVPVEDPRFDEVRSIEDLPQHKLKEIAHFFERYKDLQGKRTEIGTWEGPEAAAKLIDECIARYNEQK

SEQ ID NO: 67749 - protein, 199 aa, Triticum aestivum
  misc_feature (101)..(101): Xaa can be any naturally occurring amino acid
  misc_feature (108)..(108): Xaa can be any naturally occurring amino acid
  misc_feature (187)..(187): Xaa can be any naturally occurring amino acid
  misc_feature (192)..(192): Xaa can be any naturally occurring amino acid
MAANVALLSASSPSTSASSILRRRPPPRCSACPRRAASRLSVVAAMSDDPIKEWILTEGKATQITGTSSIGGGCINAAQRYDTDAGSFFVKTNRRIGPAMXEREALGXTHMYDTKSIRVPLPYKVGSLPTGGSFIIMEYIQFGRSRGDQSALGRKLAEMHKAAKSDKGYGFYVENTIGSTPKINTWXTADWXIEFYSKA

SEQ ID NO: 67750 - protein, 78 aa, Glycine max
  misc_feature (22)..(22): Xaa can be any naturally occurring amino acid
MKFNIPNSTTGFQKKVENRREXNCEPFWNKRFSQKDFENALGEELTDYVFKITGGGDKQGFPVNQGVLTPDRVRLLLH

SEQ ID NO: 67751 - protein, 256 aa, Microscilla sp. PRE1
MSIIDKFQLKGKVALVTGCKRGIGKAMAIGLAEAGADIIGVSASLELEGSSVEQAIRATGRNFKAYQCDFSDRKSLYNFINSVKADYSRIDILVNNAGTILRTPAAEHPDEMWDKVIEVNQNAQFILTRELGKEMVSRGEGKVIFTASLLTFQGGITVPGYAASKGAIGQMTMAFANEWASKGVNVNAIAPGYISTDNTEALRNDPDRSASILSRIPAGRWGEAEDFAGPVVFLASEAAAYMHGSIMLVDGGWMGR

SEQ ID NO: 67752 - protein, 419 aa, Candida glabrata CBS 138
MFRGTVLNKNLAQLARVQGKRHLSIHEYRSAELLRKYGVGTPRGLPAMTPEEAAKAAEQLGTDKLVIKAQALTGGRGKGHFDTGFKSGVHMISSPQEASKLAKEMLQHKLITKQTGEKGKLVSAVYIAERVETKHEAYLSILMDRATGKPMIICSSEGGMNIEEVAEKNPDAIKKFSITVSEGLKPETAREIAESLGFSADAIDDAQDAVSKLYKIFSETDATQVEINPLSEIANNKDHKVMCTDAKFGFDDNAFFKQEEIFSWRDLTQEDPDEVSAKKYELNFVKLFGNIGCLVNGAGLAMATMDVIKLNGGEPANFLDCGGGATPETIKEGFRLIMSNDKVDAIFVNIFGGIVRCDFVALGLVEAAKELGLRIPIVARLQGTNLDEGRQIIKDSGLKIYSFDELDPAAKKVVELAHH

SEQ ID NO: 67753 - protein, 486 aa, Microscilla sp. PRE1
MIMSTVKNYKLYIDGEWIDATTGESQEILSPTDETVVGTVQMGVEADAQIALEAAERAQKQWKKVPARKRADLLRTFAAEIKANKNQLAELLVREQGKLLAVAKMEVEVTASFIEYACDGARSIEGDIIPSDNPAEHIMIHKIPRGVVVAITAWNFPLALAGRKLGPALVAGNSVVLKPTQETPIATLELGNIANKVGLPKGLINILTGQGSVLGNALVANPITKMVSMTGSTPAGQQIFRTAAENLIHVQLELGGKAPCIVFDDADLEQAVEGAFHSRFDNCGQVCTSNERLYVHESIYNEFMERFMEKVKGLKLGNPMDAATTIGPKVNAKEVAHMEHLVTKSVEEGATVAIGGKKPQGKAFEKGHWFEPTILTDVKQNMTIVHEESFGPILPVIKFSEFNEVIGYANDCEYGLAAMVFTNDMNKIMRLNDELEFGEIYINRGHGEQHQGFHNGYKLSGTGGEDSKYGFEQYMEKKTFYIKYKA

SEQ ID NO: 67754 - protein, 679 aa, Oryza sativa Indica Group
MAQVVAAAGTAAAVAAVGRPLVGGGSGADALRPAVRLSFAPRWCGGSAGAARARRESAVTSVISRAPRLDAEVLPVSADDDADVKEEENFQHLKAIQQLATSANGVWSKPNVRRKTKIVCTIGPSTNTKEMIWKLAEAGMNVARLNMSHGDHASHQKVIDLVKEYNAQTKDNVIAIMLDTKSYTEYDVLMLECFFAVYASSGGIGPEVRSGDLPQPIMLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGSDGIMLSGETAHGKFPLKAVKVMHTVALRTEATMSGGETPANLGQVFKNHMSEMFAYHSTMMSNTLGTSIVVFTRTGFMAILLSHYRPSGTIFAFTDQERVRQRLALYQGVCPVQMEFSDDAEKTFGDALSYLLKHGMVKEGEEVALVQSGRQPIWRSQSTHNIQVRKVQSAQATGGSFAMTMRVAFAFQFLAIGAPETGVAELACPRFSFPSGTTRHMRARCAGGRALRADGEKDSCRFAN

SEQ ID NO: 67755 - protein, 458 aa, Oryza sativa Japonica Group
MDYNPVDSSGTDDDLPPTYQNRGVRGSGRVSGNGRDIVSAVPYNRTKPQTDMETQIHQLEQDAYCSVLRAFKAQSDAISWEKEGLITELRKELRVSDKEHRELLNRVNGDDIIQRIREWRETKGGLQADMVNNAQRSHDRVPSPTTSARKRQKTSQSIPSASVPVPSPAVHSQTLTAPMQPLSSATKKVAPPGTKGKKTKPGQKIPGGSAIKTMSSAGPSGRGPIMNKNLSGGLPTEPISVNPLIGRKVMTRWPDDNSFYEAVITDYDPQLDRYALVYDINTADETWEWVDFKEMAPEDIRWEGGDPGIIQQGRGATVHGGKKSSSRNGPMSGPGRGSRGPQKNTSRKEFPPSQNGVGKKSSDCIEILHTESLIKEVERVFSASNPDPLEMEKAKKVLKEHEQSLIDAIARLAEASDGESEERAQPLQHNRGWRNHHGGNYANDMTIDGHMVGDADAL

SEQ ID NO: 67756 - protein, 163 aa, Pseudomonas aeruginosa PAO1
MRHIISLLLENEPGALSRVVGLFSQRNYNIESLTVAPTEDPTLSRLTLTTVGHDEVIEQITKNLNKLIEVVKLVDLSESAHIERELMLVKVKATGAQRAEVKRTTDIFRGQIVDVTSSVYTVQLAGTSDKLDSFIQAIGTASILEVVRSGVTGIARGDKTLSI

SEQ ID NO: 67757 - protein, 241 aa, Neptuniibacter caesariensis
MVNIALRAARAAGEQIVRAVERLDLVKSEQSDVAKLLSDTCQKAELSIVHTIQKAYPSHKIVGEYTGEHAPISEGPEFCWTVNPIDSISNFSNGLPVFAISMAGQQNGRTEHALILNPITGEEFTASRGDGAQLNGKRLRVSNHKTIDSSLIGTGFFNRASDKAHLEAYLNIFRDMTLNGGTIYNGGSPALNLAYTAAGRIDGFYQIGLNPWEMEAGILLVQEARGLVGDFMGGNDFRRSG

SEQ ID NO: 67758 - protein, 494 aa, Novosphingobium aromaticivorans DSM 12444
MTSTSSSPVTETILNFIDGSYRKGSEGKSFPNVNPATGTAIGVVHEASQADVADAVAAAKAALTGPWGKMTTAERVKLIAAVATEIERRADDFLAAEVADTGKPRHVASHIDIPRGAANFRMFADVVSTMPGESFNTSTPDGGQALNYTVRKPKGVVAVVCPWNFPLLLMTWKVGPALACGNTVVVKPSEETPRTAALLGEVMNAVGMPKGVYNVVHGFGPGSAGEFLTSNPDVDAITFTGETGTGQAIMQKAAIGVRDISFELGGKNPAIVFADADLDKAVEGLSRSVFLNTGQVCLGTERVYVERPIFDAFVARMAAAAQGFKPGVTGDRAYLGPLISAEHREKVLGYYRRAVEDGATVVTGGGVPEISGAEAGGFFVEPTLWIDVAHGDTVMREEIFGPCCGIVPFDSEDEVIALANDTVYGLCASIWTENMSRGHRVAAAMDVGVCWVNSWFLRDLRTAFGGSGHSGIGREGGVHSLEFYTEITNICVKL

SEQ ID NO: 67759 - protein, 127 aa, Neptuniibacter caesariensis
MAYSDKVIDHYENPRNVGKMNDKDSNVGTGMVGAPACGDVMRLQIKVSDEGIIEDAKFKTYGCGSAIASSSLVTEWVKGMSLDEAAELKNTSIAEELALPPVKIHCSVLAEDAIKAAVADYKEKQDK

SEQ ID NO: 67760 - protein, 415 aa, Fusobacterium nucleatum subsp. vincentii ATCC 49256
MLAKRYTGKKLVDNIFATSKKAKQAIKEFGKENVINATIGSLYNEDEKLAVYDVVESVYRNLPPEDLYAYATNVIGEDDYLEEVIKVVFYDDYKEALKGLHIASIATTGGTGAISNTVKNYMDTGDKVLLPNWMWGTYKNIVIENGGKIETYQLFDKNGDFNFEDFKNKVLELAKFQKNVVLIINEPSHNPTGFRMTFEEWVNLMDFFKSIRDTNLIVIRDVAYFEYDDRGEEETKKIRKLLVGLPKNVLFMYAFSLSKSLSIYGMRIGAQIAVSSDEGVIQEFEDAIPFSCRTTWSNIPKGGMRLFATIMKNPELKANFLNEKQGYMNLLNERANIFLTEAKEENLEILPYRSGFFVTVPVGETVDKVIEDLESKNIFVIKFDTGIRIGLCSVPKKKIKGLAKKIKESISKFKK

SEQ ID NO: 67761 - protein, 292 aa, Triticum aestivum
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 67762 - protein, 551 aa, Clostridium perfringens ATCC 13124
MYKPKLISLLDDKENGFSKEQFFKDLIAGIIVAIIALPLSIALGISSGVSPEKGLITAIIAGFIISLLGGSRVQIGGPTGAFVVIVFGIIQNHGVDGLIIATFMAGIILVLFGLLRFGSLIKYIPYPITVGFTSGIAVTLFSTQVKDFLGLSMTKTPSEFIPKWEAYISHMNTTNLYTLAIGLLALIILIFWPKINKKIPGSLIALIVTTLVVFIFNLPVATIGSQFGKISSNIPMPHIPNLNLNTLKALIGPAFTIALLGGIESLLSAVVSDGMIGDKHNSNAELIAQGIANMGSSLFGGIPATGAIARTAANVKNGGRTPISGIVHSITLLLIMLVFMPLAKFIPLTTLSAILIIVSYNMSEWRTFKAILKAPKSDIAILLTTFFLTVLFDLVIAIGIGMVVSMCLFMRRVATSIEVNELNESDCSDKSNIDTDMENLKVGENVLVYDIRGHLFFGAVDTFMNTMKEINDDAKVLVLRMRHTKTLDVTGYKQIKNIALSCKSRNMTLIISELQEQPKKVMRLMGFIDTLGEDHFATNFDEALEKANSLI

SEQ ID NO: 67763 - protein, 109 aa, Bryopsis maxima
SVNLSILKFLAFEQTFKNSLTGLPMGGGKGGSDFNPKGKSENEVMRFCQSFMTELSRHVGPNTDVPAGDIGVGAREVGFLFGQYKRLMNRFEGVLTGKALEFGGSEIRN

SEQ ID NO: 67764 - protein, 70 aa, Arabidopsis thaliana
SIGGFGSHVVQFLALDGLLDGKLKWRPMVLPDRYIDHGAPADQLAEAGLMPSHIAEFPPRSPLATAIYIY

SEQ ID NO: 67765 - protein, 601 aa, Haemophilus somnus 2336
MTETTITFNDLGLPEFILNAVSEMGFSTPSPIQQACIPHLLNGHDVLGMAQTGSGKTAAFSLPLLAKIDTNEKYPQMLVMAPTRELAIQVADACEQFVKFSKGVRIVTLYGGQRYDIQLRALKQGAQVVVGTPGRILDHIRRGTLDLSNLQSIVLDEADEMLRMGFIDDVETVMAELPEQHQTALFSATMPAPIKRITKRFMHNPQEVKIQSTQRTAPDITQSCWYVRGFRKNEALLRFLEVEDFDAAIIFTRTKTATLDVTELLEKHGFRAAALNGDMTQQLREQTLDRLRNGSLDILVATDVAARGLDVERISLVVNYDIPLDAESYVHRIGRTGRAGRAGRAILFVEPKERRLLGNIERLMKKAIEEVEMPNHLALQECRRKNFVAKITKQLEHHDLEQYRSLLEDLFTADQDQEDIAAAMLMLLQGKQKLILPEDPVFEKHSRRNDRRERGERRGKENPRSERHGYGIPQPMDLYRIEVGRCDGVEVRHIVGAIANEGDIQSRYIGHIKLYDTYSTIELPQGMPKELLQVFAKTRVLNKQMRMSFVSAVNSEEEFEAGSGGKRKGRYEREFRGGRKFNEKSNRSFSEQRKERRERKR

SEQ ID NO: 67766 - protein, 197 aa, Escherichia coli
MLIKNPISYFHIGTFLFSERKGHLLEYWKAEIIMRDNFTVHRLIRNGMQRQRGFLLWWRLANEMYISGNKKQRKCAIKIKNALMAKYGCDIGLGARIGKGFVLPRHSGIVIHGNVKIGENVIIRQNATIGEKESDSRENYIVIGDNVDVGAHTCIIGLNVKIGSNIKIGAMSFIMEDVPDNCTYVTRKESRVIMRQL

SEQ ID NO: 67767 - protein, 333 aa, Physcomitrella patens subsp. patens
MRSFAQAAQTETEALPLRTVQIEGLVALKIVKHCKECMPALVTGQLLGLDIGSILEVTNCFPFPVCGEDEDELDTDGANYQLEMMRCLREVNVDNNTVGWYQSTYMGSFQTVELIETFMNYQENIKRCVCIIYDPLRSSQGVLALKALKLAEGFMELYRTQTFSGEKLREKNLTWKDIFEEIPVKICNSALVSSMMTELEPDVQATQCDFDRLVLSTNPFMEKNLEFLIECMDDLSMEQQKFQYYYRNLSRQQVQQQTWLQKRRTENAARRAAGEEPLPEEEPNNPIFKTLPEPSRLDSYLITNQISNYCSQVNGFAAQSFSKLYLMDAFHDE

SEQ ID NO: 67768 - protein, 1016 aa, Moorella thermoacetica ATCC 39073
MSGAMRPIPFKKLLDWILEENRKFHSIFGLPQEKFYRAQPGVYWQLFGEYLENVIGPAAGPHTQLAQNIVAAYLAGGRFFELKTVQVLDRLDIPKPCINAADEGYNVEWSTELAIEEAFEEYVKAWFLLHVLQKELWGTDRRGFMFNMSVGYDLKGIKSPKVDRFIESLKDASKTAIFQECRAVLQAEVDRFTAVDAEFIDGISPHICSSVTLSTMHGCPPAEIETICRYLLAEKRLHTFVKLNPTLLGYKFVKDTLAGMGYSYVQLKEESFSHDLQYTDGVALIGRLQEFAREQGRGFGVKLSNTLPVQVTRGELPGEEMYLSGRALYPLTLNLAARLAQEFNGHLRISYAGGGDAFNLPRLFATGIWPLTVATTLLKPGGYLRLQQIAAELATRMPDTAGEVIDVAQLAGLAAGVTRDPDFRKEKRGVASRKLTRKLPLTDCFLAPCTAGCPIGQDIPEYIRLVGEKRYREAYELIIEKNPLPFITGSICTQHCAAKCTRLDYDEPVRIREMKKEAAVKGYRASRPRCGPAQGKASARVAVIGAGPAGLAAGYFLARAGLGVTIFDKKGKPGGTVTHVIPDFRLSEDAIARDLELVKGTGVEFKLGVSPDFNVAELKRAGYKYVFLAPGAGASRPLELRTGGERVMGAVEFLAKFKEDRQKVRLGKRVAVIGGGNTAMDAARAALRVPGVEKVTIIYRRTREYMPASREELREALAEGVVLKELLAPYSWSEGVLRCQQMELEAPDASGRPGVAVKAGELVDIPADAVLAAIGQDVDYGLLEKNGIAIDEGGRIVVDPATNETSVANVFIGGDALRGPATIVEAIADGRKAARAILTREGLTPPVPGAVPFDREWRLREVNQKKGNLAGAAGDPGLEPQRCLECGFVCNICTEVCPNRANIAIQTRNGGFRDQNQIVHVDGMCNECGNCATFCPYDGAPYRDKLTLFWKEEDFAGSQNNGFLLLAGGAELVFKVRLNGRVQEVKFDPAGKANVDLEQGVLDLILAVYKGYRYLF

SEQ ID NO: 67769 - protein, 438 aa, Candida glabrata CBS 138
MSVTKVHARTVYDSRGNPTVEVEVYTKDGMFRAIVPSGASTGSHEALELRDGDKSKWEGKGVTKAVSNVNDIIGPKLIESKLDVKDQKAIDEFMIKLDGTKNKSKLGANAILGVSLAVARAGAAAKGVPLYQHIAELADMKKEPYVIPCPFFNVLNGGVHAGGNLALQEFLIAPVGAESFHEALRLGSEVYHKLKALAKKRIGSSAGNVGDEGGIAPSLSTPFEALDLIYDAIKEAGHEGKVKIAMDPASSEFFQGDKYDLDFKNPHPDAKNKLSGAQLGDYYKTILEKYPIVSLEDPFAEDDWEAWTNFFPKAGVQIIADDLTVTNPERIQTAIDKKTADCLLLKVNQIGSLTESINSAKLAYGAGWGVQVSHRSGETEDTFIADLVVGLRTGQIKSGSLARSERLAKWNQILRIEEELGASNTIFAGAKFHKGQLL

SEQ ID NO: 67770 - protein, 327 aa, Arabidopsis thaliana
  misc_feature (115)..(115): Xaa can be any naturally occurring amino acid
MLFSGSAIPLSSFCSLPEKPHTLPMKLSPAAIRSSSSSAPGSLNFDLRTYWTTLITEINQKLDEAIPVKHPAGIYEAMRYSVLAQGAKRAPPVMCVAACELFGGDRLAAFPTACXALEMVHAASLIHDDLPCMDDDPVRRGKPSNHTVYGSGMAILAGDALFPLAFQHIVSHTPPDLVPRATILRLITEIARTVGSTGMAAGQYVDLEGGPFPLSFVQEKKFGAMGECSAVCGGLLGGATEDELQSLRRYGRAVGMLYQVVDDITEDKKKSYDGGAEKGMMEMAEELKEKAKKELQVFDNKYGGGDTLVPLYTFVDYAAHRHFLLPL

SEQ ID NO: 67771 - protein, 432 aa, Ustilago maydis 521
MASTAGGIKVFSGTSHPELAELIAKRLGQPLGKATVTRNESGESIVRIAESVREHDVYIINTSCVSPTPTGAAASPNTSLMELLIMIHACKTASAKRITAVIPHFFYARQDKKDKSRAPITAKLIANMLENAGCDHVITMDLHASQIQGFFDVPVDNLYAEPAALQYIREMVDVNKAVIVSPDAGGAKRATSLADRLELDFALFHKERKRANEVSRMVLVGNVEGKVAILVDDMADTCGTLELAASQLIEYGAERVLAIVTHGILSGPALDRISNSRLEKLIVTNTLPQSHNRSRCTKIEEIDISHVLAETIRRSHYGESVSVLFNQIPYDTAQPYRHEHDDEITAAAAVARTDATVAASTRTSRPQSRAISPSHSKLFPPSPYTLPDPPVAANYFAHHPTTPSPTSTAHPALDTPKASDPKYAPSPLSRNV

SEQ ID NO: 67772 - protein, 546 aa, Candida glabrata CBS 138
MVTRRRLHHPEVEQVSKRQKVDKAESKNKKHADVAAERGEQSTEDHEDESQDKKDKKVVGDNRDEDEEVSPNGQEAAEDNDDRKDKDAKEKDTETNDEGTEKSHTDVNDDDDDVDESKEEDAAAAVDITKEKKDEQESDNKTEEKKVQENEEEEEEDENKNDEDVEELGSTEPVDDEKKGLVKFEFDGVEYKFKERASVIEENEGKIEFRVVSNDNTRENMMVLTGLKNIFQKQLPKMPKEYIARLVYDRSHLSMAVIRKPLTVVGGITYKPFNKRQFAEIVFCAISSTEQVRGYGAHLMNHLKDYVRNTSDIRYFLTYADNYAIGYFKKQGFTKDITLDKKVWMGYIKDYEGGTLMQCSMLPRIRYLDAAKILLLQEAALRRKIRTISKSHVVHPGLECFNDIENIKPIDPMSIPGLKEAGWTPEMDELAQRPKRGPHYAAIQNILVELQNHAAAWPFLRPVNKEEVPDYYEFIKEPMDLSTMELKLENNKYEKMEEFIYDARLVCNNCRLYNGENTSYYKYANRLEKFFNNKVKEIPEYSHLID

SEQ ID NO: 67773 - protein, 529 aa, Medicago truncatula
MPSSHLLLEEPIRMASILEPSKASFFSAMTKIVGTLGPKSRSVETISGCLKAGMSVARFDFSWCDPEYHQETLENLKTAIKGTKKLCAVMLDTVGAEMQVVNKSETTISLEIDAQVVLTPNQGQEASSEILPINFDGLAQAVKTGDTIFIGQYLFTGSETTSVWLEVSEVKGNDVVCIIKNSATLTGSLFTLHASQIHIDLPTLTEKDKEVISTWGVKNKIDFLSLSYTRHAKDVREARDFLSKLGDLSQTQIFAKIENVEGLTHFDEILQEADGIILSRGNLGIDLPPEKVFLFQKSALHKCNMAGKPAVLTRVVDSMTDNLRPTRAEATDVANAVLDGSDAILLGAETLRGLYPVETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESETTTASNESILKVALDHGKALGVIKSHDRVVVCQKLGDASVVKIIELED

SEQ ID NO: 67774 - protein, 155 aa, Desulfovibrio desulfuricans G20
MRSIRIIAVGRLKTAHWKTAAEHYLTRLTRAFKVEETIIKDGNAALPPLERNAQEGARIVAALTPADLAVCMDETGRQFTSQQFSAFLTPMWENANLRPCFIIGGAYGLSDEVRGKARHTMALSAMTFPHEMARVVLYEQLYRADAILRGTPYHH

SEQ ID NO: 67775 - protein, 172 aa, Brassica napus
MQAMSDEVVEVTVVEKAAEANGEKSARRRTRRKDAAEGGDGLMKWERFLPKISLRVLLVEADDSTRQIVSALLRKCSYRVAAVADGLKAWEMLKGKPESVDLILTEVDLPSISGYALLTLIMEHDTCKNIPVIMMSTQDSVNTVYKCMLKGAADYLVKPLRRNELRNLWQHV

SEQ ID NO: 67776 - protein, 392 aa, Moorella thermoacetica ATCC 39073
MFEKIFADKMANLGTETAFMVLAKAKALEAQGKEIIHLEIGEPDFATPRNIIDAGIRALNEGYTHYTPAPGLPEVRATIAEYATRQKGVHYDPEEVVIVPGGKPIMFFTILALVNPGDEVIYPNPGFPIYESVINFVGGKAVPLPIREENDFRLDVDELAGLITPKTKLLIINSPANPTGGVLTAEDIGRIADLVRGKNIVVLADEIYDRIVYDGARPVSIAAQPGMKDWTIILDGFSKTYAMTGWRIGYGLMHRELADRIAQLMVNSNSCTAAFTQKAAQEALTGPQDAAEAMVAEFKKRRDIIVDGLNSIPGITCKRPLGSFYVFPNIKGLGLSSQELEAFLMEKAGVAALSGTAFGKYGEGYLRLSYANSVENIEKALEKIAAAVKELR

SEQ ID NO: 67777 - protein, 125 aa, Medicago truncatula
MACMWRKNACSGKKLPSDVPRGHLAVTVGETNRRFVIRADYLNHPVLQELLDQAYEGYGFNKSGPLSIPCDEFLFEDILLSLGGGTVARRSSSPVLTKKLDLSFLKDAVPLLEAFDSKRSNNYKN

SEQ ID NO: 67778 - protein, 135 aa, Neptuniibacter caesariensis
MALERTFSIIKPDAVAKNVIGKIASRFESNGLKIVEMQMKHLTQEDAEGFYAEHKERPFFGDLVAFMTSGPVIVQVLEGENAIALNRELMGATNPQEAAEGTIRRDFAQSIDANAVHGSDSPASAEREIAYFFGK

SEQ ID NO: 67779 - protein, 387 aa, Clostridium perfringens ATCC 13124
MELNTLKSTFINNFGKEPTSLFFSPGRINLIGEHIDYNGGFVFPCPITLGTFAAASLREDRICRAYSLNFESLGVIEFSLDDLSYKKEDNWTNYLKGVLKVLIEKGYKIDKGIDLVINGNLPNGAGLSSSASLEMLIVKILDTFFSLNISKVDAALIGKEVENTYIGVNSGIMDQFAISLGEKDKAILLDCNSLYYEYVPLNLGDNSIIIMNTNKRRELADSKYNERRKECDDSLDTLKKYTNISSLCELTSLEFETYKDKIEDSNKLRRCVHAISENERVKDAVKALKENNLELFGQLMNQSHISLRDDYEVTGKELDTLAENAWKQPGVLGARMTGAGFGGCAIAIVNNAHVDEFIKNVGQAYKDAIGYEASFYVASIGNGPTEL

SEQ ID NO: 67780 - protein, 507 aa, Solenostemon scutellarioides
MTSLLAHPLLPPPRRRPLPPLLPPPVSHPAGPRPGRWWRNLYDVKPVRFRCFAEWAQLFGPTFSVWFGSTLNVIVSSSELAKEVLKEKDGQLADPPRSRSAVKLSRDGKDLIWADYGPHYVKVRKVCTVVLFSPKRLELLRPIREDEITVMVESIYQDSAASGKSVVIKKYLASMAFHNITRLVFGKRFVNSEGEVDKQGQEFKAIAINGLKLGASLAVSEHIPWLRWMFPLDEDAFTQHGVRMERLTREIMQEHTLARQKTGGAKQHFFDALLTLKDEYDLSEDTIIALLWDMIAAGMDTPAISVEWAMAELVRNPRVQEKVQEELDRVIGHERIMTELDIPNLPYLQCVVKESLRLHPPTPVMLPHRSNADVKIGGYDIPKGSNVHVNVWAIARDPKSWKVPLEFRPERFLEEDVDIKGHDFRLLRFGAGRRVCPGAQLGIDLATSMIGHLLHHFRWTPPTGVRAEDIDMGENPGTVTYMRTPVEAVPTPRLPANLYKRVAVVDI

SEQ ID NO: 67781 - protein, 735 aa, Chlamydomonas reinhardtii
MLRGAVSHGPAVADRAAAGPARCAAPVARGVRSAAPTRQRRAEASVNAPRAGPAGSYSGEWDKLSVEEIDEWRDVGPKTPLLDTVNYPVHLKNFNNEQLKQLCKELRSDIVHTVSRTGGHLSSSLGVVELTVAMHYVFNTPEDKIIWDVGHQAYGHKILTGRRKGMATIRQTNGLSGFTKRDESEYDPFGAGHSSTSISAALGMAVGRDVKGKKNSVIAVIGDGAITGGMAYEAMNHAGFLDKNMIVILNDNQQVSLPTQYNNKNQDPVGALSSALARLQANRPLRELREIAKGVTKQLPDVVQKATAKIDEYARGMISGTGSTLFEELGLYYIGPVDGHNLDDLIAVLSEVRSAETVGPVLVHVVTEKGRGYLPAETAQDKMHGVVKFDPRTGKQVQAKTKAMSYTNYFADALTAEAERDSRIVAVHAAMAGGTGLYRFEKKFPDRTFDVGIAEQHAVTFAAGLACEGLVPFCTIYSTFMQRGYDQIVHDVSLQKLPVRFAMDRAGLVGADGSTHCGAFDVTFMASLPHMITMAPSNEAELINMVATCAAIDDAPSCFRFPRGNGLGLDLAAYGISKDLKGVPLEVGKGVVRRQGKDVCLVAYGSSVNEALAAADMLERDGVSTTVIDARFCKPLDTKLIRSAAKEHPVMITIEEGSVGGFAAHVMQFLALEGLLDGGLKFRPMTLPDRYIDHGDYRDQLAMAGLTSQHIASTALTTLGRAKDAAKFSLSALQA

SEQ ID NO: 67782 - protein, 356 aa, Zea mays
  misc_feature (242)..(242): Xaa can be any naturally occurring amino acid
  misc_feature (284)..(284): Xaa can be any naturally occurring amino acid
MSAYCGKYKDELIKNAAYIGTPGKGILAADESTGTIGKRFASINVENVEDNRRALRELLFCTPGALQYLSGVILFEETLYQSTKGGKPFVDILKAGNVLPGIKVDKGTIELAGTNGETTTQGFDDLGKRCAKYYEAGARFAKWRAVLKIGATEPSQLSIDQNAQGLARYAIICQENGLVPIVEPEILVDGPHDIDRCAYVTEIVLAACYKALNDQHVLLEGTLLKPNMVTPGSDSKKVAPEXVIAEYTVRTLQRTVPAAVPAIVFLSGGQSEEEPTLNLNAMNXLSTKKPWALSFSFGRALQASTLKAWAGKVENVEKARAAFLARCKANSEATLGTYKGDAAADTESLHVKDYKY

SEQ ID NO: 67783 - protein, 328 aa, Chlamydomonas reinhardtii
MGEGTFGRVLECWDRKREDYVAIKIVRNIDKYRHAAMIELEVLNTLEKNDPCGLNHCVALREWFDYRGHVCMVFEKLGLSLFDYMRKNGYKPFPLDVVQDFGRQLLEAVSYMHELRLVHTDLKPENILLTCQECGVAAGGGGVGVQQPAESSGRPPSSAIKVIDFGSATFEEQYHSCIVSTRHYRAPEVILGLGWSYPCDMWSIGCILVELITGEALFQTHENLEHLAMMEAVLGPLPPGMAGRCARTPAGKYFAAGSGRLNWPDGAASRKSVKAVKRLSGLHQLILEQGDPTARPYAGELVDLITAMLRYDPADRLTAPQALEHPFF

SEQ ID NO: 67784 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNSAGLDVDALIQHVDHNGSVDGFKAETLSADDFWALECEFLIPAALEGQITGKNAPQIKAKIVVEGANGPTTPEADDILRDRGILVCPDVIANAGGVTVSY

SEQ ID NO: 67785 - protein, 594 aa, Physcomitrella patens subsp. patens
MAIADSPAWNKYQEQEQEPEHVSRKAISDSLAWKQLQQHMSEIKKTHLRELMKDEQRCKSMIKEVDGIVVDYSRQRATLETVEKLLSLAEEAKLSEKINAMWSGKHINATEDRAVLHVALRAPRDAEIMCDGKNVVPEVWGTLDKIKDFSERVRSGKWIGATGKVLTDVVAIGIGGSFLGPLFVHNALETEPACEELAKGRSLRFLSNVDPVDASIALKGLDPETTLVVVVSKTFTTAETMLNARTCRAWITSKLGVDAVSKHMVAVSTNLKLVEEFGIDPKNAFAFWDWVGGRYSVTSAVGVLPLSLQYGFDKVEEFLKGTWSMDEHFRNTPLKSNIPVLLGLLSVWNVTFLGCPARAILPYSQALQKLAPHIQQVSMESNGKGVAIDGSPLPFEAGEIEFGEPGTNGQHSFYQLIHQGRVVPCDFIGAVKSQKSVYMVGEKVSNHDELMSNFFAQADALANGKSSEDLKAEGVPASLVPHKVFTGNRPSLSILLPNVDAFTVGQLLSLYENRIAVQGFIWNVNSFDQWGVELGKSLASRVRSQLNAARTKEAAVEGFNYSTTFLLQHYLKGKTPVQSSNLVNLFPSEIFPAA

SEQ ID NO: 67786 - protein, 110 aa, Oryza sativa
  misc_feature (29)..(29): Xaa can be any naturally occurring amino acid
  misc_feature (37)..(37): Xaa can be any naturally occurring amino acid
  misc_feature (58)..(58): Xaa can be any naturally occurring amino acid
MEESHADGGNLIQVRPFSCTPNHIDRSNXISSVCLGXTILLVALYGQRSGNNRGDNPXNVSIDVVWKQVTRNIGKQETEYDMRINRTLTIMCLLSVNSYSTTSVILRVLG

SEQ ID NO: 67787 - protein, 235 aa, Brassica napus
MSLVSSSRDMGGDDESTSRTHRHDGTDDEGVESLGRQMSESSIYATEEEEEDDDSKLHLGPQYTIKEHLEKDKDDESLRKWKEQLLGSVDVTNIGETLDPEVKIISLAILSPGRPDIVLMVPENGNPKGMWFTLKEGSRYCLKFTFQVKNNIVSGLRYTNTVWKTGVKVDRGKEMLGTFSPQSEPYNHVMPEETTPSGMFARGSYSARTKFLDDDNKCYLEINYSFDIRKEWPAV

SEQ ID NO: 67788 - protein, 475 aa, Zea mays
MDMALASKASPPPWNATAAEQPIPKRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLAEKGGIPIGIGKNSCIRRAIIDKNARIGDNVKILNADNVQEAARETDGYFIKGGIVTVIKDALLPSGTVI

SEQ ID NO: 67789 - protein, 364 aa, Zea mays
MYRAAGSHLRSLKHHGASRLASTSVAKQSSGGLFSWLLGGKSSELPPLDVPLPGISIPSPLPDFVEPSKTKVTTLPNGVKIASETSSSPAASVGLYIDCGSIYETPASSGVSHLLERMAFKSTVNRTHLRLVREVEAIGGNVSASASREQMSYTYDALKSYTPEMVEVLIDNVRNPAVLDWELQNIKSEIADVSANPQGLLLEALHSVGYSGALTKPLMASESAVNRLDVSSLEEFVAEHYTAPKMVLAASGVDHDALISVVEPLLSDLPCVKRPEEPKSVYVGGDYRCQADSPNTHIALAFEVPGGWNQEKTAMVVTVLQTCPEISQAVSSVLERAVYAIAPGGVKKTITCAVAYANLIVLQR

SEQ ID NO: 67790 - protein, 243 aa, Mannheimia succiniciproducens MBEL55E
MSNMEGKKVPQVTFHTRQGDAWVDVTSAQLFDNKTVVVFSLPGAYTPTCSSSHLPRYNELTPEFKKLGVDDVICVSVNDTFVMNAWKCDEDADNITVLPDGNGEFTEGMGMLVDKEELGFGKRSWRYSMLVKNGVIEKMFIEPNEPGDPFKVSDADTMIKFIKPDWEPKPSVALFTKPGCPFCAKAKALLTEKGYPFEEIVLGKDATVTSVRAMSGRATFPQVFIGGKHIGGSDDLEAYFANK

SEQ ID NO: 67791 - protein, 229 aa, Methylococcus capsulatus str. Bath
MLELQENLQAVRQRIRAAEQACGRPEDSVRLVAVSKTQPAAVLRAAYDLGQREFGENYLQEAMEKQDLLADLDIVWHFIGPIQSNKTRLLAERFDWVHSIDRLKIAQRLNDQRPPGRAPLNVCIQVNIGGEPTKSGVTPAAVAELAQAVAALPRLRLRGLMAIPAPTADEREQRAAFRRLRELLEGLGMPGLDTLSMGMSDDLEAAVAEGTTLVRVGTAIFGRRPPAKG

SEQ ID NO: 67792 - protein, 186 aa, Bacillus anthracis str. A2012
MNALKEEIARITNIEQKRGTLAEALIDADVFIGVSAADVVDEDMIRSMNHNPIIFALANPTPEIMPNKAKIAGALVVGTGRSDFPNQVNNVLAFPGVFRGALDVQAKEINEEMKLAAVYAIAELISEEELHVNYVIPNPFDPRVVPHVAYAVARAAVETGVSRKNISMSEIKNNLFRLTKEVNILK

SEQ ID NO: 67793 - protein, 177 aa, Bacillus anthracis str. A2012
MSLLRDEALKMHKEKQGKIGVYSKVKVQNSTDLSLAYSPGVAEPCLEIYKDESKVYDYTMKGNLVGVISDGTAVLGLGNIGPKAAMPVMEGKALLFKSFAEIDAFPICLNTNNPDKIVEVVKLLEPNFGGINLEDIAAPQCFEIEERLRKSCDIPVFHDDQHGTAIVTIAGLIMHLK

SEQ ID NO: 67794 - protein, 274 aa, Methylococcus capsulatus str. Bath
MKHKTLGFIGAGNMASSLVGGLVADGYPARTIWVSDVDEAKLDALSLKFGVNVSGDNRQVARLAEILILAVKPQILREVAEGLADIVAETRPLVLSVAAGVAESSLDRWLGGDQALVRCMPNTPALVKSSATALHANGKTTSAQRSEAESILRAVGVTVWVEREEALDAVTAISGSGPAYFFLLMEAMENAAASLGLDPETARLLVQQTALGAARIAIESEEGPAQLRQRVTSPKGTTERAIGVFEERGLHEIVRDAVAAAHARAVELARELGA

SEQ ID NO: 67795 - protein, 262 aa, Neisseria meningitidis
KTSTRTRCAFEVAARDQGAGVTYLEPSASQIGHKESIKDTARVLGRMYDAIEYRGFGQEVVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKNVDFIHTDVWVSMGEPKEVWQERIDLLKDYRVTPELMAASGNPQVKFMHCLPAFHNRETKVGEWIYETFGLNGVEVTEEIFESPASIVFDQA

SEQ ID NO: 67796 - protein, 195 aa, Vitis vinifera
  misc_feature (91)..(91): Xaa can be any naturally occurring amino acid
  misc_feature (100)..(100): Xaa can be any naturally occurring amino acid
MTEYDPRLVAPTSLYLAAKAEESTVQARLLVFYVRKLNPDEKYRYEIKDILEMEMKILEALNYYLVVFHPYRALSQNQNEHNPIHWHSFPXLILLFGCFXMPTWNDLTQLSWGIVNDTYKMDLILIYPPHLIALACIYIASVHKDKETTAWFEELRVDMNVVKNISMEILDFYDSHRTITEDRITTTFNKLALRS

SEQ ID NO: 67797 - protein, 322 aa, Beta vulgaris
MDENYIRTCFAQSGELVNVKIIRNKQTMQSECYGFIEFSTHAAAERILQTYNNTLMPNVEQNYRLNWAFYGSGEKRGEDASDYTIFVGDLAPDVTDYTLQETFRVRYPSVKGAKVVIDRLTSRSKGYGFVRFGDESEQARAMSEMNGMMCLGRAMRIGAAANKKSVGGTASYQNNQGTPNDSDPSNTTIFVGNLDSNVTDEHLRQTFSPYGELVHVKIPAGKQCGFVQFTNRSSAEEALRVLNGMQLGGRNVRLSWGRSPNNRQSQPDQNQWNNAAYYGYPQGYDSYGYVSAPQDPNMYYGGYPGYGGYAMPQQAQMPLQQQ

SEQ ID NO: 67798 - protein, 92 aa, Arabidopsis thaliana
  misc_feature (2)..(2): Xaa can be any naturally occurring amino acid
  misc_feature (5)..(5): Xaa can be any naturally occurring amino acid
  misc_feature (7)..(7): Xaa can be any naturally occurring amino acid
  misc_feature (52)..(52): Xaa can be any naturally occurring amino acid
  misc_feature (62)..(62): Xaa can be any naturally occurring amino acid
  misc_feature (74)..(74): Xaa can be any naturally occurring amino acid
  misc_feature (81)..(82): Xaa can be any naturally occurring amino acid
  misc_feature (91)..(91): Xaa can be any naturally occurring amino acid
SXATXVXSPAQATMVAPLNGLKSSAAFPATRKANNDITSITSNGGRVNCMQXWPPIGKKKFXTLSYLPDLYRFXNWLRKFXXLIRNKWDPXF

SEQ ID NO: 67799 - protein, 697 aa, Oryza sativa Japonica Group
MDCLVAGANFLLKSIRHEAFTHMDGQKEYVQIDQNDLFPFLLVNVGSGVSIIKVDGHGKFQRVSGTNVGGGTYWGLGRLMTKCKSFDELLELSQRGDNSTIDMLVGDIYGGLDYSKIGLSASTIASSFGKTISDDKELSDYRPEDISLSLLRMISYNIGQISYLNALRYGLKRIFFGGFFIRGHAYTMDTISFAVNFWSKGEAKAMFLRHEGFLGALGAFMSYEKHGLDDLRIHHLVERFPMGAPYVGGKIHGPPLGDLNEKISWMEKFVQKGTQITAPVPVGFPVTTGMGGFERPTAKGDILRSDASAALNVGVLHLVPTLDVFPLLEDPKMYEPNTIDLDLNEYKYWFKILSDHLPDLVDKAVASEGGTDDAKRRGDAFAHAFSAHLARLMEEPAAYGKFGLANLLELREECLREFQFVDAYVSIKQRENEASLAVLPDLLMELDSMNEEARLLALIEGVLAANIFDWGSRACVDLYHKGTIIEIYRMSRKKMQRPWRIDDFDMFKKRMLADKKGQPYKRALLFVDNSGADVVLGMIPLARELLRNGTEVVLVANSLPALNDVTANELPGIVAEAAKHCGILRKAAEAGGLIFDAMAGIQDDLKDEPVSVPLMVVENGCGSPCIDFRQVSSELAAAAKDADLLILEGMGRSLHTNLNARFKCDTLKLAMVKNQRLAEKLFNGNIYDCICKFEPVP

SEQ ID NO: 67800 - protein, 123 aa, Brassica napus
MQMLRSFSTRTRSRLGGYERVSDDSTFSLLGAKLRRSTSVPYYAPSIKLGAGGVPTILEELPRQKSKKVKPTSKFSHPIFSFLYGKKKKSPTTRKPEFSRYLEYLKEGGMWDARTNTPVIYYK

SEQ ID NO: 67801 - protein, 258 aa, Oryza sativa
  misc_feature (148)..(148): Xaa can be any naturally occurring amino acid
  misc_feature (193)..(193): Xaa can be any naturally occurring amino acid
  misc_feature (223)..(223): Xaa can be any naturally occurring amino acid
PQGLVWNPVVTHASGALSFHIREYYWVDMKKINEIYRYKTEEYSHDATNKFNIYPEQIPSWLVDWIPEKGGYLIGNLQPAHMDFRFFSLGNLWAITSSLTTPKQAEGILSLIDEKWDDLIANMPLKICYPAMEDDEWRIITGSDPKNXFTLACIKMGRPELARRAIAVAEEKLAADKWPEYYDTRSGRSSGSXSRSYQTWTIAGFLTSKMLLEKPRAASILTXNEDLRAVEGGHCCLSRQKLVSPGTNPCCQLHGAFI

SEQ ID NO: 67802 - protein, 339 aa, Salmonella typhimurium LT2
  misc_feature (168)..(168): Xaa can be any naturally occurring amino acid
  misc_feature (185)..(185): Xaa can be any naturally occurring amino acid
  misc_feature (306)..(306): Xaa can be any naturally occurring amino acid
  misc_feature (314)..(314): Xaa can be any naturally occurring amino acid
MGSSHHHHHHSSGLVPRGSHMKAMNKVWVIGDASVDLVPEKQNSYLKCPGGASANVGVCVARLGGECGFIGCLGDDDAGRFLRQVFQDNGVDVTFLRLDADLTSAVLIVNLTADGERSFTYLVHPGADTYVSPQDLPPFRQYEWFYFSSIGLTDRPAREACLEGARRXREAGGYVLFDVNLRSKXWGNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAXAVTAKGAXTALPFPDQLNTFLSSHSLAQAMTVK

SEQ ID NO: 67803 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVDHNGSVDGFKAETLSADDFWALECEFLIPAALEGQITGKNAPHIRAKIVVEGANGPTTPEADDILRDRGILVCPDVIANAGGVTVSY

SEQ ID NO: 67804 - protein, 346 aa, Bacillus thuringiensis serovar israelensis
MMLRENIVDAIGNTPLVQLQLDSSARGNVFAKLEMLNPFGMKDRAAKKVILEAKKNGVLKDGAPIIESSSGTMALGLAMVGTYLGHPVHIVTDKRTDQMTLAKLKSLGCKLEIVTEMTHLGWQSARLDRLEEILKENKEAFCPRQYENSDNPNAYESLADEALEELGHIDILVASVGSGGSLCGTARALKKANPDLRVVAVDAVGSVIFNQPDIPGRLQGGHGNSVIPKNVDFSIIDEVHWLNDEECYAANLELAKCEKLFAGNSSAASYAVSRFLSSRCSEETNILTIFPDRGDRYYKTVYNEEYRKEKGMTNLNLHKQPKKVSYGMTVTSWSYASLQDNKMLTF

SEQ ID NO: 67805 - protein, 177 aa, Oryza sativa
LFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGLLANKDFEGAVVSRTPLRRVGEPEEVSSLVAFLCMPGSSYITGQTISVDGGMTINGLYPS

SEQ ID NO: 67806 - protein, 348 aa, Magnaporthe grisea 70-15
MLKGTIIVTGANGGLGSAIANKLLLEAQYAEYHMIFTVRNVEKANVLQEVINSHRGKGLSSSNDVVPLDLTSLASGRKLADDINARVAAGSIPPIRALVLNAGWQEWTTESFTKDGFEMAFQSNYLTHWLLTVKLLQSMDKNKGRIVVLGSWSHDPDHPGNNYQGFYKGEQWRQLHPNTEAVAKGTFSKPESLPAGGHGFRRYGAAKLCQIMMVYELQARLDADPALSKIAVLGVDPGAMPTPLTRRANPFFVLVGRAIFPILIFLSGLFSKNPEFRSSKKSAKDVMAAALSEDEPYGHSPKAVYYNGDEISTSSAESRDKRKGLELWRSSVEYTGLTEGETCLRNWR

SEQ ID NO: 67807 - protein, 115 aa, Glycine max
AEIIGTFILVYTVFSATDPKRVARDSHVPVLAPLPIGFAVFIVHLATIPITGTGINPARSLGPAVIFNNEKAWDDQWIFWVGPFIGAAIAAFYHQSVLRAQAAKALGSFRSSSNL

SEQ ID NO: 67808 - protein, 308 aa, Physcomitrella patens subsp. patens
MRSFAQAAQTETEAVPLRTVQIEGSVALKIVKRCKECMPALVTGQLLGLHIGSILEVTNCFPFLKSCWDVITVGGLVSLGVDSSSYQVQMYQSTYMGSFQTVELIETLMNYQPRSVGVESIEASGRFHGALLHPKFFLGGSESIRCRLCPHPCMSFRYIIHSNKYSLEVELHLSVIMLREKNSTLKDVFEEIPVKICNFALVSSMMTELEPDVQATQTRPIHKSFHGKESEIFDHVYGRSFHGAAEGMSFLTIATMLTENAARRAAGEEPLPEEEPNNPIFKTRPEPSRLDSYLISNQIWNYCSQVNG

SEQ ID NO: 67809 - protein, 134 aa, Triticum aestivum
  misc_feature (70)..(70): Xaa can be any naturally occurring amino acid
MGRLTSPLRALDAAAQEDLKRVFAQRAVDMVESGMKMGLGSGSMAGHALVRLGALLGTGAVRAVSGVPTXLKMEAHAERVGIPMLALADAAEIHLSIDGANEVDPDLNLAKSRGACLRKSVDECLNTIKLEREG

SEQ ID NO: 67810 - protein, 329 aa, Physcomitrella patens subsp. patens
MSKAGEMQLADGILMNLPEHPDQQLEIAQQITRFAVSGRVANLEGELDCLTLKLVEKAAIVEDLQARVSAVESMLGGITAKLAVALQDQAKLAEVKDALADQMKTLMCQVSVLDDFKKAVVRSLGPNSDFDDNPGDATYAYAPEASASTYCSSEKSLLQLPLIMSKSTEPPTPTKRKQQGQYSCMMLTSQDSPRDSAKGEESGKAMEDDKWTDNYKSAGAISEKSQWECPLTPRLPSDTGPAKSRRIDGKEVFRRASQIQSRARWTCEQFSDFLNNIREVNALRRAEEFLVCASSRAAYAYNVVPQCQLYGLNPPNWNCPPANCRVYTR

SEQ ID NO: 67811 - protein, 123 aa, Brassica napus
RQPLGVHRLVEALKHAFAVRMNLGDPDFVDVTKVVSDMLSPKFAQELKKKINDDKTFDPKYYGRKWNEIHDHGTSHFSIIDKERNVVAMTTTVNGYFGATKLSPSTGIVLNNQMDDFSIPMKP

SEQ ID NO: 67812 - protein, 853 aa, Arabidopsis lyrata
MRVVVPNCHHFYIFFVVLILIRSVFSSYVHTLSSTESLTISSKQTIVSPGEVFELGFFNPAATSRDGDRWYLGIWFKTNLERTYVWVANRDNPLYNSTGTLKISDTNLVLLDQFDTLVWSTNLTGVLRSPVVAELLSNGNLVLKDSKTNDKDGILWQSFDYPTDTLLPQMKMGWDVKKGLNRFLRSWKSQYDPSSGDFSYKLETRGFPEFFLLWRNSRVFRSGPWDGLRFSGIPEMQQWEYMVSNFTENREEVAYTFQITNHNIYSRFTMSSTGALKRFRWISSSEEWNQLWNKPNDHCDMYKRCGPYSYCDMNTSPICNCIGGFKPRNLHEWTLRNGSIGCVRKTRLNCGGDGFLCLRKMKLPDSSAAIVDRTIDLGECKKRCLNDCNCTAYASTDIQNGGLGCVIWIEELLDIRNYASGGQDLYVRLADVDIGDERNIRGKIIGLAVGASVILFLSSIMFCVWRRKQKLLRATEAPIVYPTINQGLLMNRLEISSGRHLSEDNQTEDLELPLVEFEAVVMATENFSNSNKLGEGGFGVVYKGRLLDGQEIAVKRLSTTSIQGICEFRNEVKLISKLQHINLVRLFGCCVDENEKMLIYEYLENLSLDSHLFNKSLSCKLNWQMRFDITNGIARGLLYLHQDSRFRIIHRDLKASNVLLDKDMTPKISDFGMARIFGRDETEANTRKVVGTYGYMSPEYAMDGIFSVKSDVFSFGVLVLEIVSGKKNRGFYNSNQDNNLLGYAWRNWKEGKGLEILDPFIVDSSSSPSAFRPHEVLRCIQIGLLCVQERAEDRPVMSSVVVMLRSETETIPQPKPPGYCVGRSPFETDSSTHEQRDESCTVNQITISAIDPR

SEQ ID NO: 67813 - protein, 378 aa, Physcomitrella patens subsp. patens
MACGEGHDHVGEDVYSTNQQKATTHIDKVRLAAIELVGQAAIPGTLASLARLNVFEALARAGDGVELTPQELGNQAMPGKVINLSYLGRMLRLASSVKVLREVATMSEDGSTEHRYGLEPIGKFLVDDAEKGSLVHLLLMYQDPVFLSTWNHLPESVLDDSVQPFARAHGGLHAWEYGMQNPEFDEKFNKAMAGHSKLYMRAFLDVYQGFEGVRVLIDVGGGFGSAISTITARYPHIKGINFDQPHVIKACPELPGVEHMSGDMFESIPSGGDAIFLKYILHDWDDESCIKLLKNCHKVLPANGKVIAVDSVLTDTINFEGGDRMAFMVDMNMMAFNHSGARERNEGEMRKLGLYAGFLRVDVVCKVDQLSVTEFIKA

SEQ ID NO: 67814 - protein, 1037 aa, Saccharomyces cerevisiae
MTVANTETHSAAKPSSTIGPWKLGETLGFGSTGKVQLAQHERTGHRTAVKVISKSIFNNNGNHSNDDSVLPYNIEREIVIMKLLSHPNVLSLYDVWETNNNLYLILEYAEKGELFNLLVDHGPLPEREAINCFRQIIIGISYCHALGIVHRDLKPENLLLDSFYNIKIADFGMAALQTDADLLETSCGSPHYAAPEIVSGLPYEGFASDVWSCGVILFALLTGRLPFDEENGNVRDLLLKVQKGQFEMPNDTEISRDAQDLIGKILVVDPRQRIKIRDILSHPLLKKYQTIKDSKSIKDLPRENTYLYPLADSNNHTSASIDDSILQNLVVLWHGRHADDIVSKLKENGTNKEKILYALLYRFKLDSVRGSNKKNRNKIKKTKKNKRSSTLSSSSSLLLNNRSIQSTPRRRTSKRHSREFSSSRKRSSFLLSSNPTDSSPIPLRSSKRITHINVASANTQATPSGVPNPHKRNSKKRSSKRLSYMPNTKRSSLTSKSLSNFTNLIDDDDWEYIEKDAKRTSSNFATLIDEIFEPEKFELAKREKAELQRKVQEAKRQSVNAQKINEDEFGSEVSDGMKELKKINDKVSSPLINYEFSQQELLQDIDTLLTNRYQLSSYTRPISRLDPGLTPVTETLPNNLKEKTALLQDTEKKIIETIRRSKFLGSLLNVRGGLSPGKSELAPIEESPIVSTTPLIYNDRMEPRRISDVEVPHFTRKSKHFTTANNRRSVLSLYAKDSIKDLNEFLIKEDPDLPPQGSTDNESRSEDPEIAESITDSRNIQYDEDDSKDGDNVNNDNILSDFPQGVGISQEYDMKDKNPNQSPISKSAEPTLVVKLPSLSSFQGKNASGLGLYQREPSKVTLPSLTSNNSSVGENIEDGAEKGTESEKIAASLSDDDLKEDNDKKDNDTVNAPTTVKKPPNSVLLKKFSKGKILELEIHAKIPEKRLYEGLHKLLEGWKQYGLKNLVFNITNMIITGKLVNDSILFLRSTLFEIMVLPNGDGRSLIKFNKKTGSTKTLTKLATEIQIILQKEGVLDK

SEQ ID NO: 67815 - protein, 214 aa, Mannheimia succiniciproducens MBEL55E
MNQSLLASFGSSEERVIAALDTFKQGNGVLVLDDENRENEGDLIFPAETITTEQMAKLIRYGSGIVCLCITDELCQKLELPPMVAANTSVNKTAFTVTIEAAEGVSTGVSAADRVTTVKVAVADNAKPSDLHHPGHVFPLRAAENGVLARPGHTEAAVDLARLCGYKPAGVICEITNDDGTMARTPELVAFAQKFGYAVVTIEDLIAYRTKYNK

SEQ ID NO: 67816 - protein, 676 aa, Solanum tuberosum
MAIQKWLLFLFLHLHVLNIVAQLPDLRFGICGKSGNYTENSTYKNDLNTLLTSLSSKIDKYGFYNASIGQNSDRASVIVLCRGDVELDDCRGCVDNVVQKIAQLCPNQKEVFGGYDGCMLQYSNQSIIDTPSLSVQLFLWNTANASKPEEFNQELGKLLENLRDRAAQGGPLQKYATGTTIGPDIQPIYALVQCTPDLSRQSCFDCLTDAYGTLPQCPCLGKTGGRIIGIRCNFRYEISRFFVDVPLEAPPPAGNDNKTVPTGTENKTPPTGKDDKTTRTIIIIVVSTVTIVILMICIAVILIRRRKRKLVNGIQGTSVDDTSIAESFQYDFSAIRAATDDFSDANKLGEGGFGPVYKGKLQNGQEVAVKRLSADSGQGDLESKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWLSWRNGTTIDFVDPMLKESTGLIRDIMRNIHIALLCVQESVADRPTMAAVVLMLSSFSLSLPMPSGPAFYMHSNITAETSLIKEYNTRMTDSSELAKSKSIGSSRNEASISELYPR

SEQ ID NO: 67817 - protein, 588 aa, Nicotiana tabacum
MSRQTYRVCFCFRRRFRVVAAEAPADVKNLFNKYSDNGVMNAENLQRFLIEVQKEENSSIEDAQGIMNNLHDLKILNIFHRRGLHLDAFFKYLFADINPPINPKRGIHHDMNEPLSHYFIYTGHNSYLTGNQLSSDCSDVPIIQALHRGVRVIELDIWPNSAKDDVEVLHGGTLTTPVALIKCLRSIKEHAFSVSEYPVVITLEDHLTPDLQAKVAEMITQTFGDMLFSPDSCLKNFPSPESLKRRVLISTKPPKEYLQAKEVKEKDSKKGTESPDTEAWGREVSDLKARYNDKDDSDDGAGVEDDESDEGDPNSQQNVAPEYKCLIAIHAGKGKGGLSDWLRVDPDKVRRLSLSEQELGKAVVTHGKEIIRFTQRNLLRIYPKGIRFDSSNYNPFVAWTHGAQMVAFNMQGYGRSLWLMHGMFRSNGGCGYVKKPDILLKAGPNNQIFDPEANLPVKTTLKVTVFMGEGWYYDFNHTHFDAYSPPDFYAKIGIAGVPADNVMKKTRTLEDNWIPTWDEKFEFPLTVPELALLRVEVHEYDMSEKDDFAGQTCLPVSELRQGIRAVSLHDRKGEKYNSVKLLMRFEYV

SEQ ID NO: 67818 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVEHNGSVDGFTAETLSADDFWALECEFLIPAALEGQITGKNAPQIRAKIVVEGANGPTTPEADDILRDRGILVCPDVIANAGGVTVSY

SEQ ID NO: 67819 - protein, 676 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGCMLQYSNQSILETTSFSLKYYFWNPANATKPGEFNQELGRLLENLRDRAVDDGPLQKYASGNATGPDFQAIYALVQCTPDLSRQSCFSCLSDAYGNMPRCPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERAKSKSIGSSRNEASITELYPR

SEQ ID NO: 67820 - protein, 400 aa, Geobacillus kaustophilus HTA426
MARKSFWRVGHAPTLLSSFLYFDISFMIWNLLGALGVFVAESFALTPAEKGMMVAIPVLGGALLRIPMGMLADRWGGKRAGLLGMAVTAVPLVWGWQFADRMSDVYALGFLLGVGGASFAVALPLASRWYPKEYQGLAMGIAGAGNSGTVLATLFGPRLAEAYGWNAVFGLALVPLVVVFFLFAWLARECPTAVKPVSLREYGAVLRRKEAWLFCFFYSLSFGGFVGLTGYLGIFFFDEYGVSKVTAGDFVTAVVFAGSFIRPIGGYLADRIGGMRLLSLLFAVGAVLLAFIGALPPLLIVFGLMVVLFLCFGAANGALFQVVPTWFPKEVGLLTGIIGAAGGLGGFLLPNVLGVMKQWTGSSAYGFWMLAFVFAIAVMAARRLQGTTVTIEHFSQKAAE

SEQ ID NO: 67821 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVEHNGSVDGFKAETLSADDFWALECEFLIPAALEGQITGKNAPHIRAKIVVEGANGPTTPEADDILRDRGILVCPDVIANAGGVTVSY

SEQ ID NO: 67822 - protein, 651 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGSNATKPEEFNQELGRLLENLRDRAVDDGPLQKYASGNATGPDFQAIYALVQCTPDLSRQSCFSCLSDAYGNMPRCPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERAKSKSIGSSRNEASITELYPR

SEQ ID NO: 67823 - protein, 676 aa, Solanum tuberosum
MAIQKWLLILFLHIHVLNIVAQLPDLRFGSCGGNGNYTENSTYKNNLNTLLTSLSSKIDNYGFYNASIGQNSDRASVIVLCRGDVELADCRGCVDNVVQKIAQLCPNQKEVFGGYDGCMLQYSNQSILETTSFSLKYYFWNPANATKPEEFNQELGRLLENLRDRAVDDGPLQKYASGNATGPDFQAIYALVQCTPDLSRQSCFSCLSDAYGNMPRRPCLGKRGGRIIGVRCNFRYESSRFFEDVPLEAPPPAGNDNTTVPTGTDDKTVPTGEDDKTTRTIIIIVVSTVTVVILIICIAVILIRRRKRKLVNEIQSTSVDDTSIAESFQYDFSAIRAATDDFSDANKLGEGGFGPVYKGKLQNGQEVAVKRLSADSGQGDLEFKNEVLLVARLQHRNLVRLLGFCLDGTERLLVYEFVPNASLDHFLFDSVKRRQLDWERRSKIIGGIAKGILYLHEDSRLRIIHRDLKASNVLLDAEMNPKISDFGMARLFELDETQGSTNRIVGTYGYMAPEYAMHGQFSVKSDVFSFGVLVLEILSGQKNTCFRNGESVEDLLSFAWSSWRNGTTINFVDPMLKESTGLIRDIMRNIHIALLCVQESVADRPTMAAVVLMLSSFSLSLPMPSGPAFYMHSNITAGTSLIQEYNTRVTDSSERVKSKSIGSSRNEASITELYPR

SEQ ID NO: 67824 - protein, 258 aa, Ralstonia solanacearum
SVKNAAVNVPYGGAKGGVRVDPRKLSSGELERLTRRYTSEIGIIIGPNKDIPAPDVNTNAQIMAWMMDTYSMNEGATATGVVTGKPIALGGSLGRREATGRGVFVVGSEAARNLGIDVKGARIVVQGFGNVGSVAAKLFQDAGAKVIAVQDHKGIVFNGAGLDVDALIQHVEHNGSVDGFKAETLSADDFWALECEFLIPAALEGQITGKNAPQIRAKIVVEGANGPTTPEADDILRDRGILVCPDVIANAGGVTVSY

SEQ ID NO: 67825 - protein, 383 aa, Zea mays
  misc_feature (334)..(334): Xaa can be any naturally occurring amino acid
MGQCVSAPRHRKPPPLPLSPALSFRPQILSSIADAVGEDHTADLPEELLALVFGLLGSGDRKRCSLVCRRWPVVEAASRFRLAIDARASPLAESALPRLLARFPAVSKLALKCDRRAESVGDPALAQVADRLGPGLRRLKLRSLRAVTDDGVAALAAAAANLRKLSVGSCDFGAKGIEAVLRSCLHLEELSVKRLRGLAESEPISVSSPRLQSLSLKDLYNGQCFSCLITQSPNLKTLKIIRCAGNWDIVLQDVPRDSLLAELHLEKLQVSDWGVAALYGLEVLYLAKAPEVTDIGLAELAAKSPRLRKLHVDGWKANRIGDRGLAAVAQKCSXLQELVLIGVNLTSLSLELIATNCPTLERLALCGSDTFGDAEMSCVASKC

SEQ ID NO: 67826 - protein, 339 aa, Salmonella typhimurium LT2
MGSSHHHHHHSSGLVPRGSHMKAMNKVWVIGDASVDLVPEKQNSYLKCPGGASANVGVCVARLGGECGFIGCLGDDDAGRFLRQVFQDNGVDVTFLRLDADLTSAVLIVNLTADGERSFTYLVHPGADTYVSPQDLPPFRQYEWFYFSSIGLTDRPAREACLEGARRMREAGGYVLFDVNLRSKMWGNTDEIPELIARSAALASICKVSADELCQLSGASHWQDARYYLRDLGCDTTIISLGADGALLITAEGEFHFPAPRVDVVDTTGAGDAFVGGLLFTLSRANCWDHALLAEAISNANACGAMAVTAKGAMTALPFPDQLNTFLSSHSLAQAMTVK

SEQ ID NO: 67827 - protein, 144 aa, Oryza sativa
  misc_feature (16)..(16): Xaa can be any naturally occurring amino acid
GPESPGTPHVVLPNIXCHPTRGSFMCLVRGPLERAPRYACAQADKASQLNRNYTHYSTERTPIMADPTFASSIDTGDPESRDGPMDALKATLGTDPVATVEELMRTMTVADRTERPGSSDTVVALNKMMKLTHQKMTGANDRTE

SEQ ID NO: 67828 - protein, 299 aa, Streptococcus agalactiae 2603V/R
MKVRKAVIPAAGLGTRFLPATKALAKEMLPIVDKPTIQFIVEEALKSGIEDILVVTGKSKRSIEDHFDSNFELEYNLKEKGKNELLKLVDETTGIRLHFIRQSHPRGLGDAVLQAKAFVGNEPFVVMLGDDLMDITNNKVIPLTKQLINDFEATHASTIAVMEVPHEDVSAYGVIAPQGEGVNGLYSVNTFVEKPSPEEAPSNLAIIGRYLLTPEIFNILETQKPGAGNEIQLTDAIDTLNKTQRVFARKFTGDRYDVGDKFGFMKTSIDYALQHPQVKDDLKKYIIDLGKSLEKTSKK

SEQ ID NO: 67829 - protein, 252 aa, Triticum aestivum
SGFLSNAASAVLKRLWSLKSTVKTASGAKSMVKYEGGYTVETVFDGSKLGIEPYSVEVTQGGELLVMDSMNSNIYRIALPLSRYSRPKLVAGSPEGIPGHVDGRLREAKMNHPKGFTVDGRGNIYVADAMNMAVRKISDTGVTTIAGGKSSRGGHVDGPSDDAKFSTDFEVRYIASSCSLLVIDRGNQAIREIQLNFDDCVYQYEAGFPLGVALLLAAAFFGYMLALLQRRVLGMVSTEDELQTPMKASIAS

SEQ ID NO: 67830 - protein, 241 aa, Thermoplasma volcanium GSS1
MPDYEKQKRNAAVEAASYVKTGMVIGIGTGTTARYLIEELGRRVSEENLKIKGVCTSKKSEELARAAGIEISENPEQIIDLTIDGADQVNLHGTLIKGGGGALLREKIVAYNSKEMYVIVDSRKIDDENFGSFPLPVEVVPFLHRMTLENLRKICPSTDLRKNSDGTLFITDNGNYIADMKFGRIRETNELEKKIKSIPGVVDVGLFNNIADKIFEGNDDGCNIYVVSEKGRIEKEKGQFK

SEQ ID NO: 67831 - protein, 497 aa, Arabidopsis thaliana
MPQAPMPEFSSSVKLKYVKLGYQYLVNHFLSFLLIPIMAIVAVELLRMGPEEILNVWNSLQFDLVQVLCSSFLVIFISTVYFMSKPRTIYLVDYSCYKPPVTCRVPFATFMEHSRLILKDKPKSVEFQMRILERSGLGEETCLPPAIHYIPPTPTMDAARSEAQMVIFEAMDDLFKKTGLKPKDVDILIVNCSLFSPTPSLSAMVINKYKLRSNIKSFNLSGMGCSAGLISVDLARDLLQVHPNSNAIIVSTEIITPNYYQGNERAMLLPNCLFRMGAAAIHMSNRRSDRWRAKYKLSHLVRTHRGADDKSFYCVYEQEDKEGHVGINLSKDLMAIAGEALKANITTIGPLVLPASEQLLFLTSLIGRKIFNPKWKPYIPDFKLAFEHFCIHAGGRAVIDELQKNLQLSGEHVEASRMTLHRFGNTSSSSLWYELSYIESKGRMRRGDRVWQIAFGSGFKCNSAVWKCNRTIKTPKDGPWSDCIDRYPVFIPEVVKL

SEQ ID NO: 67832 - protein, 497 aa, Saccharomyces cerevisiae
MLKSTATRSITRLSQVYNVPAATYRACLVSRRFYSPPAAGVKLDDNFSLETHTDIQAAAKAQASARASASGTTPDAVVASGSTAMSHAYQENTGFGTRPIYLDMQATTPTDPRVLDTMLKFYTGLYGNPHSNTHSYGWETNTAVENARAHVAKMINADPKEIIFTSGATESNNMVLKGVPRFYKKTKKHIITTRTEHKCVLEAARAMMKEGFEVTFLNVDDQGLIDLKELEDAIRPDTCLVSVMAVNNEIGVIQPIKEIGAICRKNKIYFHTDAAQAYGKIHIDVNEMNIDLLSISSHKIYGPKGIGAIYVRRRPRVRLEPLLSGGGQERGLRSGTLAPPLVAGFGEAARLMKKEFDNDQAHIKRLSDKLVKGLLSAEHTTLNGSPDHRYPGCVNVSFAYVEGESLLMALRDIALSSGSACTSASLEPSYVLHALGKDDALAHSSIRFGIGRFSTEEEVDYVVKAVSDRVKFLRELSPLWEMVQEGIDLNSIKWSGH

SEQ ID NO: 67833 - protein, 192 aa, Helicobacter pylori J99
MKRLEVSNQAKLPTQFGEFCIQCFREKGSNGSKDHLVIFTPNFPQNPLVRLHSECLTGDALGSQKCDCGGALQMALERISKEGGLVIYLRQEGRGIGLFNKVNAYALQDKGYDTIQANEMIGFKDDERDYSIAGEILEYYRIKKMRLLTNNPLKIAALEKYAEVTRESLIVCANEHNQGYLEVKKLKMGHLL

SEQ ID NO: 67834 - protein, 341 aa, Musa acuminata
MDHEAEAHRTDLMTITRYVLNEQSRHQESRGDFTILLSHIVLGCKFVCSAVNKAGLAKLIGLAGETNVQGGSKRKLDVLSNEVFVKALISSGRTCILVSEEDEEATFVDPSLRGKYCVVFDPLDGSSNIDCGVSIGTIFGVYMVKDKDNVTLDEVLQPGKNMLAAGYCMYGSSCTLVLSTGSGVNGFTLDPSLGEFILTHPDIKIPKKGKIYSVNEGNAKNWDGPTTKYVEKCKFPKDGDSPKSLRYIGSMVADVHRTLLYGGIFLYPADKKSPNGKLRVLYEVFPMSFLMEQAGGQAFTGKQRALDLVPTKIHQRSPIFLGSYDEVEEIKALYAAEENTA

SEQ ID NO: 67835 - protein, 344 aa, Helicobacter pylori J99
MILRRVTEALEAYKNGEMLIVMDDEDRENEGDLVLAGIFSTPEKINFMATHARGLICVSLTKDLANKFELPPMVSVNDSNHETAFTVSIDAKEAKTGISAFERHLTIELLCKDTTKPSDFVRPGHIFPLIAKDGGVLARTGHTEASVDLCKLAGLKPVSVICEIMKEDGSMARRGDKFLSDFAIKHNLKTLYVSDLISYRLENESLLKMFCQEEREFLKHQTQCYTFLDHQQKNHYAFKFKGAKTHDLAPLVRFHPIKEDFDFLTTGAFEAFFKALEYLKREGGYLIFMNTHSEQNNIVKDFGIGALVLKNLGVKDFRLLSSCEDRQYKALSGFGLKLVETISL

SEQ ID NO: 67836 - protein, 324 aa, Aquifex aeolicus
MHEIFYTGCGKVGNTLATHLDRKGHEVLLYDINEEVVKKINEGIHPYVEGIRFKNVKATTDLNQINEFKNLICALPVQVIPKVITKVNLKGKNFISASKGIIHENLKRISQLVKEIEPKLKFFVLSGPSFAEEVSKGLPTAIVLAYEDKEEAMKLQDALDSENFNVYLNDDITGVELGGALKNVIAIAVGLSDGMGYGYNARSAIITRGLHEMANVGEKFGARRETFFGLSGAGDLILTSTSDLSRNRTFGKLLGQGYSVEEALKKINQTVEGVKTAEALYEIIKRENIFAPICEGVYRIIKGEDPKKVYPHFLSNHLREEFQR

SEQ ID NO: 67837 - protein, 306 aa, Escherichia coli
MSTRVWVLGDAVVDLLPESQGRLLQCPGGAPANVAVGIARLGGKSAFIGKVGDDPFGRFMYQTLSKENVDTRYMSLDPQHRTSIVAVGLDEQGERNFTFMVRPSADLFLQPDDLPAFGPGEWLHLCSIALSAEPSRSTAFLAMEKIRQAGGNISFDPNIRSDLWQSEALLRKYLDRALSLANIAKLSEEELLFISGESQVQQGAYSLVQRYSLTLLLITQGKNGVLVYFQGQFIHYPAKPVSVVDTTGAGDAFVAGLLAGLADSGIPTNTRQLERIIAQAQICGALATTAKGAMTALPRQHDLPSQ

SEQ ID NO: 67838 - protein, 495 aa, Glycine max
  misc_feature (204)..(204): Xaa can be any naturally occurring amino acid
  misc_feature (344)..(344): Xaa can be any naturally occurring amino acid
MYRNAASRLRVISARSCSSSRIPASARFASSVATQQSSSGLGGLFGWLTGDRSSSLPSLDFPLPGVTLPPSLPDFVAPGKTIITTLPNGLKVASETSPTPTASVGLYVDCGSIYETPISFGATHLLERMAFKTTRNRSHFRVVREVEAIGGNVQASASREQMGYTFDALKTYVPEMVELLVDCVRNPVFLDWEVNEQLLKVKAXVVKLSVLAGALANPLLASESALNRLNGTILEEFVAENYTAPRIVLAASGVEHEELLSVAEPLLSDLPSVPRLEEPKSVYTGGDYRCQSESGRTHFALAFELPGGWHKLKDAMVLTVLQMLLGGGGSFSAGGPGKGMYSRXYLNVLNEYPQVHSISAFNNIYNGTGIFGIQVTTGSDFVSKAIDIAANEILGVATPGQVDQAQLNRAKQATKSAILMNLESRMVVSEDIGRQILTYGERKPVEDFLKAVDEVTSKDITSISQKLISSPLTMASYGDVLYVPSYESVSLKFRS

SEQ ID NO: 67839 - protein, 154 aa, Physcomitrella patens subsp. patens
MIQGESERSYVMVKPDGVQRGLVGEIISRFERKGFQLIGLKLFKTPKELAEEHYGELKEKPFYGKLVAYIISGPVVCIALEGPGIVASARKLIGATNPLNAEPGTIRGDLGIDVGRNVVHGSDSPENGLRELGLWFDDDELIQWDQHMTPWLKE

SEQ ID NO: 67840 - protein, 553 aa, Arabidopsis thaliana
MAPIDVGDFVPDGSISFFDDDDQLQTVSVHSLAAGKKVILFGVPGAFPPTCSMNHVNGFIEKAEELKSNGVDEIICLSGDDPFMITACSENKHVKFVEDGSGEYIQLLGLELEVKDKGLGVRSRGFALLLDNLKVIVVNVGSGGDCSLFQLMKMTTTTMSNLPTDLLEEIISRVPRKYMRAVRLTCKRWNGMFKSQSFTKMHIGKEEAATRELRQTRMIVMMDYNVYLMGIAVNEIPSIETLGKLTCLDDSEQVKISQVFCCEGLLLCILKDDDTKIVVWNPYLGQTRWIQTRLICCVSGWKKYALGYGNNSENRSCRSPKILRVTDNFNIFSENIPLQYEIYDFDSDVWTTLDVSPHWFIMSERGLSLKGNTYWGAKERHAYGSIDHIICFDFTRERFGPLLPLPFSAWGAQFASLSSVREDKITALFQNCRAYKLELWITTKIDVNNATWSKFFTMDTPYLHEILSLKTFFIDEENKIVVVSNKERDTKGDLTHDSIDIINGEARCLWKLGLGKPADKNCWPLVCPYVPSVVQIKQHKGGKTKEQSDYKRH

SEQ ID NO: 67841 - protein, 162 aa, Clostridium perfringens ATCC 13124
MHCTFIKSTDVILREIEKYIPKMYKCLMEIYQHIGEDDEEEIIKEQYSLIDGISIDFGVMQKTRRSFVIKCDFSWDDIGTFSALSRFLGPNGNNRTSDNVFLEECENCSVFGKEKLIIGFGIKDLVLVDAGDVILVMDKGRDQEIKHLLNSISGKKEFKEYL

SEQ ID NO: 67842 - protein, 338 aa, Streptococcus agalactiae 2603V/R
MTKQKIAVLGPGSWGTALAQVLNDNGHEVRLWGNVVEQIEEINTNHTNQRYFKDITLDSKIKAYTNLEEAINNVDSILFVVPTKVTRLVAKQVANLLKHKVVLMHASKGLEPGTHERLSTILEEEISEQYRSDIVVVSGPSHAEEAIVRDITLITAASKDIEAAKYVQKLFSNHYFRLYTNTDVVGVETAGALKNIIAVGAGALHGLGYGDNAKAAIITRGLAEITRLGVQLGADPLTFSGLSGVGDLIVTGTSVHSRNWRAGDALGRGEKLEDIEKNMGMVIEGISTTKVAYEIAQNLNVYMPITEAIYKSIYEGANIKDSILDMMSNEFRSENEWH

SEQ ID NO: 67843 - protein, 553 aa, Arabidopsis thaliana
MSSDQRWRLLRPAFFIFFFLFFLPHNLTFGLCFNTEALALMKFKERIEIDPFGALVNWGELSHCSWSGVVCSHDGRVVILNLRDLSLQGTLAPELGNLTHLKSLILRNNSFSGKVPEEVTELQELEILDLCDNNFGQPFPFARRLLQISPPPSQPSPPSPMEEVPIDFPFFFAPPPQNIGASPPTETQVIPNPSPVPPPPAQPPPAQTPPPQLSEVPHAVNKKKSHKSKMYIIVGVLVGVLGVMAALVAFFFLWNQKVKLIKPWGETGSSGQLQDVVTTGVPKLKLAELETACEDFSNIIGSTSSDATIYKGTLSTGSEIAVLAVASGSLQDWSEDHETQFQEKRLSQVNHKNFLNVIGYCHEDEPFNRMLVFEYAPNGSLFEHLHDQDAEHLDWPMRLRIVMGIAYCMEHMHNLNPKPISHTNLNSSSVYLATDYAAKVSDFTFLSSTPLDPMTNVSSFGALLQEIITGKIPDPDSLLQEETKPVADPTLKSFQEEVMERVWEVVKECLSQKVEMKEVVVKLREITGITPEAALPSRSPAWWAELEIISTEM

SEQ ID NO: 67844 - protein, 448 aa, Pseudomonas fluorescens Pf-5
MRLSSECKTTSLDQLSRLPEAHGYRLGSLCFPIVFAGTKMTSSEATAVRFSLSQRALGLSAPGTSSMRSKANALKESGIKVINFAAGELSFDACEDMRAGAIEAIANARNRYTPPIGLPALREKLAQRVSQRTGVEFAANEVAVTAGAKQALYNACMVLLNPGDEVIVPTPYWETFPTQIRLAGATPVCVQTRADHYRLTVDAVCGALTERTRMIVINTPNNPTGTVYEREQLLAIAQLAQERQLWVMFDECYRGLVREGHEHHNILALCPALKGQTVLIDSFSKSQAVTGWRVGYACAPAPVIAAMHNLQGHTTSNPSSLSQYAALNTLNADSSHFADLVNPFLQRQLHAARTYLDRLEGVSYAPPEGAFYLYIDVSSRLGGYYQGEAVRDVDHLADLLLTEAHIAVVPGSGCGDPHCIRISYAVEYEELIEGLGRFAQFISAIVID

SEQ ID NO: 67845 - protein, 486 aa, Bacillus anthracis str. Ames
MITTEIKRVKNHINGEWVESTGTEVEAVPNPATGKIIAYVPLSPKEDVEKAVEAAKAAYETWSKVPVPNRSRQLYKYLQLLQENKEELAKIITLENGKTLTDATGEVQRGIEAVELATSAPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFHEDNYVGPLIRESHKERVLGYINSGVADGATLLVDGRKIKEEVGEGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLGTNGTDGVQFYTRKKVVTERWF

SEQ ID NO: 67846 - protein, 275 aa, Bacteroides fragilis
IDKVGDPFPEETYRVCKNADAVLFSAVGDPKFDNDPTAKVRPEQGLLAMRKKLGLFANIRPFQTFKCLVHKSPLRAELVEGADFLCIRELTGGMYFGEKYQDNDKAYDTNMYTRPEIERILKVGFEYAMKRRKHLTVVDKANVLASSRLWRQIAQEMAPQYPEVTTDYMFVDNAAMKMIQEPKFFSVMVTENTFGDILTDEGSVISGSMGLLPSASTGESTPVFEPIHGSWPQAKGLNIANPLAQILSVAMLFEYFDCKAEGALIRKAVDASLDA

SEQ ID NO: 67847 - protein, 387 aa, Geobacter metallireducens GS-15
MPFDFKLPDLGEGITEAELRKWLVKEGDTVREHQPVAEVETDKAVVEVPSPRGGRVGRLARREGETVAVGATLFTIEEEGEAPPERPKSVGIVGELPEAEEAREVIATPLVRKLARERGIDLATVRGSGPRGSITPDDLEKVSAPVAQPAESFGPVELVPLRGVRRAVARNVMASQRNTAFVTGMEEADITELWELRRRELGAVETRGAHLTFLPFFIKAVQHALREHPYLNAAIDDTAETIILKRHYHFGIAVETPDGLMVPVIRDVDRKSIIELAAEIQGLGSKARKRTISLDELKGSTFTLTNYGHFGGVFATPIINWPDVAILGFGRIGERPWIHKGQIAIRRILPLSLTFDHRVTDGADAAQFLLKVVAYLEDPALLFIEST

SEQ ID NO: 67848 - protein, 514 aa, Brassica napus
MTYQRKRNKQSMAITVPRRQLFIGGQWTEPLRRQTLPVVNPATEDIIGYIPAATSEDVELAVEAARKALTRNKGNDWSKASGAVRARYLRAIAAKVTERKSELANLEAIDCGKPLDEAAWDMDDVAGCFEYYADLAQGLDSKQKAPLSLPLDTFKGYVLKEPIGVVGLITPWNYPLLMAVWKVAPALAAGCTAILKPSELASVTCLELADICREVGLPPGVLNILTGLGTEAGAPLASHPHVDKIVFTGSTATGSNIMTSAAKLVKPVSLELGGKSPIIVFDDVKIDKAVEWTMFGCFWTNGQICSATSRLLVHEKIADEFLDKLVKWTKNIKISDPFEEGCRLGPVVSKGQYERVVKFVSNARKEGATVLCGGARPGHLKKGYFVEPAIISNVTTSMEIWRDEVFGPVLCVKTFSTEDEAIQLANDSQYGLAGAVLSNDLERCDRVSKAFEAGIVWVNCSQPCFCQAPWGGTKRSGFGRELGEWGLENYLSVKQVTQYISNEPWGWYKSPSKL

SEQ ID NO: 67849 - protein, 167 aa, Triticum aestivum
SLEQVCTKKQAGTGPEFPGYRRPTRPYIRSGAGIGKREYADFPLPIALAENSGRCKTNENGAKILPDGTPWIPNLMKEITIVVSNGSKSIHVDQKLIDGPNPNNRWKKYIPLILAVQYFFVVKGIRRAIHSDISNGKLDDWEQRYRDLVGSGNPVDQKVSSSRNPKA

SEQ ID NO: 67850 - protein, 275 aa, Bacteroides fragilis
IDKVGDPFPEETYRVCKNADAVLFSAVGDPKFDNDPTAKVRPEQGLLAMRKKLGLFANIRPVQTFKCLVHKSPLRAELVEGADFLCIRELTGGMYFGEKYQDNDKAYDTNMYTRPEIERILKVGFEYAMKRRKHLTVVDKANVLASSRLWRQIAQEMAPQYPEVTTDYMFVDNAAMKMIQEPKFFDVMVTENTFGDILTDEGSVISGSMGLLPSASTGESTPVFEPIHGSWPQAKGLNIANPLAQILSVAMLFEYFDCKAEGALIRKAVDASLDA

SEQ ID NO: 67851 - protein, 271 aa, Staphylococcus aureus subsp. aureus MRSA252
MKLVFYGAGNMAQAIFTGIINSSNLDANDIYLTNKSNEQALKAFAEKLGVNYSYDDATLLKDADYVFLGTKPHDFDALATRIKPHITKDNCFISIMAGIPIDYIKQQLECQNPVARIMPNTNAQVGHSVTGISFSNNFDPKSKDEINDLVKAFGSVIEVSEDHLHQVTAITGSGPAFLYHVFEQYVKAGTKLGLEKEQVEESIRNLIIGTSKMIERSDLSMAQLRKNITSKGGTTQAGLDTLSQYDLVSIFEDCLNAAVDRSIELSNIEDQ

SEQ ID NO: 67852 - protein, 400 aa, Neisseria meningitidis
MPCMNHQSNSGEGVLVAKTYLLTALIMSMTISGCQVIHANQGKVNTHSAVITGADAHTPEHATGLTEQKQVIASDFMVASANPLATQAGYDILKQGGSAADAMVAVQTTLSLVEPQSSGLGGGAFVLYWDNTAKTLTTFDGRETAPMRATPELFLDKDGQPLKFMEAVVGGRSVGTPAIPKLMETIHQRYGVLPWGKLFDTPIRLAKQGFEVSPRLAISVEQNQQHLARYPKTAAYFLPNGVPLQAGSLLKNLEFADSVQALAAQGAKALHTGKYAQNIVSVVQNAKDNPGQLSLQDLSDYQVVERPPVCVTYRIYEVCGMGAPSSGGIAVGQILGILNEFSPNQVGYDAEGLRLLGDASRLAFADRDVYLGDPDFVPVPIRQLISKDSWIRISSATLVY

SEQ ID NO: 67853 - protein, 275 aa, Bacteroides ovatus
IDKVGDPFPEATYQVCKDADAVLFSAVGDPKFDNDPTAKVRPEQGLLAMRKKLGLFANIRPVQTFKCLIHKSPLRAELVENADFICIRELTGGMYFGEKYQDNDKAYDTNYYTRPEIERILKVAFEYAMKRREHLTVVDKANVLASSRLWRQIAQEMAPNYPEVTTDYMFVDNAAMKMIQEPAFFDVMVTENTFGDILTDEGSVISGSMGLLPSASTGESTPVFEPITGSWPQAKGLNIANPLAQILSVAMLFEYFDCKEEGALIRKAVDASLDE

SEQ ID NO: 67854 - protein, 275 aa, Bacteroides ovatus
IDKVRDPFPEATYQVCKEADAVLFSAVGDPKFDNDPTAKVRPEQGLLAMRKKLGLFANIRPVQTFKCLIHKSPLRAELVENADFICIRELTGGMYFGEKYQDNDKAYDTNYYTRPEIERILKMAFEYAMKRRKHLTVVDKANVLASSRLWRQIAQEMAPNYPEVTTDYMFVDNAAMKMIQEPAFFDVMVTENTFGDILTDEGSVISGSMGLLPSASTGESTPVFEPIHGSWPQAKGLNIANPLAQILSVAMLFEYFDLKEEGALIRKAVDVALDE

SEQ ID NO: 67855 - protein, 555 aa, Desulfovibrio desulfuricans G20
MNLTEALLHALKERGAKEVYGIPGDFALPYFKIIESTGILPLVTLSHEPAVGFAADASARFRGGLGVAAVTYGAGALNMVNAIAQAYAEKSPVVVISGAPGTHEGGHGLLLHHQAKHLDSQYRMYKEVTCDQAVLDDPATAPETIARVLQSCIEHSRPVYLEIPRDLPAAPCAPVPAFAASGTDADAVDACARDVLQRVQSAALPMMMVGVEVRRYGIEDKVALLAERLGVPVVTSFMGRGLLASASCLEGTYLGMAGDETLSEAVESSDGLLLLGVIMSDTNFGVSGSQLDRRRVMHAEDRQVRVGYHVYHDIPLGALVDRLLALLDDGQEADMALSGCGGSSDDRALQGAGLAVNPRGFMADAADITPTDIAALLNDFFASHGAMPVASDIGDCLFTMLSVDAIPMVAPGYYASMGFGVPAGMGLQITTKERSLILVGDGAFQMTGMELGNCTRLGIDPIVLVFNNSSWEMLHVFQPETAYSNLGEWDFAAVADGLGGRGHRAATRAELARALTQAHAERGRFQLIDARLAPHSLSPTLARFVEGVRRFSSGQ

SEQ ID NO: 67856 - protein, 162 aa, Glycine max
  misc_feature (109)..(109): Xaa can be any naturally occurring amino acid
  misc_feature (154)..(154): Xaa can be any naturally occurring amino acid
  misc_feature (159)..(160): Xaa can be any naturally occurring amino acid
TAITYFRRVYTRKSMSEYDPRLVAPACLYLASKVEESTVQARLLVFYIKKMCAGSDDKYRFEIKDILEMEMKLLEALDYYLVVYHPYRPLLHLLQDAGVTDLTQFAWGXVNDTYKMDLILVQPPYMIALACIYIASVLKDKDTTSWFEELHVDXNIVKXXSM

SEQ ID NO: 67857 - protein, 211 aa, Chlorobaculum tepidum
MPLLGDDFPELKVQTTHGPMNIPGDLKGSWFVLFSHPADFTPVCTTEFVAFQQRVEAFEKIGCKLIGMSVDQVFSHIKWVEWIKENLDVDITFPIVAANDRIANKLGMLHPGKGTNTVRAVFVGDPNGKVRLVLYYPQEIGRNMDEILRAVKVLQISDSNKVAMPADWPNNLLIKDHVIIPPANNVEDAKKRKEQQYDCYDWWFCHKPLDK

SEQ ID NO: 67858 - protein, 416 aa, Saccharomyces cerevisiae
MSLSSKLSVQDLDLKDKRVFIRVDFNVPLDGKKITSNQRIVAALPTIKYVLEHHPRYVVLASHLGRPNGERNEKYSLAPVAKELQSLLGKDVTFLNDCVGPEVEAAVKASAPGSVILLENLRYHIEEEGSRKVDGQKVKASKEDVQKFRHELSSLADVYINDAFGTAHRAHSSMVGFDLPQRAAGFLLEKELKYFGKALENPTRPFLAILGGAKVADKIQLIDNLLDKVDSIIIGGGMAFTFKKVLENTEIGDSIFDKAGAEIVPKLMEKAKAKGVEVVLPVDFIIADAFSADANTKTVTDKEGIPAGWQGLDNGPESRKLFAATVAKAKTIVWNGPPGVFEFEKFAAGTKALLDEVVKSSAAGNTVIIGGGDTATVAKKYGVTDKISHVSTGGGASLELLEGKELPGVAFLSEKK

SEQ ID NO: 67859 - protein, 700 aa, Desulfovibrio desulfuricans G20
MFLNEHMSKVLFAEAGIDTPAGDLLTPGQLAEYTPAVSAPWFLKAQVLTGGRGKAGGIRRAATLKELRETAQDMFTMEIKGHRVPFLRIESATDIRRECYLSFVLSRERRDLLLTTSRAGGIHVESSTGQQKPLVQRVPLDSGLREHHLRAAFFEMGVEKEHWAGFKAMAEKLYRAVREYGLLLAEINPLVLTCDGRWVALDGKVELDDSVVDLQPDLERFYTPEHHSREENLAREAGLSYVELKGWVGILVNGAGLAMATMDLLNFSGLSAANFMDLGGAADASRMRRALDLLFENRNVRAVFINLFGGIVSCADVARALVDALEGGDAPKPIVVRMAGHESAEGRALLHDFAHPSVTIAQEMHEALDALRSMKPADVPRIEFPLPQEPDPVPQHNGQEAAACVPVYNGMGLDSSSGVLVQGLTGRVAQRHAALMMEYGTRVVAGVTPFKGGQEVMGIPVYDSVHEACRHHRIDASIIFVPAAFAPDAVLEAAAEEIPWVVCITEGIPQAAMLSALKNIQPSPTCVVGPNTPGIVVPHQLKIGIMPGYVFSPGPVAVFSRSGTLTYEAASRLSAAGIGQSVCVGVGGDSFVGTGFVDLCERVRHDAATRAVLVLGEVGGRAEEELAEYVRRTGFSKPVVSFVAARTAPPGRRLGHAGAILDETTGGVEAKLQAMREAGFTICPDLASLPRIMRAVLDRA

SEQ ID NO: 67860 - protein, 258 aa, Oryza sativa
MRGSGNSALWPGARRPMASSSSAASGKSRPECINSSNPFHECSDYCLRKIAEAKERIEDEQRPPVDRTVHPDCINASDPYHVCSEYCFKRIADAKSGLERAEQEPPSADAGKSDAAQAEGGGGDDDAEQVDAGSDDGYLQMTEKQKKLFELRLKMNEARKANQQAMVAEKKRMEPRAESRGVSKQKWLEDRKKKIGKLLDSNGLDMTKSYMLDTQESGEAESTRGKRPAQLLGVHQRPIDAQQSPTWGQRVQRKKLDI

SEQ ID NO: 67861 - protein, 226 aa, Zea mays
MDVDVDEATATPASASAKPASNGEAPSGAREVDVGEEYTLAGVLRSFVDGVWYPDEPLLRRLRAASCEAAPRLKGASRNSARDLLEWTRQGSGLRAILVISVGTIMPIALTGLLIFMFFLLIATANAIIVSALMSLAAAGGFLAIFFACLVAVYIGAVGVAIFAISAIVISSVVGVMITTGWVGFFWMIWFTARKSMDLTKHSISMTSSAVQSYSASRQVKQKHVD

SEQ ID NO: 67862 - protein, 182 aa, Oryza sativa
  misc_feature (46)..(46): Xaa can be any naturally occurring amino acid
MGNVFANLFNSLFSKRDMRILMVGLDAAGKTTILYKLKLGEIVTGXGTIGFNVKTVEYKNISFTVWDVGGQDKIRPLWRHYFQNTQGLIFVVDSNDRERVGEARDELHRMLQEDELINAVLLIFANKQDLPNAMNAPEITDKLGLHSLRNRNWYIQATCATTGDGLYQSLVWFSNQLKNVKN

SEQ ID NO: 67863 - protein, 255 aa, Helicobacter pylori J99
MLSRLDKERYLRHIMLEDVGEEGQLKLLKSSVLVIGAGGLGSAVLMYLCTAGIGKIGIVDFDSVDMSNLKRQIIHSQDCLNHSKASSAKARLKQLNAGIEVETFEERFKAHNALPLIEPYDFIIDATDNFNAKFLINDACVLAQKPYSHAGVLKYRGQSMSVLPHSACLACVFDKPPKKGFNPTSGLWGVLPGVLGCIQASECLKYFLGFETLLINTLLIADIKTMDFKKIQAPKNPDCRVCGTHKITHLQDYEI

SEQ ID NO: 67864 - protein, 464 aa, Glycine max
MERKRNNPTSFTMFTLLLGVLSQNLVIPVISTTTTIEDHNSPDPHAGTDLSNSLCSYCSPDHGSGSSGHGSSPHHSHHGSPSHHGSPSHHGSPSHGGGGSYNPTPSTPPGGGSYDPTPSPPSGGGGSYNPTPLTPPGGGSYDTTPSPPLGGGGSYNPTPSTPPGGGSYDPTPSPPSGDGGGGSYNPTPSTPPGGGSYDPTLSPPTNGGSYNPTPSTPPGGGSYDPTPSPPSGGGSYNPTPSTPPGGGSYDPTPSPPTDGGSYNPTPSPPSGSNCGTPPQDPSTPTPSVPTTPSTPSNPPLGGGGYYNSPPTYGGGSPPTPITVSPPSTPIDPGTPTIPSTPPYLPSPTPFTGTCNYWNTHPGIIWGLLGWWGTLGHAFGVSSIPGFGASRSLPQALSNTRTDGLGALYREGTASFLNSLVNNRFPYTTQQVRDRFVASLASNNAAAAQANLFKMANEGRMKPRA

SEQ ID NO: 67865 - protein, 219 aa, Zea mays
IETFMNYQDSIRRCVCIVYDPSRSSQGVLALKALKLTDSFMDLYRNNGLTGEKLREKKLSWVDIFEEIPIKVSNSALVSAFMKELEPESPVTQCDLDRLKLSTAPFMERNLEFLIGCMDDLSSEQNKFQYYNRNLSRQQSQQQAWLQKRRQENMARKAAGEEPLPEEDPSNPIFKPIPEPSRLEGYLVTNQICSYCNHINGVAGQNFDRLYLMKALHED

SEQ ID NO: 67866 - protein, 262 aa, Neisseria meningitidis
KTSTRTRCAFEVAARDQGAGVTYLEPSASQIGHKESIKDTARVLGRMYDGIEYRGFAQETVEELTKYAGVPVFNGLTNEFHPTQMLADALTMREHSGKPWNQTAFAYVGDARYNMGNSLLILGAKLGMDVRIGAPQSLWPSEGIIAAAHAAAKETGAKITLTENAHEAVKNVDFIHTDVWVSMGEPKEVWQERIDLLKDYRVTPELMAASGNPQVKFMHCLPAFHNRETKVGEWIYETFGLNGVEVTEEVFESPASIVFDQA

SEQ ID NO: 67867 - protein, 184 aa, Triticum aestivum
  misc_feature (51)..(51): Xaa can be any naturally occurring amino acid
PAIYLHSTALAPPVMALSPTSVALFQGLKSTPGLPVSRRSNGASLGSVSNXGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 67868 - protein, 317 aa, Synechocystis sp. PCC 6803
MSFANADTPPQVVVLGAGAWGSSLAYVLNNNDIPTQVWSRRSPQSLESMVAGADVIVSAVSIKGVPSVAARLEAMDLQRRTILVTATKGLDPETMTTPSQIWQAALPSQPIAVLSGPNLSKEIDQGLPAATVVASSDQAAAEEIQTIFAADNFRVYTNNDPLGTELGGTLKNVMAIAVGVCEGLGLGTNAKSALITRALPEITRVGLHFGAQPDTFWGLAGLGDLLATCSSMLSRNYRVGYGLSKGQSLEEILANLGGTAEGVNTTDVLIKIANREKIAVPITRQVYRLLHGKITPPQAVEALMERELKAEFEDFDL

SEQ ID NO: 67869 - protein, 365 aa, Mycobacterium sp. MCS
MKVLVEADGGSRGNPGPAGYGSVVWSEDRSSVLAEAKQSIGRATNNVAEYRGLIAGLEEAANVGATEVAVSMDSKLIVEQMAGRWRVKHPDLIPLYQRARELAEGFDRVTYSWIPRAANARADRLANEAMDAAQGIDPPPRTAAPAASTHTPTSPAGWTGARGEPTRFLLLRHGQTELSVERRYSGRGNPALTELGRSQAGAAAAYLAGRGGIDAVITSPLQRAYDTATAAAKTLGLDVTVDEDLIETDFGAWEGLTFGEASQRDPELHGRWLRDTSVDPPGGESFDTVAHRVRRARNRIIADHGASTVLVVSHVTPIKTMLRLALNAGEGILYRLHLDLASLSIAEFYPDGGSSVRLVNQTAHL

SEQ ID NO: 67870 - protein, 531 aa, Triticum aestivum
  misc_feature (217)..(217): Xaa can be any naturally occurring amino acid
  misc_feature (257)..(257): Xaa can be any naturally occurring amino acid
  misc_feature (455)..(455): Xaa can be any naturally occurring amino acid
NKFVQKSRPVPVRNSRDIVDPRVRELLLFCTTVFILIVSSLYLLGLLAGRRRNLPPGPCPLPLVGNLLSLGALPHRTLARLAERHGPIMAIRLGTVTTVVASSPDAARDILQRHDAAFSGRSIPDGTHVFAHNTHSMGWLPASSPRWRALRKVCSGELFAPHRLDMHHSLRQEKVQQLVSHVTQLAREGTPVRVGRLGFTTALNLLSSTIFSTELAXSTTAHVKPSDVKAMLAELNVTVGLPNPSDFIPEVALARPXQGLRRRIQGLFTRLHAMIGERIESQMGDRAAAAGEPTKKNFLDVLLDYRNTDDDQGFERQTLLSLISDLFSAGTDTSSATVEWAMAELLLNPSSMSRARQELDQVIGSKEQVEESDIGQLKYLQAIVKETFRLHPPAPFLLPHVAETTTQVQGYTVPKGTRLLVNVWAIGHDGKVWPEPEKFMPERFLEKEVDFKARXSCRFDMIIILPFGSGRRMCPGTPLAARMVHLMLASLLHRFQWRLPVDVEKKGLDMAERLGVNLSMATPLEAIATPV

SEQ ID NO: 67871 - protein, 1573 aa, Ostreococcus tauri
MCERELALSGMKEGENVVFDAEPLAAYLRERAGTKEGTLRGVVMTCGDEDRTPQNAAEAFAKDLETIERAGVPAVGILFDEESIRAGATSRPSTGRSLLASDASSDQECGFLCETQVQVITGVVIFWGLLLTLVYGWGLMTDLDTPTPIIEASDRDSMTSEYDSLEKIEVDETSTAPTKVLTTYGGVDSSTKNYFFQVPASILLLIISLPLAFVYVPALSTTSDYKIVRGDKCWASKTTTCDNHLNTYVYFWNVTNPSQVLAGTHAPNLDEVGPYVLTNTVNKRQNITFSSDESEVSFVSTLYAQPDTGSFCPGCALSDEIVSFNLAYVGMVKTVGSETNILALSLPKTLSGLVAGIAQLFGGMANDPTLSAAFPNLVVAAQGGVTALQALALEQMFTLSPLGGMSVTELTAIGVPPSLLTGFPYVPEYASWAAASASLPVSSVSIPTPTSTAMYVSVVNDDTGETAAGTLAASSTSLAASLSIPPFQAQLWQGFLQHAMTTYGKDAFTAMLGPTLGANSSGILIKRTVQEWIFGYEDPVVSPTYPAGDPRRIIRSVTKIRDARTIHNDHVPWNLTDTSTWAHSYGSTPYHVATGVGAPRDATKILSRSDGSGPVIYPHTGHVESVLGKDIATGQYHDIKKTGVSVDVKAWADFGMGLDLKRSLTLRHRPGRAVQKNDKVSVEIFGVAHEEFMSCPVNQTACGRNANFYGIFNVSGFELVPSVYTLPHGHRADPRLFGGYVDPTSSASPFSPNPAKHDIEFSIYEHTGNTFGMRVPIQQNFKIDRTDLFFTTLWSGAAMGDHFYVPISWTSLEYDVGDDVYDSIKDTVTHIELLVATWTYICPALCFMGILFSGVTLYVRRALNRRLVDNDRRERETTRDDSHAIGSYREKTLVSSLRKKHAELLDESSRRGRTDQTEFGISARSTNQRTIMPGVTSSVRDGVCVIEMSNPPVNALALPVLEGLEKALKEAQGDGRVKAIVIKGAGGKFSGGFDIGHLRKSTQGAPASDVGEFNAILCTLAEGGAKPCVAAIENLALGGGLEVAMSCAARVATPGAQLGLPELQLGVIPGFGGTQRLPRLVGLEKSLEMMLKSKSIKAEEALKLGPEAGLQREPVNFKKAVSSPAAKGLVHFFFAQRATNIVPGVTDGGLKPRVMKSVGVVGGGLMGSGIATACLLAGIGVVLKEIKQEFLDAGVGRIQSNLASMVRKGRMTEDKARKLMSLVKPTLSDDDFRQCDMVIEAVIENLDLKQKIFCNLEKICRPDCILSTNTSTIDITKIATKMKNPERIVGAHFFSPAHVMQLFEIIRTKDTPSQILVDTLGLSKQIRKTPVVVGNCTGFAVNRVFFPYTMSATALVDIGCDPYAIDRAIMMFGMPMGPFRLGDLVGHDVGVHVGKNFIDDFPDRVYQSPLIPSLLASKRLGEKSGAGFYKYDNKRRATPDPEGVEGLIAASRAQTRLPLDGSSIPNGLTPQEIAEMIFFPVVNEACRVLDEGIVVKAGDIDTASILGMGFPAFRGGIVHWGDSVGAAVIATKLRTWATRYGGLYQPCPYLENCAIQGRTLAQGPLDTKLKSRL

SEQ ID NO: 67872 - protein, 488 aa, Geobacillus kaustophilus HTA426
MDMTMTTGVQTLKNYIGGQWVESRSGKTEAVPNPATGEVLAYVPISSREELDEAVRAAKEAFKTWRKTPVPRRARILFKYQQLLVEHWEELARLVTLENGKSYNEAYGEVQRGIECVEFAAGAPTLMMGRQLPDIATGIESGMYRYPIGVVGGITPFNFPMMVPCWMFPLAIACGNTFVLKPSERTPMLANRLAELFKEAGLPDGVLNIVHGAHDVVNGLLEHPDVKAISFVGSQPVGEYVYKTAAAHGKRVQALTGAKNHSIVMPDADLNVAVREIINAAFGSAGERCMAASVVVAVGEIADELVEKLVAAANELKIGNGLEESVFLGPVIREAHKQRTVKYIELGEKEGAILVRDGRKDAAVQDNGYFIGPTIFDRVTTDMTIWKDEIFAPVLSIVRVETLDEAIEVANKSPFANGACIYTRDGGNVRKFREEIDAGMLGVNLGVPAPMAFFPFSGWKNSFYGDLHANGMDGVEFYTRKKMMTSRW

SEQ ID NO: 67873 - protein, 242 aa, Zea mays
  misc_feature (189)..(189): Xaa can be any naturally occurring amino acid
  misc_feature (197)..(197): Xaa can be any naturally occurring amino acid
  misc_feature (217)..(217): Xaa can be any naturally occurring amino acid
  misc_feature (222)..(222): Xaa can be any naturally occurring amino acid
MIMAPLHEFLPEGNVEEIVRELCSETGANQEDALARIEKLSEVNPMLGFRGCRLGISYPELTEMQARAIFEAAIAMTNQGVQVFPEIMVPLVGTPQELGHQVALIRQVANKVFTSMGKTIGYKIGTMIEIPRAALVADEIAEQAEFFSFGTNDLTQMTFGYSRDDVGKFIPIYLAQGILQHDPFEVLDXRGVGELGXLATEKGRKARPDFEVGICGXHGGEXFIVAFFARLGWISFLLPFRS

SEQ ID NO: 67874 - protein, 275 aa, Bacteroides caccae
IDEVGDPFPEETYQACKNADAVLFSAVGDPKFDNDPTAKVRPEQGLLAMRKKLGLFANIRPVQTFKVLIHKSPLRAELVENADFICIRELTGGMYFGEKYQDNDKAYDTNYYTRPEIERILKVAFEYAMKRRKHLTVVDKANVLASSRLWRQIAQEMAPQYPEVTTDYMFVDNAAMKMIQEPAFFDVMVTENTFGDILTDEGSVISGSMGLLPSASTGESTPVFEPIHGSWPQAKGLNIANPLAQILSVAMLFEYFDLKEEGALIRKAVDASLDE

SEQ ID NO: 67875 - protein, 462 aa, Arabidopsis thaliana
MADVRLGETIHSVVIRSGFGSLIYVQNSLLHLYANCGDVASAYKVFDKMPEKDLVAWNSVINGFAENGKPEEALALYTEMNSKGIKPDGFTIVSLLSACAKIGALTLGKRVHVYMIKVGLTRNLHSSNVLLDLYARCGRVEEAKTLFDEMVDKNSVSWTSLIVGLAVNGFGKEAIELFKYMESTEGLLPCEITFVGILYACSHCGMVKEGFEYFRRMREEYKIEPRIEHFGCMVDLLARAGQVKKAYEYIKSMPMQPNVVIWRTLLGACTVHGDSDLAEFARIQILQLEPNHSGDYVLLSNMYASEQRWSDVQKIRKQMLRDGVKKVPGHSLVEVGNRVHEFLMGDKSHPQSDAIYAKLKEMTGRLRSEGYVPQISNVYVDVEEEEKENAVVYHSEKIAIAFMLISTPERSPITVVKNLRVCADCHLAIKLVSKVYNREIVVRDRSRFHHFKNGSCSCQDYW

SEQ ID NO: 67876 - protein, 423 aa, Saccharophagus degradans 2-40
MTLPKDPESSTVKPVKKDKRKNIIKSEKLLGVCYDIRGPVLEHANRLEEEGHRILKLNIGNPAPFGFEAPDEIITDVVYNIREAQGYTASRGLFPARKAIMHECQRQEIPNVEIEDIFLGNGVSELIVMANQALLNNGDEVLVPSPDYPLWTAAVNLAGGKAVHYMCDEQSDWFPDIDDMRSKITSRTRAIVVINPNNPTGAVYSQELLEQIVALAREHQLVIFADEIYSKILYDDAEFVPMGRIAKDVLCVTFNGLSKSYRLAGFRSGWIILSGAKHLAKDYIRGIDMLASMRLCANVPAMLAVQTALGGYQSINELILPGGRLLEQRDAAIEELAKIPGVSCVVPKGAIYLFPKIDRTMYDFDDDQQLILDFLIQEKILLVQGTAFNWKQPDHFRIVFLPQADQLRQAIIKFGEFLQQYRI

SEQ ID NO: 67877 - protein, 134 aa, Saccharophagus degradans 2-40
MSDLTKKDDEYWRDKLDAEQFRICREKGTERPFTGEYCDSKEPGTYLCRCCAEPLFESATKYDSGSGWPSFFQPIKGDAVGEIKDTSHGMVRVEVVCHNCGCHLGHVFPDGPKPTGLRYCINSASIQLQKEGAE

SEQ ID NO: 67878 - protein, 544 aa, Geobacter metallireducens GS-15
MIHLSNITKQHGAQVLFRDASFQILPGTRTGLVGPNGAGKTTIFRIITGEEEVDAGEMTCAKKTTVGYFSQDVGEMAGRSALEEVMAGSAETVRLAAELKEMEAAMCEPQSDDEMAALLERYGAAQEEFEHRGGYDLDTRAQTVLTGLGIGPDRFHHPVESFSGGWKMRIALAKILTLKPDVLLLDEPTNHLDVESIIWLEEWLANDFDGALLMTSHDRDFMNRIVTRIIEVANRTVTTYGGNYDFYERERDIRREQLLASHKRQQEMLAKEEEFIARFAARASHAAQVQSRVKKLEKIERIEIPAEERMVRFEFSEPPRSGEDVVVMENLGKVWQTPDGGEKPVFGGVSGIIRRLNKIAVVGVNGAGKSTFLKVLAGQTEPTTGTVTIGANVELGYFSQHAMEVLDPKKTVFETVQEAMPLANIGVIRNLLAAFLFQGDTVDKRVENLSGGEKSRVVLATLLARPVNFLVLDEPTNHLDIRSREILLDALRNFAGTVVIVSHDRHFLRSLVDRVFEVDHGEMRVYEGDYSYYLRKSHELHGLP

SEQ ID NO: 67879 - protein, 794 aa, Neisseria meningitidis FAM18
MADNYVIWFENLRMTDVERVGGKNASLGEMISQLTEKGVRVPGGFATTADAYRAFLAHNGLSERISAALAKLDVEDVAELARVGKEIRQWILDTPFPEQLDAEIEAAWNKMVADAGGADISVAVRSSATAEDLPDASFAGQQETFLNINGLENVKEAMHHVFASLYNDRAISYRVHKGFEHDIVALSAGVQRMVRSDSGASGVMFTLDTESGYDQVVFVTSSYGLGENVVQGAVNPDEFYVFKPTLKAGKPAILRKTMGSKHIKMIFTDKAEAGKSVTNVDVPEEDRNRFSITDEEITELAHYALTIEKHYGRPMDIEWGRDGLDGKLYILQARPETVKSQEEGNRNLRRFAINGDKTVLCEGRAIGQKVGQGKVRLIKDASEMDSVEAGDVLVTDMTDPDWEPVMKRASAIVTNRGGRTCHAAIIARELGIPAVVGCGNATELLKNGQEVTVSCAEGDTGFIYAGLLDVQITDVALDNMPKAPVKVMMNVGNPELAFSFANLPSEGIGLARMEFIINRQIGIHPKALLEFDKQDDELKAEITRRIAGYASPVDFYVDKIAEGVATLAASVYPRKTIVRMSDFKSNEYANLVGGNVYEPHEENPMLGFRGAARYVADNFKDCFALECKALKRVRDEMGLTNVEIMIPFVRTLGEAEAVVKALKENGLERGKNGLRLIMMCELPSNAVLAEQFLQYFDGFSIGSNDMTQLTLGLDRDSGLVSESFDERNPAVKVMLHLAISACRKQNKYVGICGQGPSDHPDFAKWLVEEGIESVSLNPDTVIETWLYLANELNK

SEQ ID NO: 67880 - protein, 150 aa, Triticum aestivum
  misc_feature (50)..(50): Xaa can be any naturally occurring amino acid
  misc_feature (59)..(59): Xaa can be any naturally occurring amino acid
  misc_feature (119)..(119): Xaa can be any naturally occurring amino acid
MAEQTFIMIKPDGVQRGLIGEVISRFETEAFYLKGLTLQNVPPPFVRWDXGDPSSIFFXGGCAPNVGSGPVVAMVCAGKYLESIAGAIIGALNPLASEAGTSRGSFADHIGTDVVHGSXSCESDRNGIALWFPDGIAAMMSSLTRCIYEA

SEQ ID NO: 67881 - protein, 2214 aa, Saccharomyces cerevisiae
MATIAPTAPITPPMESTGDRLVTLELKDGTVLQGYSFGAEKSVAGELVFQTGMVGYPESVTDPSYEGQILVITYPLVGNYGVPDMHLRDELVEELPRYFESNRIHIAGLVISHYTDEYSHYLRKSSLGKWLQNEGIPAVYGVDTRSLTKHLRDAGSMLGRLSLEKSGSDRTISRSSSWRSAFDVPEWVDPNVQNLVSKVSINEPKLYVPPADNKHIELQTGPDGKVLRILAIDVGMKYNQIRCFIKRGVELKVVPWNYDFTKEDYDGLFISNGPGDPSVLDDLSQRLSNVLEAKKTPVFGICLGHQLIARAAGASTLKLKFGNRGHNIPCTSTISGRCYITSQNHGFAVDVDTLTSGWKPLFVNANDDSNEGIYHSELPYFSVQFHPESTPGPRDTEFLFDVFIQAVKEFKYTQVLKPIAFPGGLLEDNVKAHPRIEAKKVLVLGSGGLSIGQAGEFDYSGSQAIKALKEEGIYTILINPNIATIQTSKGLADKVYFVPVTAEFVRKVILHERPDAIYVTFGGQTALSVGIAMKDEFEALGVKVLGTPIDTIITTEDRELFSNAIDEINEKCAKSQAANSVDEALAAVKEIGFPVIVRAAYALGGLGSGFANNEKELVDLCNVAFSSSPQVLVEKSMKGWKEVEYEVVRDAFDNCITVCNMENFDPLGIHTGDSIVVAPSQTLSDEDYNMLRTTAVNVIRHLGVVGECNIQYALNPVSKDYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYANLGFNETDLDIDIDYELNNPTDMRVFAIANAFAKKGYSVDKVWEMTRIDKWFLNKLHDLVQFAEKISSFGTKEELPSLVLRQAKQLGFDDRQIARFLDSNEVAIRRLRKEYGITPFVKQIDTVAAEFPAYTNYLYMTYNADSHDLSFDDHGVMVLGSGVYRIGSSVEFDWCAVTAVRTLRANNIKTIMVNYNPETVSTDYDEADRLYFETINLERVLDIYEIENSSGVVVSMGGQTSNNIAMTLHRENVKILGTSPDMIDSAENRYKFSRMLDQIGVDQPAWKELTSMDEAESFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPLTPYPVEKLPDDYVAVKVPQFSFPRLAGADPVLGVEMASTGEVATFGHSKYEAYLKSLLATGFKLPKKNILLSIGSYKEKQELLSSVQKLYNMGYKLFATSGTADFLSEHGIAVQYLEVLNKDDDDQKSEYSLTQHLANNEIDLYINLPSANRFRRPASYVSKGYKTRRLAVDYSVPLVTNVKCAKLLIEAISRNITLDVSERDAQTSHRTITLPGLINIATYVPNASHVIKGPAELKETTRLFLESGFTYCQLMPRSISGPVITDVASLKAANSVSQDSSYTDFSFTIAGTAHNAHSVTQSASKVTALFLPLRELKNKITAVAELLNQWPTEKQVIAEAKTADLASVLLLTSLQNRSIHITGVSNKEDLALIMTVKAKDPRVTCDVNIYSLFIAQDDYPEAVFLPTKEDQEFFWNNLDSIDAFSVGALPVALANVTGNKVDVGMGIKDSLPLLLAAVEEGKLTIDDIVLRLHDNPAKIFNIPTQDSVVEIDLDYSFRRNKRWSPFNKDMNGGIERVVYNGETLVLSGELVSPGAKGKCIVNPSPASITASAELQSTSAKRRFSITEEAIADNLDAAEDAIPEQPLEQKLMSSRPPRELVAPGAIQNLIRSNNPFRGRHILSIKQFKRSDFHVLFAVAQELRAAVAREGVLDLMKGHVITTIFFEPSTRTCSSFIAAMERLGGRIVNVNPLVSSVKKGETLQDTIRTLACYSDAIVMRHSEEMSVHIAAKYSPVPIINGGNGSREHPTQAFLDLFTIREEIGTVNGITVTFMGDLKHGRTVHSLCRLLMHYQVRINLVSPPELRLPEGLREELRKAGLLGVESIELTPHIISKTDVLYCTRVQEERFNSPEEYARLKDTYIVDNKILAHAKENMAIMHPLPRVNEIKEEVDYDHRAAYFRQMKYGLFVRMALLAMVMGVDM

SEQ ID NO: 67882 - protein, 424 aa, Staphylococcus aureus subsp. aureus MRSA252
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASSTVEQTSTSKQNQPRNNGRFSPVVFKLASEHDIDLSQVVGSGFEGRVTKKDLMSVIENGGTTAQSDKQVQTQSTSVDRSSNQSSEDDSENSTIPVNGVRKAIAQNMVNSVTEIPHAWMMIEVDATNLVNTRNHYKNNFKNKEGYNLTFFAFFVKAVADALKAYPLLNSSWQGNEIVLHKDINISIAVADENKLYVPVIKHADEKSIKGIAREINTLATKARNKQLTTEDMQGGTFTVNNTGTFGSVSSMGIINHPQAAILQVESIVKKPVVINDMIAIRSMVNLCISIDHRILDGLQTGKFMNHIKQRIEQYTLENTNIY

SEQ ID NO: 67883 - protein, 668 aa, Saccharomyces cerevisiae
MEDKFANLSLHEKTGKSSIQLNEQTGSDNGSAVKRTSSTSSHYNNINADLHARVKAFQEQRALKRSASVGSNQSEQDKGSSQSPKHIQQIVNKPLPPLPVAGSSKVSQRMSSQVVQASSKSTLKNVLDNQETQNITDVNINIDTTKITATTIGVNTGLPATDITPSVSNTASATHKAQLLNPNRRAPRRPLSTQHPTRPNVAPHKAPAIINTPKQSLSARRAVKLPPGGMSLKMPTKTAQQPQQFAPSPSNKKHIETLSNSKVVEGKRSNPGSLINGVQSTSTSSSTEGPHDTVGTTPRTGNSNNSSNSGSSGGGGLFANFSKYVDIKSGSLNFAGKLSLSSKGIDFSNGSSSRITLDELEFLDELGHGNYGNVSKVLHKPTNVIMATKEVRLELDEAKFRQILMELEVLHKCNSPYIVDFYGAFFIEGAVYMCMEYMDGGSLDKIYDESSEIGGIDEPQLAFIANAVIHGLKELKEQHNIIHRDVKPTNILCSANQGTVKLCDFGVSGNLVASLAKTNIGCQSYMAPERIKSLNPDRATYTVQSDIWSLGLSILEMALGRYPYPPETYDNIFSQLSAIVDGPPPRLPSDKFSSDAQDFVSLCLQKIPERRPTYAALTEHPWLVKYRNQDVHMSEYITERLERRNKILRERGENGLSKNVPALHMGGL

SEQ ID NO: 67884 - protein, 275 aa, Bacteroides thetaiotaomicron
IDKVGDPFPEETYEVCKNADAVLFSAVGDPKFDNDPTAKVRPEQGLLAMRKKLGLFANIRPVQTFKCLIHKSPLRAELVENADFICIRELTGGMYFGEKYQDNDKAYDTNYYTRPEIERILKVAFEYAMKRRKHLTVVDKANVLASSRLWRQIAQEMAPNYPEVTTDYMFVDNAAMKMIQEPAFFDVMVTENTFGDILTDEGSVISGSMGLLPSASTGESTPVFEPIHGSWPQAKGLNIANPLAQILSVAMLFEYFDCKEEGALIRKAVDASLDE

SEQ ID NO: 67885 - protein, 473 aa, Staphylococcus aureus subsp. aureus MRSA252
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSVGIIGGGVIGMEFASLMIDLGVDVTVIEAGERILPTKSKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDANEGYSEMVIDQSTEEIVGINMIGPHVTELINEASLLQFMNGSALELGLTTHAHPSISEVLMELGLKAESRAIHV

SEQ ID NO: 67886 - protein, 333 aa, Desulfovibrio desulfuricans G20
MAVTLGINGFGRIGRYLVRLLANDPELNTAVVNARADNESLARLFKYDSCHGTYPAEVKANSDGFTVNGKQIVVTRYGHNEWKWADYGVDIAVESTGTVKDRAGLALHMERGAKKTVISAPCADADLTVVMGVNDHLYDPAQHDVISNASCTTNCLAPVVKVLNDTFGVRHGLMTTVHSYTMSQRLLDGTHKDPRRGRAAAMSMIPTSTGAAKAVGLVIPELAGKLNGMAIRVPTPNVSLVDLTCELGKSATAEEINAALREAAATTLKGNMGYTEEPLVSCDYMGSTFGGVVDGPCTSVMEGNMAKLIIWYDNEAGFTNQLVRLLRKVGNSL

SEQ ID NO: 67887 - protein, 176 aa, Neisseria meningitidis FAM18
MNAIRTFQNRTPEIHESCMIDEACVVIGEVSLAEDVSVWPCAVLRGDVNSITVGARSNIQDGSVLHVSHKTAAKPEGSPLVIGEDVTVGHKVMLHGCRIGNRVLVGMGTTVLDDAVIEDEVMIGAGSLVPPRKRLEGGYLYVGSPVRQVRVLTDEEKAFLKYSAAHYVKLSKQYGM

SEQ ID NO: 67888 - protein, 480 aa, Vitis vinifera
MVKICCIGAGYVGGPTMAVIALKCPSIEVAVVDISISRITAWNSDQLPIYEPGLEEVVKQCRGRNLFFSTNVEKHISEADIIFVSVNTPTKTRGLGAGKAADLTYWESAARMIADVSKSNKIVVEKSTVPVKTAEAIEKILSHNSKGISYQILSNPEFLAEGTAIQDLLNPDRVLIGGRETPGGQKAIKALKDVYAHWVPEDRIISTNLWSAELSKLAANAFLAQRISSVNAMSALCEATGADVSEVSHAIGKDSRIGPKFLNASVGFGGSCFQKDILNLIYICECNGLPEVANYWKQVIKVNDYQKNRFVNRVVASMFNTVSGKKIAILGFAFKKDTGDTRETPAIDVCKGLLGDKASLSIYDPQVTGDQIQREISMNKFDWDHPVHLQPMSPTSVKQVNVVWDPYEATRDAHGICILTEWDEFKTLDYQRIFNNMQKPAFVFDGRNIVNIEKLREIGFIVYSIGKPLDPWLKDMPAIA

SEQ ID NO: 67889 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVAFQAGSVVKTRLVGVLNMEDESGMDEKLLALPIDKIDPTHSYVKDIDDLSKHTLDKIKHFFETYKDLEPNKWVKVKGFENKESAIKVLEKAIKAHQG

SEQ ID NO: 67890 - protein, 464 aa, Marinobacter sp. ELB17
MSSGHIVQIIGAVIDVEFPRDAVPGIYDALLLEGGETTLEVQQQLGDGVVRTIAMGSTEGLKRGLKAENTHKPISVPVGTKTLGRIMDVLGRPIDEQGPIGEEELWAIHRKAPGYADQAASADLLETGIKVIDLICPFAKGGKVGLFGGAGVGKTVNMMELINNIAKEHSGLSVFAGVGERTREGNDFYYEMKDSNVLDKVAMVYGQMNEPPGNRLRVALTGLTIAEKFRDEGRDVLFFVDNIYRYTLAGTEVSALLGRMPSAVGYQPTLAQEMGELQERITSTKSGSITSIQAVYVPADDLTDPSPATTFSHLDATVVLSRDIASKGIYPAIDPLDSTSRQLDPLVIGEQHYAVARGVQNVLQRYKELKDIIAILGMDELSEDDKQIVSRARKIERFLSQPFHVAEVFTGSPGKYVSLKETISSFEGILNGDYDDMPEQAFYMVGTMDEAVEKAKAMKLKESK

SEQ ID NO: 67891 - protein, 462 aa, Mannheimia succiniciproducens MBEL55E
MQTLTILLIRGKLMSSTVSSLEDFLSLVAQRDGNQPEFLQAVREVFTSIWPFLEANPQYRSQALLERLVEPERAFQFRVAWTDDKGQVQVNRAFRVQFSSAIGPYKGGMRFHPSVNLSILKFLGFEQIFKNALTTLPMGGGKGGSDFDPKGKSDAEVMRFCQALVAELYRHIGPDTDVPAGDIGVGGREVGYLAGYMKKLSNQAACVFTGRGLSFGGSLIRPEATGYGLVYFAQAMLAEKGDSFQGKTVSVSGSGNVAQYAIEKALQLGAKVVTCSDSAGYVYDEAGFTTEKLAALLDIKNVKRGRVKDYAEQFGLQYFPGERPWGVKVDIALPCATQNELELTDAQKLIANGVQLVAEGANMPTTIEATEALQAAGVLFAPGKAANAGGVATSGLEMAQSSQRLFWSAEEVDQKLHNIMLDIHANCKKYGTDANGNINYVAGANIAGFVKVADAMLAQGVY

SEQ ID NO: 67892 - protein, 287 aa, Mannheimia succiniciproducens MBEL55E
MPNKVVVVGSLHYDIVVESTHRPVKGETVIGKRWYPKFGGKGGNQAVAAAKAGCRVFMVSAVGPDNFAPFLLEHLNKSGVNTDFVQKISGVGSGMSVAIMDSEGDYGAVVVSGSNLEIDINRLDNETLWDNAKMLILQNEVSDSINFEAAKRASRRHIPVCLNAAPAKKLSAEFTKLIDILIVNAVEAEAMCGLSVNSLDSALQAALKLSQDFSRVIVTAGGDGVAYADKESNGKIASIKVKLISTLGAGDCFVGHLCTALSENNTLRDAVAYANQKAAEHVSTVQE

SEQ ID NO: 67893 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVVFQAGSVVKARLVGVLNMEDESGMDEKLLALPIDKIDPTHSYVKDIDDLSKHTLDKIKHFFETYKDLEPNKWVKVKGFENKESAIKVLEKAIKAYQG

SEQ ID NO: 67894 - protein, 182 aa, Physcomitrella patens subsp. patens
MASVVAASSAVAPAAAFGAASSGVSTSEATSVKAFSGLKSATLFSGNAQTLSSVQNGSRVQCMQVWNPIGMTKFETFSYLPPLSDDAIAKQVEYMIQQKLIPCLEFDNSNGVSRVNNSSPGYYDGRYWTMWKLPMFGCQDSAQVLREIEECKTTFPGCYVRVLGFDNVKQVQICGFLVARPN

SEQ ID NO: 67895 - protein, 262 aa, Neisseria meningitidis
KTSTRTRCAFEVAARDQGAGVTYLEPSASQIGHKESIKDTARVLGRMYDAIEYRGFGQETVEELAKYAGVPVFNGLTNEFHPTQMLADALTMREHSGKPLNQTAFAYVGDARYNMGNSLLILGAKLGMDVRIGAPQSLWPSEGIIAAAHAAAKETGAKITLTENAHEAVKNVDFIHTDVWVSMGEPKEVWQERIDLLKDYRVTPELMAASGNPQVKFMHCLPAFHNRETKVGEWIYETFGLNGVEVTEEVFESPASIVFDQA

SEQ ID NO: 67896 - protein, 538 aa, Hordeum vulgare
MAFEVVAAQLARLSDALATSDHASVVSINLFVALLCACIVLGHLLEENRWLNESITALIIGLCTGVVILMTTKGKSSHVLVFSEDLFFIYLLPPIIFNAGFQVKKKQFFRNFMTITLFGAVGTMISFFTISLAAIAIFSKMNIGTLDVSDFLAIGAIFSATDSVCTLQVLNQDETPFLYSLVFGEGVVNDATSVVLFNALQNFDPNQIDAIVILKFLGNFCYLFVSSTFLGVFSGLLSAYIIKKLYIGRHSTDREVALMMLMAYLSYMLAELLDLSGILTVFFCGIVMSHYTWHNVTESSRVTTKHAFATLSFIAETFLFLYVGMDALDIEKWKFASDSPGKSIGISSILLGLVLVGRAAFVFPLSFLSNLTKKTELEKISWRQQIVIWWAGLMRGAVSIALAYNKFTRSGHTQLHGNAIMITSTITVVLFSTMLFGILTKPLIRFLLPASSNGDPSEPSSPKSLHSPLLTSMLGSDMEAPLPIVRPSSLRMLITKPTHTIHYYWRKFDDALMRPMFGGRGFVPYSPGSPTDPNVIVA

SEQ ID NO: 67897 - protein, 1081 aa, Oryza sativa Japonica Group
MDGDADAVKSGRHGSGQACQICGDGVGTTAEGDVFAACDVCGFPVCRPCYEYERKDGTQACPQCKTKYKRHKGSPAIRGEEGEDTDADDVSDYNYPASGSADQKQKIADRMRSWRMNAGGGGDVGRPKYDSGEIGLTKYDSGEIPRGYIPSVTNSQISGEIPGASPDHHMMSPTGNIGKRAPFPYVNHSPNPSREFSGSIGNVAWKERVDGWKLKQDKGAIPMTNGTSIAPSEGRGVGDIDASTDYNMEDALLNDETRQPLSRKVPLPSSRINPYRMVIVLRLVVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHPSFVKDRRAMKREYEEFKVRINGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPIKQKKKGSFLSSLCGGRKKASKSKKKSSDKKKSNKHVDSAVPVFNLEDIEEGVEGAGFDDEKSLLMSQMSLEKRFGQSAAFVASTLMEYGGVPQSATPESLLKEAIHVISCGYEDKTEWGTEIGWIYGSVTEDILTGFKMHARGWRSIYCMPKRPAFKGSAPINLSDRLNQVLRWALGSVEILFSRHCPIWYGYGGRLKFLERFAYINTTIYPLTSIPLLIYCVLPAICLLTGKFIIPEISNFASIWFISLFISIFATGILEMRWSGVGIDEWWRNEQFWVIGGISAHLFAVFQGLLKVLAGIDTNFTVTSKASDEDGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 67898 - protein, 116 aa, Zea mays
MAFPWCLSAPAAVPPVAPAPGTFGVSASVTALARVPVLAGCSGWEWERPKPGRRPDIFPKFSPMKTPLPHPLPADDPLDDDQEEEEEEQPPPQEEPQEDDPDKEEPEEDDPDKPTE

SEQ ID NO: 67899 - protein, 127 aa, Sulfolobus solfataricus
MSKASYVKFEVPQDLADKVLEAVRKAKESGKIKKGTNETTKAVERGQAKLVIIAEDVQPEEIVAHLPLLCDEKKIPYVYVSSKKALGEACGLQVATASAAILEPGEAKDLVDEIIKRVNEIKGKTSS

SEQ ID NO: 67900 - protein, 320 aa, Petunia x hybrida
MENFPIISLDKVNGVERAATMEMIKDACENWGFFELVNHGIPREVMDTVEKMTKGHYKKCMEQRFKELVASKALEGVQAEVTDMDWESTFFLKHLPISNISEVPDLDEEYREVMRDFAKRLEKLAEELLDLLCENLGLEKGYLKNAFYGSKGPNFGTKVSNLPPCPKPDLIKGLRAHTDAGGIILLFQDVKVSGLQLLKDGQWIDVPPMRHSIVVNLGDQLEVITNGKYKSVMHRVIAQKDGARMSLASFYNPGSDAVIYPAPALVEKEEAEKNKQVYPKFVFDDYMKLYAGLKFQAKEPRFEAMKAMETDVKMDPIATV

SEQ ID NO: 67901 - protein, 434 aa, Bdellovibrio bacteriovorus HD100
MMTVWRLRQGADKRIRSGHPWVFSNELLVSPKGHPAGAAVELQDSKGQFLARGYGNPHSLISFRALSFNSQDKDPTSFDFLHEKIFNSWRVRKAAGFRGSFRLAFGESDFIPGLVLDYYVIVQNGKRAQLFAAQLVTAGMNEALKDAEGFFKGLAEKAHAQGLSEFGWDQTAVVIRNDVGVRKLEGLQVEEPRLIKDLPDMNLRDVEIVLNAAGDDGTITMSCDLVEGQKTGFFLDQTHNIFLAVGLFKNWAKTQQPRKIRVLDLCCYVGHWSTQITRALKSLGFEVEVSLADISKTALAFAKKNAEREGAEVIVHEMDVSEGLAALPSTHYDIVIADPPAFIKSKKDIPIGKHAYLKMNTHAFRLVKKNGFVASCSCSGLLEEEEFRDAIRKASLRNYAELRSVLRGGHAADHPTLMQFPEGFYLKMYVHYVH

SEQ ID NO: 67902 - protein, 1021 aa, Oryza sativa
MGFLNLVGNSFGCSASGERLVSAARDGDLQEARALLEYNPRLAWYSTFGGRNSPLHYTAAQGHHEMGKRTAILHSHFLLLACSNCFSVARIRRQDQPQELQGPGTSDELIPSAYDSMEARHDQAHKTRAFPFPQNLRTVRIRPLHVSTRPSSTSAPHRTVAPASPTSPAAAPLISAGRLLQASATRTAEMYRIAGSHLRSLKRYSYSRFASTSVVKQSSGGLFSWLLGEKSSQLPPLDVPLPGITLPPPLPDFVEPSKTKVTTLPNGIKIASETSVSPAASVGLYIDCGSIYETPASSGASHLLERMAFKSTTNRSHLRLVREVEAIGGNVSASASREQMCYTYDAFKAYVPEMVEVLIDSVRNPAFFNWEIKEQLEKIKAEIAEVSDNPQGLLLEALHSAGYSGALAKPLMAPQSAIHRLDSSILEEFIAENYTAPRMVLAASGVEHDELVSIAEPLLSDLPSVKRPEEPKSVYVGGDYRCQADSDKTHIALAFEVPGGWFEEKTAIIVTVLQMLMGGGGSFSAGGPGKGMHSRLYLRILNNYHQIESFSAFNSIYNHSGLFGIHATTSPNFASKAVDLAAGELLEVATPGKVTQEQLDRAKQATKSAVLMNLESRVVASEDIGRQILTYGERKPIEHFLKDLEAITLNDISSTAKKIISSPLTLASWGDECFLAVIHVPSYESVSQKFFSNTAELLRMCRDFKSMHAEIVLMIFPFMRRQKATAAVALSRAGGGSGGVQGGDRALQGGWGKRRLPGRAGEAVAVTAPSRSGGGSGGGGGGALQGGRGKRQRRRSPLGQVGKAAGATAAVADAVAVFFPLVGKLTDARALSAAERHDVPAFLRLVPSLEAPELPAPLLAVQVTRFVGGGDGGGVAVQHAVPDGQSFWRFMDAWSAPALGRPSAPAPVFDRSAIVHPMAAAMAQRILRKVTPELPLLLTANLLRRTWQHHDTTTLELERHRIADIKNLIVELDEATTSPGRVRGAAAAAAATDRRRPPDSPSHPRPPSARATKPCPQLLAH

SEQ ID NO: 67903 - protein, 134 aa, Zea mays
MQLLFFQTTVNAPHRRSIQRTPWNGIEGNCAMWMRVKQKIVQLCRQLNKPVIVASQLLESMIEYPTPTRAEVADVSEAVRQRVDALMLSGESAMAEPAVGSDRGGRKEMALHARGRQRRRRNGKQTACVEAVRA

SEQ ID NO: 67904 - protein, 538 aa, Rhodococcus sp. RHA1
MSTAAPAVTEVLDVLVVGAGFAGLYQLENLRSRGYSVKVVEAGEGLGGIWHWNRYPGARVDSEGPIYQFTRPDLWDEFAFSELYPGGDELRRYFKYVDAKLDLSKDIYYNTRIISAEFDDTANTWTVTAENGSSFVCKYFVLCTGFAAKPIFPKLPGMDSFTGINHHTGLWPEGGIEFAGKRIAIIGTGASGVQVAQEASKKAAQLTVFQRTPVQALPMRQRQLTDEDNAKIKFDLADRFSRRSASFSGFDFDFIPKSALGVSDEERITTYERLWECGFEFWLGTYQDVFVDDDANDTAYEFWRDRTRARIKDPVIAEKLAPTKKAYPFGVKRPSLEQTYYDIFNQDNVRVVDLHEDPIETITPTGLKTTSEQHEFDIIVYATGFDAVTGGLTAMDIRGTDGTLLRDKWSNGVRANLGVATAGFPNLLFLYGPLSPSGFCNGPSCAEIQGDLIVNTIDYMRDNGLNRIESEADADAAWSDHVAELTAEALYDKADSWYMGANVPGKPRQLLNYPGGLPLYLAKWDETVCAGYKGFTLS

SEQ ID NO: 67905 - protein, 707 aa, Shewanella oneidensis MR-1
MAVGKTFNLTRREDGIAILTMDVPGETMNTLKAEFGPEISEILSEIKRDSSIRGLVLISGKKDSFVAGADISMLDACQTAGDAKALSQQGHVVFNELEALNIPVVAAIHGACLGGGLELALACHQRVCSDDGKTMLGVPEVQLGLLPGGGGTQRLPRLVGITTALDMMLTGKQIRPKQALKMGLVNDVVPQTILLQTAVEMALAGKQIAKPVKKSLVNQLLEGTGFGRNIIFDQAAKQVAKKTQGNYPAPAKIIDCVRQGIAKGMQKGLEVEASHFAELVVSKESEALRSIFFATTEMKKETGAEGATPRKVKKAVILGGGLMGGGIASVTTTKAKIPARVKDINEKGLSNALSYAYKLLDKGVKRRHMTPAARDNLMALMTTTTEYKGVKDADIVVEAVFEDLALKHQMVKDIERECGEHTIFASNTSSLPIGQIAQAASRPENVIGLHYFSPVEKMPLVEVIAHAKTSPETIATTVAFARKQGKTPIVVQDGAGFYVNRILALYMNEAAQLLLEGQSVEHLDKALVKFGFPVGPITLLDEVGIDVGAKISPILEKELGERFKAPAAFDKLLSDDRKGRKNGKGFYQYGAASKKKAVDETVYGVLGIKPGVDKEMSAVAERCVVQMLNEAVRCLDAGIIASPRDGDIGAIFGIGFPPFLGGPFHYIDTLGADNLVKILERYQTQYGDRFEPCQRLKAMAAEKARFF

SEQ ID NO: 67906 - protein, 209 aa, Chlamydomonas reinhardtii
PQQSHLVHTKPTVVVRSSATADKASISQTNGVEQSTSPSVYSFGNLNVEEAYDLERNDWKTTSLSVVVVGASGDLAKKKIFPALFALYYEGLLPEEFHIFGFARSKMTDAEFRNMIAGTLTCRIHARENCQEKTEKFLERCFYSAVLRFSNLVFEPLWCRQYIRNVQITFSENFGTEGRGGYFDTYGILRDVIQNHLLQILALFAMEPP

SEQ ID NO: 67907 - protein, 293 aa, Staphylococcus aureus subsp. aureus MRSA252
MTNLPMNKLIDEVNNELSVAINKSVMNTQLEESMLYSLNAGGKRIRPVLLLLTLDSLNTEYELGMKSAIALEMIHTYSLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDATKEHLESYSYHLGMMFQIKDDLLDCYGDEAKLGKKVGSDLENNKSTYVSLLGKDGAEDKLTYHRDAAVDELMQIDEQFNTKHLLEIVDLFYSRDH

SEQ ID NO: 67908 - protein, 764 aa, Oryza sativa Japonica Group
MTSSSRVRVGNLVPLNEGNASSSNGSVSSIPIYLGANVVGRNHLVVVDKRVSRKHLSLHASADGSIEAVVEGPNPIIVRSEGQRRKVCAQERVKIAHDDVLELIPGEYFVKYLNVGDNHKSSTSMGSSDFKKGKRLCEDDTVVIKRNRQIMEDEALARSLQKSFAEESSTISGLGCDQMLSSLDSAGFSERNNERIHSVDYLKDVLSLTFRLMRVQGLPSWTNTSSVTIQDVIQGEVLLAVLSNYMVDMEWLLTACPSLRKVRHVLVIHGEDGASVELLKKVKPANWILHKPPLPISFGTHHSKAMLLVYPQGIRVVVHTANLIHVDWNNKTQGLWMQDFPWKDAKDVNRSVSFENDLVDYLSAIKREILELLATCCKLIWPEFRVNLPVVGDVNINAAFFRKFDYKSSSVRLIGSVPGYHVGPNIKKWGHMKLRSVLEGCTFEQQFCKAPMIYQFSSLGSLDEKWMSEFAFSLSAGKSDNGSPLGIGKPLIVWPTVEDVRTSIEGYAAGSCIPSPQKNVEKDFLRKYWARWKADHLGVLFLPKTHQSVPQFSCTGKNNSNLFLTQNNLAPGKEIKTKLVTLCWKSDEEKEQSTEIIRLPVPYQLPPKPYGTEDVPWSWDKRYTKKDVYGSVWPRHVLGVACHFHQQSFMSDLDIQIPTAFDPFAEANAGDSGAAAGSKDYVHVRIQQRNGRKSLTTVQGLKKEFSYNKILKDLKKEFCCNGTVVQDPELGQVIQLQGDQRKNVSNFLVQAGIVKKEHIKIHGF

SEQ ID NO: 67909 - protein, 275 aa, Bacteroides uniformis
IDKVGDPFPEATYEACKNADAVLFSAVGDPKFDNDPTAKVRPEQGLLAMRKKLGLFANIRPVQTFKVLLHKSPLRAELVDGADFLCIRELTGGMYFGEKYQDNDKAYDTNMYTRPEIERILKVGFEYAMKRSKHLTVVDKANVLASSRLWRQIAQEMAPQYPEVTTDYMFVDNAAMKMIQEPKFFDVMVTENTFGDILTDEGSCISGSMGLLPSASTGESTPVFEPIHGSWPQAKGLNIANPLAQILSVAMLFEYFDLKEEGGVIRKAVDASLDA

SEQ ID NO: 67910 - protein, 238 aa, Saccharomyces cerevisiae
MVKPIIAPSILASDFANLGCECHKVINAGADWLHIDVMDGHFVPNITLGQPIVTSLRRSVPRPGDASNTEKKPTAFFDCHMMVENPEKWVDDFAKCGADQFTFHYEATQDPLHLVKLIKSKGIKAACAIKPGTSVDVLFELAPHLDMALVMTVEPGFGGQKFMEDMMPKVETLRAKFPHLNIQVDGGLGKETIPKAAKAGANVIVAGTSVFTAADPHDVISFMKEEVSKELRSRDLLD

SEQ ID NO: 67911 - protein, 544 aa, Neisseria meningitidis FAM18
MFAIFNLRASSQTRHARHAGSRFCLYAAPSNHICRTPQHTKGYIMAKVLIVPVSAGLDASAAAQAFAKALDAQIFQAVDATAETLLAQGKSDDWFDALVGKVAALDAANLVIEGIAPDADKIYLAGKNVELALSLDAAAVFAVRSDNADADELANRLNLAKQFFAAAPGVLEGFVVDGAAASVAEAAAEKTGLTFFGSSDALKDVSVLAGREAKRLSPAQFRYNLIDFARQADKRIVLPEGAEPRTVQAAAICHEKGIARCVLLAKREEVEAVAKERGISLPDSLEIIDPASLVEQYVEPMCELRKSKGLTPEDARKQLQDTVVLGTMMMAQNDVDGLVSGAVHTTANTIRPALQLIKTAPGASLVSSVFFMLLPNQVLVFGDCAVNPNPTAQQLADIAIQSADSAKAFGIDPKVAMISYSTVNSGSGPDVDTVIEATKLAREKRPDLAIDGPLQYDAATVPGVGKSKAPGSPVAGQATVLVFPDLNTGNCTYKAVQRSANVLSVGPLLQGLRKPVNDLSRGALVEDIVFTIALTAVQAKQMEG

SEQ ID NO: 67912 - protein, 275 aa, Bacteroides vulgatus
IDKVGDPFPEATFQACKNADAVLFSAVGDPKFDNDPTAKVRPEQGLLAMRKKLGLFANIRPVQTFKCLVHKSPLRAELVENADFICIRELTGGMYFGEKYQDNDKAYDTNMYTRPEIERILKVAFEYAMKRRKHLTVVDKANVLASSRLWRQIAQEMAPQYPEVTTDYMFVDNAAMKMLQDPCFFDVMVTENTFGDILTDEGSVISGSMGLLPSASTGESTPVFEPIHGSWPQAKGLNIANPLAQILSVAMLFEYFDLKEEGTLIREAVDASLDE

SEQ ID NO: 67913 - protein, 260 aa, Brassica napus
  misc_feature (178)..(178): Xaa can be any naturally occurring amino acid
  misc_feature (230)..(230): Xaa can be any naturally occurring amino acid
MEACLRCSRGGSNLIEALRPIRKFSGSLRSSSSSISFSTEDKPVKRAYDGLLLDAGGTLLQLSEPVHETYASLGLKYGLKTTPAEIKQGFKRAFASPWPEKLRYQGDGRPFWKLVVSEATGCSDNDYFEEVYQYYANGEAWHLPDGAYETMSLLKNAGVKMAVVSNFDTRLRKLLKDXNVIDMFDAVIVSSEVGYEKPDGRIFKCALEQISVDANRAVHVGDDEGADKGXANAVGIDCWLWGKDVQTFSDIQDRILVSEH

SEQ ID NO: 67914 - protein, 708 aa, Chlamydomonas reinhardtii
ARGVRSAAPTRQRRAEASVNAPRAGPAGSYSGEWDKLSVEEIDEWRDVGPKTPLLDTVNYPVHLKNFNNEQLKQLCKELRSDIVHTVSRTGGHLSSSLGVVELTVAMHYVFNTPEDKIIWDVGHQAYGHKILTGRRKGMATIRQTNGLSGFTKRDESEYDPFGAGHSSTSISAALGMAVGRDVKGKKNSVIAVIGDGAITGGMAYEAMNHAGFLDKNMIVILNDNQQVSLPTQYNNKNQDPVGALSSALARLQANRPLRELREIAKGVTKQLPDVVQKATAKIDEYARGMISGTGSTLFEELGLYYIGPVDGHNLDDLIAVLSEVRSAETVGPVLVHVVTEKGRGYLPAETAQDKMHGVVKFDPRTGKQVQAKTKAMSYTNYFADALTAEAERDSRIVAVHAAMAGGTGLYRFEKKFPDRTFDVGIAEQHAVTFAAGLACEGLVPFCTIYSTFMQRGYDQIVHDVSLQKLPVRFAMDRAGLVGADGSTHCGAFDVTFMASLPHMITMAPSNEAELINMVATCAAIDDAPSCFRFPRGNGLGLDLAAYGISKDLKGVPLEVGKGVVRRQGKDVCLVAYGSSVNEALAAADMLERDGVSTTVIDARFCKPLDTKLIRSAAKEHPVMITIEEGSVGGFAAHVMQFLALEGLLDGGLKFRPMTLPDRYIDHGDYRDQLAMAGLTSQHIASTALTTLGRAKDAAKFSLSALQA

SEQ ID NO: 67915 - protein, 173 aa, Helicobacter pylori
MNLDQLEVSHDADSLCVVIEISKHSNIKYELDKESGALMVDRVLYGAQNYPANYGFVPNTLGSDGDPVDALVLSDVAFQAGSVVKARLVGVLNMEDESGMDEKLIALPIDKIDPTHSYVKDIDDLSKHTLDKIKHFFETYKDLEPNKWVKVKGFENKESAIKVLEKAIKAYQC

SEQ ID NO: 67916 - protein, 120 aa, Enterococcus faecalis V583
MDKIRINNLKFFTKNGVLAEEKRLGQQVEIDLEMQLSLAEAGRTDDVTQTVNYAEVNELIAQRVNNHSYDLIEGLASAILDDISADYQEQLNKIIIKIRKYSVPMPGLFDNIEIEMEREV

SEQ ID NO: 67917 - protein, 91 aa, Arabidopsis thaliana
  misc_feature (52)..(52): Xaa can be any naturally occurring amino acid
  misc_feature (72)..(72): Xaa can be any naturally occurring amino acid
MASSMLSSATIVASLDHATMVAPFSGLKSSAVFTVIRRANNDITSITINGGXVNFMHVWPPTGNNKFETLSXLPDLTDSELAMEVDYLIRD

SEQ ID NO: 67918 - protein, 449 aa, Enterococcus faecalis V583
MKTYDYIVIGGGSGGIASANRAGMHGANVLLIEGNEIGGTCVNVGCVPKKVMWQASSMMEMMERDTAGYGFDVEIKNFSFKQLVENREKYIDFLHGAYNRGLDSNNIERIHGYATFTGEQTIEVNGTEYTAPHILIATGGRPKKLGIPGEEYALDSNGFFALEEMPKRVVFVGAGYIAAELAGTLHGLGAETHWAFRHERPLRSFDDMLSEKVVERYQEMGMQIHPNATPAKIEKTAQNEYVITFENGESITTDAVIFGTGRQPNTDQLGLENTKVALDEKGYVKVDKFQNTTQNGIYAVGDVIGKIDLTPVAIAAGRRLSERLFNGQTDLYLDYNLVPTVVFTHPPVATIGLTEKAALEEYGEDQVKIYRSSFTPMYFALGEYRQKCDMKLICVGKEEKIVGLHGIGIGVDEMLQGFAVAIKMGATKADFDNTVAIHPTGSEEFVTMR

SEQ ID NO: 67919 - protein, 321 aa, Borrelia burgdorferi
NGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKILSWYDNEFGYSTRV

SEQ ID NO: 67920 - protein, 606 aa, Medicago truncatula
MGGGGTISEGIRRLFQRRSSTTSTSKQQQQQHQHSNDNNNNNNNINIDLVVRDLRSQLAVIPTTNDLDHDHDHQQSLFNLNHIKVPTNTVFFPSSMDPNKKGPPETEFFTEYGEASQYQVQEIIGKGSYGVVCSAIDTHTGQKVAIKKINHVFEHVSDATRILREIKLLRLLRHPDIVEIRHIMLPPSRREFRDIYVVFELMESDLHQVIKANHDLTPQHHQFFLYQLLRGLKFIHTANVFHRDLKPKNILANADCKLKICDFGLARVSFNDAPSTIFWTDYVATRWYRAPELCGSFFSKYTPGIDIWSIGCIFAEMLTGRPLFPGKNVVHQLDIMTDLLGTPPPESIARIRNEKARRYLNSMRKKQPVPFSQKFPNIDPLALRILERLLAFDPKNRPSAEEALSDPYFHGLSNIDREPSTHPISKLEFEFERRKVTKDDVRELIYREILEYHPQMLEEYIRGGDQTSFMYPSGVDRFKRQFAHLEEHYGKKGERISPLQRQHASLPRERVHTSKNENNENNDIEMPTGSDLQSPPGSNVTDAENSGAQNGLAKPNYSPRSLLKSASISASKCIDVKGSKDPEEPVIEVNDDAADELTDNIAAMHA

SEQ ID NO: 67921 - protein, 395 aa, Triticum aestivum
REKQHTEHIDKVKHEEDPLASGGPKPMDVSTTPHEIFSADVTVLEGHSSEVFACAWSPAGSLLASGSGDSTARIWTIPDGPCGSIQSSPASAHVLKHFKGRTNEKSKDVTTLDWNGEGTLLATGSYDGQARIWSRDGELKQTLFKHKGPIFSLKWNRKGDFLLSGSVDKTAIVWDTKTWECKQQFEFHSAPTLDVDWRNNNSFATCSTDNMIYVCKIGDPRPVKTFSGHQSEVNAIKWDPTGSLLASCSDDWTAKIWSVKQDKCVYDFKEHTKEIYTIRWSPTGPGTNNPNQQLLLASASFDSSIKLWEVEKGHLLYSLAGHRQPVYSVAFSPDGEYLASGSLDQSLHIWSVKEGRILKTFRGSGGIFEVCWNKEGSKIAACFSNNTVCVMDFRM

SEQ ID NO: 67922 - protein, 320 aa, Borrelia burgdorferi
GFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKILSWYDNEFGYSTRV

SEQ ID NO: 67923 - protein, 321 aa, Borrelia burgdorferi
INGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKILSWYDNEFGYSTR

SEQ ID NO: 67924 - protein, 643 aa, Clostridium perfringens ATCC 13124
MIILSCRHLTKSFGIDEILRDVTFNINEGDKVGLIGPNGEGKSTLFKILTKQLDYDSGELFLDKNKTLGYLSQNLSLDSENTIYDEMLSVFSSLTELEDKIKTLEEKLNEPYDASNKEYHNKLIKDYTLSQELYENRGGYTFRGEISRVLKGLGFLEEDFNNQIINLSGGQKTRLALCKLLLRKPDLLLLDEPTNHLDLEAIEWLEEYLNGYKGTVFVISHDRFFLDSVTNTTFELIGGNIHCYNASYTKFLELRKKDIEARLKAYNLQQAEIKRQEEIIEKFRSFNREKSVRAAESRQKALDKMDRLEAPEVIKEASKISFETLVKSGNDVLHIENLKKSYDSLLFENVNLDLKRGEKVALIGENGRGKTTLFKIIMGMLKQDSGSVSLGKNVFTGYYDQEQSNLNLHKTIIDEVWDDFPNLTTTEVRNYLASFLFTGDDVFKEISLLSGGEKCKINLLKLMLSKANLLLLDEPTNHLDIMSREALEDAILSYDGTLIVISHDRYFLNKVINKIVELQENGLKTYLGNYNYYMDKKANPNRYEDIDEEINQGKTKTQIKEERKKKKSAEKSARALRAQLRDVEKLIPQKEEELEKLQEMLCTEEVYSNPEESVRVNKEINSVQEEIDSLYATWEELSESLEE

SEQ ID NO: 67925 - protein, 326 aa, Oceanobacillus iheyensis HTE831
MIDNFWRDLPRPFFVLAPMEDVTDVVFRHVVTEAARPDVFFTEFTNSESYCHPDGRQSVRGRLTFTEDEQPIVAHIWGDKPEYFRQMSIGMAEMGFKGLDINMGCPVANVAGNGKGSGLINRPEIAAELIQAAKAGGLPVSVKTRLGYTYIDEWKEWLKHVLEQDIVNLSIHLRTRKEMSKVDAHWELIPEIKKLRDEIAPDTLLTINGDIPDRQTGLKLVEEYGVDGVMIGRGVFKNPFAFEKEQKEHSSQEMLDLLRLHLDLHDKYDELESRSFKPLHRFFKIYVKGFRGASELRNQMMNTKSTAEVRALLDNFEIENTIEVDQ

SEQ ID NO: 67926 - protein, 270 aa, Arabidopsis thaliana
MEACLRCSRGSYLIEAMRPLSSSLRPSSSVSFSTGKPIKRAYDGLLLDAGGTLLQLSKPVHETYASLGQKYGLKTTPAEIKEGFKRVFSAPWPEKLRYQGDGRPFWKLVVSEATGCSDNDYFEDVYQYYANGEAWHLPEGAYETMSLLKDAGVKMAVVSNFDTRLRKLLKDLNVIDMFDAVIVSAEVGYEKPDERIFKSALGIGILHSKLNAEQISVDVNRAVHVGDDEGADKGGANAIGIACCRAFWPRKDKERRHGKKTCEVLPSDQG

SEQ ID NO: 67927 - protein, 673 aa, Ostreococcus tauri
MTTPTPRARSTGATRRGRTTSTPTPSAIGRLELLGWLNRELTCDLASLRDCADCVAYCQLVDALHPGAVILRALDFNAVTEGDKQRNARVLERGMRACGMEATVDYDALALGKFTEHNNLLRWFYAYVAKNGAEALERYDAYAARVKAQRHKARDGGEKSEATVSRERCGRADDESEEDDEGPRSGEVRIRAEVATGNNDISDSEDGEGGRAAARRENPGTLFDDVLNADNQNTTKQASQTNRKRRQAGRPSRYTIDEEDDDQEYDIIPVATQEYPDEIACSCGLCGRTFKTVRGRNVHASRCAGVRVENAPASAFVNASSGEHVCDKCGKMFPTFGGLKLHRVRWCKGMVSDNGADIVSSKTLVSSGSLREMETTKRARRCLLRQSEDCDHANTSFKTFNALQEHMEQCHGVPRVMEPMREVELDRSCRYCQECPTGEYRCKSFRQLCDHYKKEHNIVLLAVPGGANDVEVNGVSHEHAQVEMLNGHLDCTECDFRGKNHKGLKVHMRLVHNLQVKSIEPPITRPSKRLPLEASARAQMRGGDASAEIQRINPHEYGFSPIVTFGRHVTLCGVTASDEVEPTTTGQMRQAMVNLVELLVQAGTDAMHLLSVHVYITDIREQFNVSKVWDKFFSDCGIDQKDRPVRYITQTFASKDAMLRVELGAQAVLPTGH

SEQ ID NO: 67928 - protein, 200 aa, Vibrio cholerae O1 biovar eltor str. N16961
MSPIFDALVPMVVEQTSRGERSYDIYSRLLKERVIFLTGQVEDHMANLVVAQLLFLESENPDKDIFLYINSPGGSVTAGMSIYDTMQFIKPNVSTVCMGQACSMGAFLLAGGAPGKRYVLPNSRVMIHQPLGGFQGQASDIQIHAQEILTIKNKLNRLLAEHTGQPIEVIERDTDRDNFMSADQAVEYGLVDAVLKHRGE

SEQ ID NO: 67929 - protein, 310 aa, Rhodococcus sp. RHA1
MALDPAVKNLIDTLNEQGLKSFEQMSIAEVRGVVESFSGLQAPKADVARVVDTVYPGPGGDQAVRLYIPESETPLPIVVYIHGGGWVAGSLDVTEQPCRALAADAKVIVAAVSYRLAPEHKFPAAPEDAFAALNWVVEHAADFGGDGTRVAVMGDSAGGNLAAVTALRARDTGAPALRAQVLIYPVIDGTARFPSREENAEGYLVTTAAIDWFWEQYLATPEDAENPYASPAKAADLAGLPSTLLLLNEYEVTRDEGVDYGRRLADQDVPVQVELYEGLVHAVYWMTGAIPRSAELHGAVVEFLGKQFAG

SEQ ID NO: 67930 - protein, 485 aa, Luzula multiflora
NPSSSQEKNIGHITQIIGPVLDVVFASEKVPNIYNALVVKGRDSSDQDINVTCEVQQLLGNDQVRAVAMSATDGLRRGMEVIDTGAALSVPVGRVTLGRIFNVLGEPIDNLGSVDTSTKFPIHRSAPLFIDLDTELSIFETGIKVVDLLAPYRRGGKIGLFGGAGVGKTILIMELINNIAKGHGGVSVFGGVGERTREGNDLYVEMKESKVINEKNISESKVALVYGQMNEPPGARMRVGLTALTMAEYFRDVNKQHVLLFIDNIFRFVQAGSEVSALLGRMPSAVGYQPTLSTEMGSFQERITSTNRGAITSIQAVYVPADDLTDPAPATTFAHLDATTVLSRVLASKGIYPAVSPLESTSTMLQPEIVGEEHYETAQRVKQTSQRYKELQDIIAVLGLDELSEEDRLTVARTRKIERFLSQPFVVAEVFTGSPGKYVNLAETIRGFQLILSGELDSLPEQAFYLVGNIDEATAKAINLETESD

SEQ ID NO: 67931 - protein, 275 aa, Bacteroides uniformis
IDKVGDPFPEATYEACKNADAVLFSAVGDPKFDNDPTAKVRPEQGLLAMRKKLGLFANIRPVQTFKCLLHKSPLRAELVDGADFLCIRELTGGMYFGEKYQDNDKAYDTNMYTRPEIERILKVGFEYAMKRSKHLTVVDKANVLASSRLWRQIAQEMAPQYPEVTTDYMFVDNAAMKMIQEPKFFDVMVTENTFGDILTDEGSCISGSMGLLPSASTGESTPVFEPIHGSWPQAKGLNIANPLAQILSVAMLFEYFDLKEEGALIRKAVDASLDA

SEQ ID NO: 67932 - protein, 491 aa, Marsippospermum grandiflorum
TSNPVVSTLKEKNIGHIVQIIGPVLDVVFLPGGLPNIYNALVVKDRDTVGPDIHVTCEVQQLLGNNRVRAVAMNATDGLTRGMEVIDTGAPLSVPVGGATLGRIFNVLGQPIDNLGPVDTSTTFPIHRSAPAFIELNTELSIFETGIKVVDLLAPYRRGGKIGLFGGAGVGKTVLIMELINNIAKGHGGVSVFAGVGERTREGNDLYKEMKESGVINEKNISESKVALVYGQMNEPPGARMRVGLTALTMAEYFRDVNKKDVLLFIDNIFRFVQAGSEVSALLGRMPSAVGYQPTLSTEMGSLQERITSTKKGAITSIQAVYVPADDLTDPAPATTFAHLDATTVLSRPLAAKGIYPAVSPLDSTSTMLQSNIVGKEHYETAQRVKQTSQRYKELQDVISVLGLDELSEEDRLIVARARKIERFFSQPFCVAEVFTGSPGKYVDLTETIRGFQLILSGELDHLPEQAFYFVGNIDEATAKAINLEAESNLK

SEQ ID NO: 67933 - protein, 641 aa, Geobacter metallireducens GS-15
MLHLKNLSKDFAGRPLFTGINWHLKKGERVGLVGENGAGKSTLMKIVAGLVEHSAGEMIFAKGATVGYLPQDGIVTRGRPLLAEVMTALDDLQRMERELADLTRRLEEIPHDDPEHGALLDRYGHLQEEFRLRGGYAMEAEACRVLDGLGFLPADRGRDCGEFSGGWQMRIALAKLLLKKPNVLLLDEPTNHLDIEARNWLEGYLCEYPHSVILVSHDRFFMDQVCHRITEVWNSVLTDYHCSYSRYLVQREERVAALREAKRRQDEEVQKIEDFISRFRYKADKASLVQSRIKQLEKIERIVLPPERKKIRFRFPDPPASGRIAMELAGVVKAYGPNVVLNGVDLTVEKGERIALVGHNGAGKSTLMGIMAGKPFEGGERIVGHNVALDYFAQDQAQVLDSDKSVHDELLADAPFAMVPQLRDILGAFLFSGDDIHKKVAVLSGGERNRLALAKMLLRPSNLLLMDEPTNHLDLFSKDVLLDALKTFPGTVVFVSHDRYFIDGLATRVVEVAGGQLTSYHGDYEYYLQKKAAVDGQISPVPGPRSPVPDSVPESKEERLRQREEEKSRQRDEKRRQKRLEELETAIAAEEERLAELEARMADPAFFQDLEAARQGGEEHAALTARIAGLYEEWETVGAEG

SEQ ID NO: 67934 - protein, 275 aa, Bacteroides uniformis
IDKVGDPFPEATYEACKNADAVLFSAVGDPKFDNDPTAKVRPEQGLLAMRKKLGLFANTCPVQTFKCLLHKSPLRAELVDGADFLCIRELTGGMYFGEKYQDNDKAYDTNMYTRPEIERILKVGFEYAMKRSKHLTVVDKANVLASSRLWRQIAQEMAPQYPEVTTDYMFVDNAAMKMIQEPKFFDVMVTENTFGDILTDEGSVISGSMGLLPSASTGESTPVFEPIHGSWPQAKGLNIANPLAQILSVAMLFEYFDLKEEGGVIRKAVDASLDA

SEQ ID NO: 67935 - protein, 289 aa, Neisseria meningitidis FAM18
MKPIRKAVFPVAGMGTRFLPATKASPKEMLPIVDKPLIQYAVEEAVEAGCTEMVFVTGRNKRSIEDHFDKAYELETELEMRHKDKLLEHVRNILPPNITCLYIRQAEALGLGHAVLCARAAIGDEPFAVILADDLIDAPKGALKQMVEVYGRSGNSILGVETVEASQTGSYGIVETEQLKQFQRIIGIVEKPKPEDAPSNLAVVGRYILTPRIFDLLTGLPRGAGNEIQLTDGIAKLLDHEFVLAHPFEGTRYDCGSKLGYLEATVAYGLKHPETGEPFRRLLEKYRTE

SEQ ID NO: 67936 - protein, 313 aa, Synechococcus sp. WH 8103
WNTGRLEEGGNLAYKIQLKEGYFPVAPNDTAQDIRSEMLLLMGQLGIPTEKHHHEVAGAGQHELGMKFAELIQAADNVMTYKYVVRNVAKKYGKTATFMPKPVFNDNGSGMHVHQSLWKGGQPLFFGEGTYANLSQTARWYIGGILKHAPAFLAFTNPTTNSYKRLVPGFEAPVNLVYSEGNRSAAVRIPLTGPSPKAKRLKFRSGDALANPYLAFSAMVMAGLDGIKNQIDPGDGENRDLFELPAEKLAKIATVPPSLNGALEALNADRGFLTAGGVFSDDFIDNWIDFKYEEVQQLRQRPHPHKFAMYYDA

SEQ ID NO: 67937 - protein, 340 aa, Thermoplasma volcanium GSS1
MPCIVRCIRCGNVRKNEELRCPVCGNLYEIYPDFKFQDDYEKNFPYIKKWVSLGEVETPIVNYGEVKFKIDYYQPTFSYKDRGSKVLISHIRDITPSQNISTISEDSSGNAGASIAAYGAAAGLKVKVYVPKTVSGQKFKQILVYGAEAVKIDGNREDVQIAAENSGYYYASHVLRPEFRDGIRSLAYEIFMQTEKMPDHIFIPVSAGTLLIGLYSGFEHLFRSGEIEKIPNIVAVQAEAVSPVCAKLNGEQFDENSNATSIADALVSKKPILLEKMLSILRENGKCIRVSDNEIIEARKELALKGIYAEYSSSTVFAAYKKKKLENSLLVLTGAGLKND

SEQ ID NO: 67938 - protein, 193 aa, Neisseria meningitidis FAM18
MCYTFKLHTFPNKGNQMADFNQILTPGDVDGGIINVVNEIPAGSNHKIEWNRKLAAFQLDRVEPAIFAKPTNYGFIPQTLDEDGDELDVLLVTEQPLATGVFLEARVIGVMKFVDDGEVDDKIVCVPADDRNNGNAYKTLSDLPQQLIKQIEFHFNHYKDLKKAGTTKVESWGDAEEAKKVIKESIERWNKQA

SEQ ID NO: 67939 - protein, 424 aa, Saccharophagus degradans 2-40
MENIFKDLESNVQSYALSFPVIFNRAKNEELFDTEGNAYIDFLAGAGSLNYGHNNDVIKKALVEYIMEDGVTHGLDMHTKAKAEFMDSFNTHILQPRELDYTMQFTGPTGANAVEAALKLARKVKGRTNVVSFTNGFHGVTAGAVAATGNQHHRDGTGVPLANVSRMPFCGYHGQNVDTIKMIDKLIGDPSSGVDAPAAAIVEVVQGEGGLNVAQDEWLRQLEKLCRKHDMLLIVDDIQAGCGRTGTFFSFEKAGIKPDIITLSKSFSGYGLPMAVVLMSPELDIWKPGEHNGTFRGNNHAFVTAKAAIEHYWKDDKFQNEIAEKSAKVTKRLKHIADKYGVTKARLKGRGLMQGIDVVSGEIADEITTKAFEKGLIIETAGNLSQVIKVFCPLTITMEKLNAGLDIVESAFAEVLGDKLRNVS

SEQ ID NO: 67940 - protein, 645 aa, Saccharomyces cerevisiae
MVEKRSRQSSSSGSEFSVPPDVDNPPLSIPLKTLSDRYQLIEKLGAGSFGCVTLAKAQFPLSNILGKQHDIRGTLMDQPKNGHQNYITKTQGVVAIKTMMTKLHTLQDYTRVREIKFILAIPANDHLIQIFEVFIDSENYQLHIVMECMEQNLYQMMKHRRRRVFSIPSLKSILSQILAGLKHIHEHNFFHRDLKPENILITPSTQYFEKEYMNQIGYQDNYVIKLADFGLARHVENKNPYTAYVSTRWYRSPEILLRSGYYSKPLDIWAFGCVAVEVTVFRALFPGANEIDQIWKILEVLGTPIKRSDFVNTNHITAPPPGGFWDDASNLVHKLNLKLPYVEGSSLDHLLSSSQLSDLSEVVKKCLRWDPNERATAQELCEMPFFENTVASQVDARGNVTNTEQALIFAGINPVATNTKPIYFNSSTKLPAETESNDIDISNNDHDSHAMCSPTLNQEKLTLVEFLNEFVEEDNDDHSIPDVGTDSTISDSIDETELSKEIRNNLALCQLPDEEVLDHSLSNIRQLTNDIEIINKDEADNMEQLFFDLEIPEKDEFQRKQPFNEHADIDEDIVLPYVNNSNYTHTDRSHHRGDNVLGDASLGDSFNSMPDFTPRNFLIPTLKKSREKFEPHLSNSNQHFGNVTF

SEQ ID NO: 67941 - protein, 431 aa, Zea mays
MKPRASLERLARPFSSSSRRSSSDQSRRDREEEADLEAIAAREQRAFRYETLAAATRSFSEKNRLGQGGFGPVYRGRLEDGRDVAVKRLGAGSRQGAREFRNEATLLSRVQHRNVVNLIGYCARGAEDKLLVYEYVPNESLDKILFSSSSSARSSSNSDRSRRAELTWPRRHEVVVGVARGLLYLHEDAHTPIIHRDIKASNILLDDRWVPKIADFGMARLFPEAGDGHSRVHTRVAGTNGYMAPEYLMHGDLSTKADVFSFGVVVLEIVSGRKNSAFIPPPDAEADSLLEYAWRLYKKGRSLELLDHAVKSSAVPEQVELCVRIGLLCVQADPRLRPDMKRVVIILSKKQSTLEEPTRPGVPGSRYRRRPHGLRGTHYSAGSSSGTSLPSTSATSDASASASASVSNAMTTSSTHTMRSQGLPSHREEHE

SEQ ID NO: 67942 - protein, 1022 aa, Medicago truncatula
MKNILKKLHIMSNNQSEDAQAERSNKSNDGSSSSPTTRNKLSNWLHSVSSNRKQSPGSPPSGERVEELSDSLTFGGGGGGLDMVVSDSTKRDSGSSSSRDPEVEEEYQIQLALELSAKEDPEAVQIEAVKQISLGSCHPDNTPAEVVAYRYWNYNALGYDDKISDGFYDLYGVLTDSTSTRMPSLIDLQGTPTANDVKWEAVLVNRVADSNLLKLEQKAMGFAVKSREDFEIVVDRNLVHKLAILVAEYMGGSVEDPESMSRAWRSLSYSLKATLGSMVLPLGSLTIGLARHRALLFKVLADSLGIPCRLVKGMQYTGSDDVAMNFVKIDEGREYIVDLMAAPGTLIPSDAAGSHIEYDDSSFVASPSSRDLDSSHITSFSSGVGSSSEETSDFRTFEKGNRYKHFADAGKESDVSSRPPTCKEELKKPLNEFKNIPNVEKIKARESVSRPNNYPYMHGRSPSWTEGISSPEAHRMKVKDVSQYMIDVTKENPKLAQKLHNVLLESGVVAPPNLFSEIYHEQLGSQNEANSPTEEDEYKHRSAQKEAKEDSDNLAPRFLPPLPPHIIHPKASPSNQLEHSKPVEGLGIGLSLDSREAAVQHTYSDAEATLVKYGKNVPVAAAAAAAAAVVASSMVVAVAKSSTDSSFEIPVAAAATATAAAVVATTAAVSKQYELGNRSDGDAEGSGNEPKGSGDGENNALGANSEGGEKSDRSVSNDSTKSDLALDDVAEYDIPWEEITMGERIGLGSYGEVYRGEWHGTEVAVKRFLLQDISGESLEEFKSEVQIMRRLRHPNVVLFMGAITRPPNLSIVTEFLPRGSLYRLIHRPNNQLDERRRLRMALDAARGMNYLHNSTPVIVHRDLKSPNLLVDKNWVVKVCDFGLSRMKYSTFLSSRSTAGTAEWMAPEVLRNELSDEKCDVFSYGVILWELFTMRQPWGGMNPMQVVGAVGFQHRRLDIPDDVDTAIANIIRQCWQTDPKLRPTFAEIMALLKPLQKPITGSQAHRASVHAHSSRSAEDPAAA

SEQ ID NO: 67943 - protein, 477 aa, Saccharophagus degradans 2-40
MLTVEKIGGTSMSDYLTVRDNVVLGPNGENPTTGRILVVSAYGGMTDQLLEHKKSGKAGVFAYFSSDEDAGSWREALNNVRQNMFQKNAELFNSADAISKANVFIGERLDTAERCLEDLQRLCGHGHFSLEAHLSTVREMLASLGEAHSARNMAELLKEEGVNARFVDLTGWNADKSLGMDEHILEQFKDVDLGNELPVVTGYAHCESGIMSTFDRGYSEMTFSRIAVLVQADEALIHKEYHLSSADPKVVGVDAAVPIGRTNYDVADQLANLGMEAIHPKAAKGLRQSNIPLRVKNTFEPDHNGTLITTDYVSEKPCVEIIAGKQAVYAVECFNQDMVGDLLNFEQKIMQICQRFRCTHVTKDVNANTVTHYLSSNMKKIKRVQRELEEMFPESEINVKKVSIVSAIGSDMQVPGILAKTVGALADAGISVLAVHQSMRQVDMQFIVEEAAYEAAVRALHKCLVEVHDHGIAICAA

SEQ ID NO: 67944 - protein, 271 aa, Zea mays
NKFVQKSRLVPVRNSRDIVIGGGSGGSGSGRRAAGWYGAKTLIVESGRSGGTCVNVGCVPKKMTWNFASINETLHVAKHYGYDVSENVDKNYRHFKEIRDSTIKRLNGIYERNWGREGIDLVHGRAGFVEPKTIEVTLEDGSKARYSAPHILIAVGGRPSIPDIKGAEHGITSDGFFEIEELPPKIAVVGAGYIAVELAGVMGAVGCETHMFIRGETFLRKFDPMIQNTMTERYEASGIHIHKKHPGLKEVQLIRDGKGKDKLLKLISNDG

SEQ ID NO: 67945 - protein, 1648 aa, Shewanella sp. MR-4
MNNLQFKRSAIASLTALYVSGACTFALAAPGMEKVAGSSFYTPTFTAEDVLKVTNERKAELSGDIYVGTPGQLNRVKKARTPEEIFQPEASSQGVQTYIVQLDAEPLATYEGDIPGFAATKAPVNRSIIAKGRVSVNTAAAQSYKSFLLGKQDKFVSRVRQAGVNLKINKQFTIASNALVVEMTQEDAIRMSHQAGVKRISPNRIFELRTDRGPEFIGADQMWQGTATQGGLPVKGEGMVVGIIDTGINTDHVAFADDEEYARLNPYKGQAIGDCGAFPELCNNKLVGLHSYPEITDVYAAPEFQTSSGAKKRIRPANAEDYAGHGSHTASTVAGNTLKDTPLQGFTGDKVSDGVDVPFTFPQTSGVAPRAHIIAYQVCWPGSSGDPYAGCPESAILSAFEDAIADGVDAINFSIGGAENMPWGDPMELAFLSAREAGISVAAAAGNSGAFWTADHSSPWVTTVGASTHDRKLKAGIKSITAFEGTGKPTTAIQGTSFSGSITGEVVLAEKYADPNPNDSYKAASCNVPFPAGTFTSDQIVVCERGDIARIEKAKNVAAGGAGGVILQNMSSSVDNLEADMYVIPGIQVKYTDRLKIRNWVLKNPGTARATITDFTNDYSFDASAGNNLATFSSLGPSKTNNTLVPDLTAPGVDIYAANADDQPFTNNPSASDWTFMSGTSMAAPHVTGAMTLLTQLHPDWTPAEIQSALMLTAGPVVLNTGYELIEPYYNFMAGAGAINVARAADTGLVMDETIENYRNADPTNGGVVNWLNLPSMVEMECEKTCSWMRTVKATRDGTWTVEGVGKEEGFEVSVSPASFSLKAGESQSIIITAKTPNLIEHKVEPEDGSSPWSAVLNQNTFFNGQVLLKEVNSSSPDVHMPVVVASVAEQLPISHRFEISRDQGTESLVVNTDSYSQLTPRFYGPVKPEIASSKLTAVSAILSKANIDKGWDIRPLVVPEGTKRLVVEVQKAEQVSTLENLNPRYTQLHPFIMVGLDKNGSNTFVPEGDSPTSSEIRAEYIDELMCISTSQSEHNYCSFESPTPGTYWIATAMAYASGQGDVAIETGYALVMENDDKGYLSMSGPASHDGNGNYEIGLNWNIPETKAGDVYYGGFDLGNMPGAEGTLGFTALDIRRADDAVTWSVSQDKARSMDVIDVKLNIAPNLETQDRNYKFEMKLPEGMRLATGTIKTNNDEVATAIVADEHTLTLSGLQLSTRNVEREYKVSTNLTDKMCHTPIIDEYSKGGYIDLWGEFRIQPNADWFVGDFNNAFDVPINWLFYKQDAKFEVYNQPNAGYMRMHTVGALQFNTGYWYMSQHRGPGFLNEALAPFWRGTFTSKYRRDPSSPWGLTIASQYAAERPDLGDLLFLEFDNVTDTKTGEEFDFETILRSGIDDRPGQFEIIYAYSNLGENVAKGAVFVEGFDSPWSKTVGPKNGTLYEVLGFDDLDEKLQNDLVVCYDYVGPEQSRMEVSFKVAVQPEATGKTLDLELNYDLEGATPTSLVHTVAVNGNIKLVPIANQVVAENTRLEGLSVSYVDANKVPNTVEVSGEHISAEINGNDFTLIPEANFHGDTLVTVTIRDNEIGSDAASTSFMLTVESDGVEPPPVTPVTPDKPEPESSSGGALGWSLLSLLSMAFIRRAKKATRA

SEQ ID NO: 67946 - protein, 473 aa, Mycobacterium sp. MCS
MTVMAPETVGETLDPRDPLLRLRTFFDDGTVELLHERDRSGVLAAAGTVNGVRSIAFCTDGTVMGGAMGVEGCRHIVNAYDTAIEEQSPIVGIWHSGGARLAEGVKALHAVGLVFEAMIRASGYIPQISVVVGFAAGGAAYGPALTDVIVMAPDSKVFVTGPDVVRSVTGEDVDMVSLGGPEAHHKKSGVCHIVASDELDAYERGRRLVGLFSQQGHFDRTKAEAQDSDLAALLPESARRAYDVHPLITALLDDGVPFEEFQGKWAPSMVVGLGRLAGRTVGVLANNPLRLGGCLNSESAEKAARFVRLCDAFGIPLVVVVDVPGYLPGVDQEWGGVVRRGAKLLHAFGEATVPRVTLVTRKIYGGAYIAMNSRSLGATKVFAWPDAEVAVMGAKAAVGILHKKKLAAAAPEDREALHEELAAEHERIAGGVDSAIEIGVVDEKIDPAHTRSKLTQALAEAPARRGRHKNIPL

SEQ ID NO: 67947 - protein, 346 aa, Oceanobacillus iheyensis HTE831
MYTAKARAVDGPHQPFHATEIKRRNLDSHDVLIEIKYSGICHSDIHTAHGEWGEVNYPLVPGHEIAGVVSDVGPEVTKYKVGDRVGVGCMVDSCGECENCRRGEEQYCHQGNVQTYGGVDKYGEPTQGGYSTHIVVTEDFVLRIPDNIELDVAAPLLCAGITTYSPLNHWNAGPGKKVAVVGMGGLGHMAVKIAHAMGAEVTVLSRTLNKKEDGLEFGAENYYATSEKETFETLAGSFDLIINTVSAKLDMDAYFSLLNLDGSLVNVGAPAEPLSVNVFSLIGHRRSFAGSLIGGIRETQEMLDFCAEHNIVPKIEVISADQIDEAYTRVLDSDVKYRFVIDVSTI

SEQ ID NO: 67948 - protein, 258 aa, Arabidopsis thaliana
MENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 67949 - protein, 606 aa, Mycobacterium sp. MCS
MSAAPTLKKALNQRQLRMIAIGGVIGAGLFVGSGVVIADTGPGSFLTYAMSGVLIIMVMRMLAEMAVANPSTGSFADYSRNALGNWAGFSVGWLYWYFWVIVVGFEAIAGAKIIQYWIDVPLWASSLVFMVLMTATNLFSVKSYGEFEFWFAGIKVAAIVAFIALGALFVVGLWPGKDADFSNLTAHGGFMPMGFGVITVGIVTVIFSMVGAEIATIAAAESADPERAVSKAANSVIVRILLFYVGSALLLVTILPWNDEGIAASPFVAAFTEMGIPYADHVMNAVVLTAVLSCLNSGMYTASRMLFVLAARREAPPSLVRVTRRGVPAQAILASSVVGFLCVIAAAVSPDTIFAFLLNSSGAIILFVYLLIAVSQIILRRRTPDSELRVKMWLFPVLSVLTAVGIVAILVQMFIDDALRSQLVLSLLSWGVVLLLYFANKHFLKRRPTKAGVTGTGKPHRVLVLANQTVNSTELLDELHRIGADQETHYFVVVPVSPIETGTAETHGPLDVEEATQKAASERLDLTLNALRGHDFTADGELGDRRPLRALADAVESFDPDQIVISTLPPEKSVWQRFDVVDRARAQHRVPVTHVVATGAEATATP

SEQ ID NO: 67950 - protein, 518 aa, Mycobacterium sp. MCS
MTSSRSPVLNASRRATELSALADGAPLDVVVIGGGITGTGIALDAASRGLSVALVEKHDLAFGTSRWSSKLVHGGLRYLASGNVGIARRSAVERGILMTRNAPHLVSAMPQLVPLLPEMGGPARALVRAGFLAGDGLRRLAGTPASTLPRSRRVTAGRAAELVPAVRRDGLAGAFLAYDGQLIDDARLVTAVARTAAQHGARILTRVGASHATGTSVRLTDQCTGESFDVAARAVVNAAGVWAADVDETLRLRPSRGTHLVFDAAAFGHPTAALTIPIPGALNRFVFAMPEQLGRVYLGLTDEDAPGPIPDVPQPSPQEVTFLLDTVNTALATTLTAADVRGAYAGLRPLIDTAHARSETGTGAGSTADLSRDHAVTESPSGVISVIGGKLTEYRYMAEDVLDRAIALRGLTAGPCRTRDLPLVGAVGRVPADLPTSLVARYGAEAPHVVARARCDRPTAAVADGIDVTRAEFEYAVTHEGALTVDDILDRRTRIGLVEDDRNRALQVAKEFVDALVE

SEQ ID NO: 67951 - protein, 174 aa, Zea mays
SPPPSSFTSKFADELIANAAYIGTPGKGILAADESTGTIGKRLASINVENVESNRRALRELLFTTPGALPCLSGVILFEETLYQKSSDGTPFVDMLKSAGVLPGIKVDKGTVELAGTNGETTTQGLDGLGDRCKKYYEAGARFAKWRAVLKIGVNEPSQLAIHENAYGLARYAV

SEQ ID NO: 67952 - protein, 136 aa, Rosa hybrid cultivar 'Pavarotti'
MLPLTGQQYSEKVSENCVAIWKKFGIYTDAEAKAIEKFVEVFKDQTFPPGASILFTQSPNGSLTIGFSKDGSIPAVGNAVIENKLLSESVLESIIGKQGVSPEARKCVATRLSELLKESDDCVAGNGEVKEAEVKA

SEQ ID NO: 67953 - protein, 377 aa, Triticum aestivum
MASFNAAGAGAANPNPNKSLEVRALGQYCCPWSKWLKPNVWVDSTGDCLRFVQVNPAPGDSVSSLSFSPKANHLIATSWDNQVRCWEVQPGGQCQAKASISHDQPVLCSAWKDDGTTVFSGGCDKVVKMWPLLSGGQATAFSGHEAPVKELAWIPQMSLLVSGSWDKTLRYWDIRQPNPAHVQQLPERCYALSLSYPLMAVGTADRNVVIFNLQNPQAEFKRIVSPLKFQTRCIAAFPDQQGFLVGSIEGRVGVHHVDDSNQSKNFTFKCHREGNDIFSVNSLNFHPVHHTFATAGSDGGFNFWDKDSKQRLKAFSKCPSPITCSTFNQDGSIFAYAVCYDWSKGAEKHNPSTAKTNIFLHSVQESDVKGKPRTGKK

SEQ ID NO: 67954 - protein, 266 aa, Cryptococcus neoformans var. neoformans JEC21
MPHIALTRPRPTVWQIALTSPPDNRLVPALLSELSDALDAVEIEWRQAGGGDMDPKKREGYAGKGAGALVFTSGLPKFFSNGLDFEGSLKINNFFEEVYDPVMWRLLTFPLLTVAAINGHAFAGGMVLALCCDYRIITSGKGFMCMNEITFGSPLPNSFSALLANRIPDPQHLRDTLLARRWTQPELLKIGLVDKVVEQDKVIEQAVELGEKEGIRVAPGSWGLIKEGVFRPILESSQSYRPVARPPDAEKAFWNRVGKGKGKAKL

SEQ ID NO: 67955 - protein, 430 aa, Ostreococcus tauri
  misc_feature (1)..(1): Xaa can be any naturally occurring amino acid
XLGAAHFIPSTSASPRPTFLYTVPTAARSSSRNNGAFTAPGTCPFPYSPGDRTSISVVERRSTNASASAPLPVRQRVPLAVAARANASIVAAFLVDGSMIASNPARARAQSGDPSSSTVDRERYDEKREISVFAAEDAADELIAGRARRDGEVFIGSISLEATEDAVRRALKACGAETGAVGFEMMTDRATGKHRGYAFARYGDPESAAKAIETIESARVEIGGQKIRASVKPNKTRVFVGGIRKDATRAECVEALRARGAGLEFFELARPKKKKEGVEQTDENGGHGWATYYNEACAERFMKNMREAEDKLPIANESDTRGMTTSWATVKASAAKVQGIRTLHVRDLNSTNATEEAMRECFGRFGDIEDVQLRTDREPHFAWVTFANPNDAEKALGECEPVPDAPEGRKGGSFISSVDGATLNIAPAKV

SEQ ID NO: 67956 - protein, 300 aa, Zea mays
AEAMESPFRADVVKDKAALVTGGGSGICFEIAAQLARHGAQVAIMGRRREVLDKAVAALRSQGLRAVGFDGDVRNQEDAARVLAATVAHFGKLDILVNGAAGNFLASPEDLTPKGFRTVLEIDTLGTYTMCYEALKYLKKGGPGKGPSTGGLIINISATLHYSASWYQIHVSAAKAGVDSITRSLALEWGTDYDIRVNGIAPGPIQDTPGLRKLAPEEMSKGLREMMPLFKFGEKRDIAMAALYLASDAGKYVNGTTLVVDGGLWLSHPRHIPKEEVRELSKVVEKKVRASGVGVTSSKL

SEQ ID NO: 67957 - protein, 325 aa, Oryza sativa Japonica Group
MPAPPAASWRRHAAAAAASSSTRKTLLLLLPVFLLLLLFVLSRAPDLTLSPAAASSRHLSAGVRPFDCYASQQASPVFASLVEGVPHPFFYSLADMGALPDHPHKNIARILKGKRFRKPDISETIQQLLGGKVGIGSRGVVVDVGANVGMASFAAAVMGFRVVAFEPVLENLQRICDGVYLNRVQDQVVVYHAAASDRVGNITMHKVIGRLDNSAISATGAKLAFKANEEIAVEVATIPLDEVILDAERVVLIKIDVQGWEYHVLRGASKLLSRRKGDAPYLIYEEDERLLQASNSSAREIRAFLSSVGYNHCTRHGTDAHCTKN

SEQ ID NO: 67958 - protein, 508 aa, Vibrio cholerae O1 biovar eltor str. N16961
MKRSSICYRASKPLIASLVMSVWNAVHLSRRFAALPQAFYTPVHPQPLQNVRWGMWNSRLAQQFGLPEAPNDELLLSLSGQQLPADFSPVAMKYAGHQFGVYNPDLGDGRGLLLAEMATKQGEVFDIHLKGAGLTPYSRMGDGRAVLRSSLREYLCSEAMAGLGIATTRALALMSSETPVYREREERGALLVRLAHTHVRFGHFEHFFYTDQHANLKLLADKVIEWHFPDCVQTSKPYAAWFSQVVERTALMIAQWQAYGFNHGVMNTDNMSILGETFDYGPFAFLDDYDPNFICNHSDYQGRYAFDQQPRIGLWNLSALAHALSPLIDKDDLEAALGSYSERLNLHFSRLMRAKLGLATQQEGDGELFADFFALLANNHTDYTRFLRELSCLDRQGNEAVIDLVLDREAAKTWLTRYLERAARELGQEGRPISTRERCQAMRQVNPKYILRNYLAQQAIEFAERGDFEEMQRLATVLASPYAEHPEFERYAKLPPEWGKKLEISCSS

SEQ ID NO: 67959 - protein, 516 aa, Novosphingobium aromaticivorans DSM 12444
MEAKQREGRARLVLVTGAARGIGLACAHRFARAGDRVVMADRDLAACTFEAERLGSRHVALQLDVSDEAAVEHAMDGLLQQFGAFDVVINNAGVVDRFARPLLDVPPEDIDRLIGVNLEGPYLVVRAALRTILAGRRGAAIVNVASGAALRALPGRAAYSMTKAGVIGMTRAMAIELGPQGIAVNAVLPGYIDTEILLALEREGKFDRAAAAGAIPMGRLGRTDEIAEAVHYLARGGYHCGSLLSVDGGVDAYGGSGKASTAVMPHRPVRAGDVACVTGGASGIGAVVADRLAGLGWLVAIIDSREIADGPHPAWQADIASEASVESAMAGIAGQLGPVTLLVNNAGIVEPMAKSADQALADFRRTIDVNVKGTIHASRAAARQMIGAGGGAIVNLSSITASLGLPGRNAYCASKSAVTMLTRSLACEWAAHGIRVNAVAPGYILTPAVQALLASGERDMNSVVRRIPVARLGQPDEVADAIAFLASDAASYVTGATLQVDGGYLASGHPPDGPMP

SEQ ID NO: 67960 - protein, 478 aa, Geobacillus kaustophilus HTA426
MPIAVQKQKLYINGEWREGKSYTELKSPYSRETIAEIPVATEQEVDEAIAAAYAARQTMAAMPAHERAAILERVGEQLKARQEEAARLIALEAAKPIITAKGEVARTIQTYKFAAEEAKRIHGETLPLDAAPGGEHRIALTVREPIGVIGAITPFNFPMNLVAHKLGPAIASGNTVVLKPASQTPLSAYFIAELFEKAGLPKGALNVVTGSGRTVGDKIVTDPRISMITFTGSPEVGIAIRNKAGLKRVTLELGSNSAVIVDEQVDLDRIIPRCVFGAFTFQGQVCISLQRIYVHENRYDEFVEKFVAAAKQLKTGDPLDPTTDVSALITPNDVDRALSWIEEAKQGGANVVLGGERDGNILLPTVIVDAEPTMKVSCQEVFAPIVLINRVRSIDEAIELVNDSRYGLQAGIYTDNVHTAWKAAKQLHVGGVLINDIPTFRVDHMPYGGVKESGFGREGVRYAIEEMTELKLIIFNES

SEQ ID NO: 67961 - protein, 385 aa, Silicibacter pomeroyi DSS-3
MGSMQIRHYSNRFLLSTLRKNMPIQGGIVKTFVDAPVSGAVDDQALLRRALERFARIRLGHLPSPLEPLDRLSEALGGPRIWVKRDDCTGLSSGGNKTRKLEFLMASACEAGADTIITQGAIQSNHARQTAAAAARLGLHCHLLLEDRTGAADLAYTLNGNVLLDRLHGATISRRAGGSDMAAEMERLAATLRGKGKRPYVIPGGGSNRVGALGYVNCALELSEQALSMGLDIDALIHATGSCGTQAGLVAGLAGLSWNTHLLGIGVRAPQERQEAMVFDLACETMDYLGMGIPIVRSGVRANCDHVGPGYGLPTEAMCEAVRMLARLEGLLLDPVYTGKAMAGLIDLTRQGYFDGMANIVFLHTGGSAALFGYPEIFGLPGYQP

SEQ ID NO: 67962 - protein, 112 aa, Triticum aestivum
MATKRSVGTLREADLKGKKVFVRADLNGPVDDAEKITDDTRIRASIHTIKYLLEKGAKVILASHLDRPKGVTRKFILKPIVARLYELLGLEVVMAADCIGKEVEKLACALPD

SEQ ID NO: 67963 - protein, 435 aa, Thermoplasma volcanium GSS1
MSGKADPLEIAKEQVAPVKEEIEEDPFEIALKQLNKAAKVLNLDEQALEILSSPQKILQVSIPVKMDDGKVRVFTGFRVRHNIARGPAKGGIRYHPQETLSTVKALSMWMTWKCAIADIPYGGAKGGIICDPSTLSQGELERLSRGYIRAIADFIGPEVDVPAPDVNTNPQIMAWMMDEYENIVRHSAANVITGKPLEVGGSLGRFDSTGKGGMFVLREGAKKIGLDLSKARVAVQGFGNVGQFAVKFVQEMFGAKVVAVSDIKGGIYSENGFKFDDLLAWSKKIGSVVGFPGSKPITNEELLESDVDVLIPAAIEEQITEKNADKIKAKIILELANGPTTPEADEILYKKGKLVLPDVLSNSGGVIVSYFEWVQNNYGEYWTTEEVYDKLDQKITKAARQVLDTMDKYHVDPRTAAYVIAVKKVADAMKVRGWY

SEQ ID NO: 67964 - protein, 187 aa, Burkholderia mallei ATCC 23344
MPIINSPIKPFKATAYHNGDFVQVSDETLKGKWSVVVFYPADFTFVCPTELGDLAERYAEFQKLGVEIYAVSTDTHFTHKAWHDTSDTIAKIKYPMIGDPTLAISRNFDVLIEEEGLALRGTFVINPQGEIKLCEIHDNGIGRDAGELLRKVQAAQYAAAHPGEVCPAKWTPGADTLTPSLDLIGKI

SEQ ID NO: 67965 - protein, 416 aa, Thermoplasma volcanium GSS1
MPESIDPFEMALQQLDKAARVLNLDEQALEILRQPEKILQVSIPVRMDNGKIKVFTGFRVRYNTARGPGKGGIRYHPDETLSTVKALASWMTWKCAIADIPYGGAKGGIICDPKSMSQGELERLSRGYIRAIADFIGPEVDVPAPDVYTNPQIMAWMMDEYENIVRHSAPNVITGKPLEIGGSEGRGDATAKGGMYVLREGAKRVGLDLSKATVAVQGFGNAGQFAVKFVQEMFGAKVVAVSDTKGGIFKSDGINYEALLDHKRKTGSVVGFPGSKPITNEELLESDVDVLIPAAIEEQITEKNADKIKAKIILELANGPTTPEADEILYKKGRLDLPDFLSNSGGVTVSYFEWVQNNYGEYWTAEEVYEKLDKKMTKAAHEVFDAMDKYKINPRTAAYVISVKKVADAMKARGMY

SEQ ID NO: 67966 - protein, 382 aa, Robiginitalea biformata HTCC2501
MKLPFESKLPGLEPSIFGVMNRISLDAGALNLAQGFPDFGADPELIRLHSEALEEGYNQYAPMSGIYSLREAIAEKTETLYGASYHPETEVTVTAGATQALYTAIAATIRPGDEVIVFKPAYDHYEPSVKAHGGVPVLLQLQGPDFRIDWVAFDAALTASTRMVIINTPHNPSGTVLSREDMEMLETRLRGTNILVLSDEVYEHLVFDGQEHQSVARFPGLRERAFVCASFGKTFHITGWKTGYCLAPELLMQEFRKIHEFAIFCVSHPAQRALKTYLENPDHYLELNDFMQRKRDLFLEAVASSRFTFTPAAGTYFQLLGYQDISEAPDTEFAETLARDKGLAGIPISVFNRNRQDNRQLRFCFAKKDETLKRAGEILSQV

SEQ ID NO: 67967 - protein, 1478 aa, Saccharomyces cerevisiae
MPFLRKIAGTAHTHSRSDSNSSVKFGHQPTSSVASTKSSSKSPRATSRKSIYDDIRSQFPNLTPNSTSSQFYESTPVIEQSFNWTTDDHISAGTLENPTSFTNSSYKNDNGPSSLSDSRKSSGGNSVNSLSFDKLILSWDPTDPDEWTMHRVTSWFKFHDFPESWILFFKKHQLFGHRFIKLLAYDNFAVYEKYLPQTKTASYTRFQQLLKKTMTKNVTNSHIRQKSASKLKSSRSSSESIKSKLKNSKSQEDISNSRSTSESALSPTKSGPSKTDEKNFLHSTSTHQKTKSASSLYRRSFISLRGSSSSNASSAKSPSNIKLSIPARPHSIIESNSTLTKSASPPASPSYPSIFRRHHKSSSSESSLLNSLFGSGIGEEAPTKPNPQGHSLSSENLAKGKSKHYETNVSSPLKQSSLPTSDDKGNLWNKFKRKSQIGVPSPNTVAYVTSQETPSLKSNSSTATLTVQTADVNIPSPSSSPPPIPKTANRSLEVISTEDTPKISSTTASFKETYPDCINPDKTVPVPVNNQKYSVKNFLLDQKFYPLKKTGLNDSENKYILVTKDNVSFVPLNLKSVAKLSSFKESALTKLGINHKNVTFHMTDFDCDIGAAIPDDTLEFLKKSLFLNTSGKIYIKDQMKLQQKPKPAPLTSENNVPLKSVKSKSSMRSGTSSLIASTDDVSIVTSSSDITSFDEHASGSGRRYPQTPSYYYDRVSNTNPTEELNYWNIKEVLSHEENAPKMVFKTSPKLELNLPDKGSKLNIPTPITENESKSSFQVLRKDEGTEIDFNHRRESPYTKPELAPKREAPKPPANTSPQRTLSTSKQNKPIRLVRASTKISRSKRSKPLPPQLLSSPIEASSSSPDSLTSSYTPASTHVLIPQPYKGANDVMRRLKTDQDSTSTSPSLKMKQKVNRSNSTVSTSNSIFYSPSPLLKRGNSKRVVSSTSAADIFEENDITFADAPPMFDSDDSDDDSSSSDDIIWSKKKTAPETNNENKKDEKSDNSSTHSDEIFYDSQTQDKMERKMTFRPSPEVVYQNLEKFFPRANLDKPITEGIASPTSPKSLDSLLSPKNVASSRTEPSTPSRPVPPDSSYEFIQDGLNGKNKPLNQAKTPKRTKTIRTIAHEASLARKNSVKLKRQNTKMWGTRMVEVTENHMVSINKAKNSKGEYKEFAWMKGEMIGKGSFGAVYLCLNVTTGEMMAVKQVEVPKYSSQNEAILSTVEALRSEVSTLKDLDHLNIVQYLGFENKNNIYSLFLEYVAGGSVGSLIRMYGRFDEPLIKHLTTQVLKGLAYLHSKGILHRDMKADNLLLDQDGICKISDFGISRKSKDIYSNSDMTMRGTVFWMAPEMVDTKQGYSAKVDIWSLGCIVLEMFAGKRPWSNLEVVAAMFKIGKSKSAPPIPEDTLPLISQIGRNFLDACFEINPEKRPTANELLSHPFSEVNETFNFKSTRLAKFIKSNDKLNSSKLRITSQENKTE

SEQ ID NO: 67968 - protein, 448 aa, Thermoplasma volcanium GSS1
MIMENEERTEKYNEDALRYSEYYKGKIQTMSKVPVRSLDDFSIWYTPGVAAVSRKIATDHDLSFELTGRWNTIAILTDGTRVLGLGNIGPEAAMPVMEGKALIFNYLGGVNAIPVPIRVSSREEFVSVAKSLEPSFGGINLEDIESPKCFFLLETLQKEMNIPVWHDDQLGTASITLAGIINSIRIVGKKIEEVKVVFNGAGAANIAAAYLFKAAGFKKENIILVDSKGVLQPERQDMDSLMLNNPWKYQLAIETNGERVKGDLKEALKGADILISAAKSGPDTVDAKLVKEMNNDPIVFVLANPIPEMWPEEAKENGAKIVATGRSDFPNQINNSLVFPGVFRGVLDARAKGVNFDVMVAASYEIANFVEEPTAEKIVPTMEEWELYPRLASAVATKTVELGLARKIDSKEGFYKRARDIIENNRNIYRKMMDLGLIRMMPNGERKY

SEQ ID NO: 67969 - protein, 313 aa, Brassica napus
MISDSITNASASAAPSARDMGKKKRTNRAAKLKQSKLGLRREQWLSQVAMINKGDKEETVPNRKTGIEKVVHRDLPVEKLDGQRGEEEAHHHESFVESLSNSPNSILTSINSIPNFCSGSSSGSGGSCSGNITEDEDAADGGCLDDWEAFADALAADEQKKHDKENPPEEQSASLRDSVSGSNVAVRDVKPMSRKQKSNQAWRADDKLRPQGLPNLGKQRSFPVMNLHFSSAAVPSSCPICYEDLDLTDSNFLPCPCGFRLCLFCHKTICDGDGRCPGCRKPYEKNTIKVETSVQNGGLTIRLARSSSMFCRS

SEQ ID NO: 67970 - protein, 580 aa, Oryza sativa Japonica Group
MSSKFLAIYLLLAFLSHGTCSYMATTASGWDDHDFFRHCPPSRCSKDGPEIRFPHRLESSNTSSACRASCARLACSGQDTILHHPILGPCKVTSIDYKEAVINIIHLLPFPCPLQKLMVDSLPPDDYHGCNLYRRIPAKIVSCSKEFTPSGTSPVPYELDHLQNAAENIFGPISCLSGTGQYFSYLVHAQLYMYLLPLDCRIVSRGSIPIPGSDSCSGPTFKEKAEKFINFAETTVSWGSFQDGVLDNCMACERQKQLCAFSSRRNQTFCTSHGNHHATSSVAAFVVFSFIMATALYLSLKSRYDEEVHLKVEMFLRTYGTSKPTRYSFSDVKKITRRFKEQLGQGGFGSVYKGRLPNGVPVAVKMIEHSTGNGEEFINEVATIGQIHHINIARLLGFCSEGTRHILIYEFMPNESLEKCIFLHDPNTSQELLAPKKMLDVALGIARGMEYLHQGCNQRILHFDIKPNNILLDYNFNPKISDFGLAKLCARDQSIVTLTKARGTMGYIAPELYSRNFGEISYKSDVYSFGMLVLEMVSGRRNSDPSIENQNEVYFPEWIYEKVITEQDFVLSREMTEEVD

SEQ ID NO: 67971 - protein, 397 aa, Physcomitrella patens subsp. patens
MAIENIKQQYNLSDWSGDPCFPYPYNWLACTLDSSGPRISTLFLQDNHLEGSVPKFGNKQLIMNRNSWMPLGLDGHLCYLPFEPKQMQSPYGIRCDSSLNFFQNHTQVFSLRELRVASKNFSKKIGEGGFGPVYYGKLADGQEVAIKVSNGISKQGQSEFFTEVDLLSRIHHKNLVSLIGYCQEKDNQTLIYEYFPNGSLRDHLYGPSATTPLSWNTRVHIALDAAQGLEYLHLACRPNIIHRDVKSSNILLTDRMEAKVSDFGLSKLALQAEGVSHISTLVKGTAGYLDPEYYISQKLTVKSDVYSFGVVLLELVCGRPPISMPHLQAGNLQEIVDPDLRSDFSLESMWKVIEIAMTSVEPKENHRPNMQEVVQELREAAAIEQQRSAKIRTWPQK

SEQ ID NO: 67972 - protein, 302 aa, uncultured archaeon GZfos27B6
MNLISIFDLSQAEIEALIETAKELKRERKEGVRARNDLQGKTLAMIFEKPSTRTRVSFEVAMHELGGNVTSLNWNELQLGRGERIKETAKVFSAYVDAVMIRAFRHDTVEKFARHALIPVINGLSDLEHPCQTLADLMTIKEYKSKLAGVKVAWVGDGNNVCNSLIGGAAITGMDVSVACPAGYEPDEGTVEKAREMGCETLITGTAEKAAADADVLYTDVWVSMGDENESEKRKTDLKNYQLNEDLVRIAKEDVIMMHCMPVHIGEEITEGVMNSANSVIFEQAENRLHAQKALLLKLLKY

SEQ ID NO: 67973 - protein, 533 aa, Staphylococcus aureus subsp. aureus MW2
MLQVTDVSLRFGDRKLFEDVNIKFTEGNCYGLIGANGAGKSTFLKILSGELDSQTGHVSLGKNERLAVLKQDHYAYEDERVLDVVIKGHERLYEVMKEKDEIYMKPDFSDEDGIRAAELEGEFAEMNGWNAEADAANLLSGLGIDPTLHDKKMAELENNQKIKVLLAQSLFGEPDVLLLDEPTNGLDIPAISWLEDFLINFDNTVIVVSHDRHFLNNVCTHIADLDFGKIKVYVGNYDFWYQSSQLAQKMAQEQNKKKEEKMKELQDFIARFSANASKSKQATSRKKQLEKIELDDIQPSSRRYPFVKFTPEREIGNDLLIVQNLSKTIDGEKVLDNISFTMNPNDKAILIGDSEIAKTTLLKILAGEMEPDEGSYKWGVTTSLSYFPKDNSEFFEGVNMNLVDWLRQYAPEDEQTETFLRGFLGRMLFSGEEVKKKASVLSGGEKVRCMLSKMMLSSANVLLLDEPTNHLDLESITAVNDGLKSFKGSIIFTSYDFEFINTIANRVIDLNKQGGVSKEIPYEEYLQEIGVLK

SEQ ID NO: 67974 - protein, 533 aa, Helicobacter pylori J99
MLQTINLTQRYATKKLFENVNIKLDKNKRYGLIGANGAGKSTFLKILSKSIDCSSGEVIITSGMRMGVLGQDQYAFEDLSLKDAVLIGNRRLYDAIKEKERLYTEGDLSDDKVNARLGELETICVEEDPMYECEVVIEKILEDLGIPSSKHNDLMKTLPSSDKFKILLAQVLFPKPDILLLDEPTNNLDLNAIEWLENNLKRHEGTMVVISHDRHFLNAVCTHILDLDFHSVREFSGNYDDWYIASTLIAKQQEAERNKKLKEKEELEKFIARFSANASKAKQATSRQKQLDKLDIQSLAISSRRDPSIIFKPKRTIGNEALECENISKSYDDQIVLNQVSLKVMPKDKIALIGPNGVGKSTLCKILVEELKPDTGVVKWGATVLKGYFPQNVSEEISGEETLYQWLFNFNKKIESAEVRNALGRMLFNGEEQEKCVNALSGGEKHRMVLSKLMLEGGNFLVLDEPTNHLDLEAIIALGEALFKFDGALICVSHDRELIDAYANRIIELVPSPKGASIIDFKGSYEEYLASKK

SEQ ID NO: 67975 - protein, 830 aa, Magnaporthe grisea 70-15
MQRQNKIRPPKRSLRHETDEFDQQWDVLREALTDIHNRNSSRLLFEHLYRASYKIVLKKQGERLYTLVQEFEGKWFAEQVIPQLQAMIAPNLINVAVEAGTSAHERREMGDTFMKGLKEAWENHRMSMNMVADILMYLDKGFLKESRGTSIFVTTIGLFRDHLVNPNTVVGHDRTFSLFDILSTVILDHIDMEREGDVINRSLIHSCVKMLEDLYETDEEMDADRLYLVRFEPHLLEASRTFYRSEALKLLRNGDASIWIRQTHRRLLEEEDRCKTTLSTLSIEKMTRAVEAELISAHLNDFLALENNGLRQMLDDDRVEDLAILYQLVARVDPSKDLLKKGVLNRILALGAEIEKNLSTIDFSVAQGDAAENPAAEKPKSQALSQQAQQTAAAIKWVHDVLDLRAKFDVIWEKSFAQDPGLQTTMTKGFSDFIHQFGRSSEFVSLYIDENLKRGIRGKSDLEVTAILDRSIVMIRYLKDKDLFERYYQKHLGRRLLHSRASSEEAEKQLITMMQLELGKHFTSKFEGMFKDITISEELSTKYGEHIRSLGDVDVHHKPIDLAISVLTSNSWPPDVMGRPAQVGRGDGPPAVDCNYPPEIKRLQDSFFKFYLKDRSGRVLTWIGSAGSADIKCVFPPVKGMSGPLSRERRYELNVSTYGMVVLMLFNSLEDGETLSFEDIQAETSIPPKDLSRALASLSINPKARVLLKDPATKTIRPGDKFSFNAGFVSKAIKIKAPVINSQSKVEGDEERQRTEDKNDETRRHMIDAAIVRIMKSRKELAHNALLAEVIGQLVSRFQPDVAMIKTRIEDLIAREYLERLDDSGYKYMA

SEQ ID NO: 67976 - protein, 371 aa, Enterococcus faecalis V583
MALTAGIVGLPNVGKSTLFNAITKAGAEAANYPFATIDPNVGMVEVPDARLQRLTELVKPKKTVPTTFEFTDIAGIVKGASKGEGLGNQFLSHIRQVDAICHVVRCFDDENIMREQNRDADFVDPLADIDTINLELILADLDSINKRYTRVAKMAKAKDKEAVEELAVLDKIKPVLEEGLSARTIEFTPEEEKIVKSLFLLTTKPVLYVANVSEDEVADPDNNEYVQQVRNFATSENAEVIVVSARAEEEIAELDSEEDKAEFLEAMGIEQSGLDQLIRAAYDLLGLATYFTAGEQEVRAWTFRKGIKAPQAAGIIHSDFERGFIRAETVSYEDLDKYGNMQAAKEAGRVRLEGKDYVVQDGDVMLFRFNV

SEQ ID NO: 67977 - protein, 543 aa, Schizosaccharomyces pombe
MPAMKRKKLDMESSRWFPKGETCFQRWYRSFLPPEDGKPQKLKRTLTARHIQMIGIGGAIGTGVWVGSKNTLREGGAASVLICYSLVGSMVLMTVYSLGELAVAFPINGSFHTYGTRFIHPSWGFTLGWNYLASFLATYPLELITASICLQFWININSGIWITVFIALLCFVNMFGVRGYGEVEFFVSSLKVMAMVGFIICGIVIDCGGVRTDHRGYIGATIFRKNAFIHGFHGFCSVFSTAAFSYAGTEYIGIAASETKNPAKAFPKAVKQVFIRVSLFYILALFVVSLLISGRDERLTTLSATAASPFILALMDAKIRGLPHVLNAVILISVLTAANGITYTGSRTLHSMAEQGHAPKWFKYVDREGRPLLAMAFVLCFGALGYICESAQSDTVFDWLLSISNLATLFVWLSINVSYIIYRLAFKKQGKSYDEVGYHSPFGIYGACYGAFIIILVFITEFYVSIFPIGASPDAGAFFQSYLCFPVVVIVFIAHALITRQKFRKLSEIDLDTGFSKYDRLEESDKGPMTAKSLAKSVLSFCV

SEQ ID NO: 67978 - protein, 400 aa, Glycine max
MALLVMVKKKRGGGRKGLEEEEEDGFVPVLNLKVFSYKELQLATRGFSEKVGHGGFGTVFQGELSDASVVAVKRLERPGGGEKEFRAEVSTIGNIQHVNLVRLRGFCSENSHRLLVYEYMQNGALNVYLRKEGPCLSWDVRFRVAVGTAKGIAYLHEECRCCIIHCDIKPENILLDGDFTAKVSDFGLAKLIGRDFSRVLVTMRGTWGYVAPEWISGVAITTKADVYSYGMTLLELIGGRRNVEAPLSAGGGGGGGESGDEMGGKWFFPPWAAQRIIEGNVSDVMDKRLGNAYNIEEARRVALVAVWCIQDDEAMRPTMGMVVKMLEGLVEVSVPPPPKLLQALVTGDSFHGVKADSGNGASSTGGSLSDGDLEVSTADSESYTGNVFSPLDVNVNVSVR

SEQ ID NO: 67979 - protein, 142 aa, Arabidopsis thaliana
MSNYAAGLGKPGSGKRRIRDLLNQPDNRVCADCGASVPKWAKYQSIHLLKSCGVHRSLGTHILKVLSVTLDEWSDEEVDSMIETGGNASANSIYEAFVPDTCSKPGPDDGVILGADTRATEGPIVADKNCGKIHYMAPNIYC

SEQ ID NO: 67980 - protein, 209 aa, Methanothermobacter thermautotrophicus str. Delta H
MPLIGDKFPEMEVQTTHGPMELPDEFEGKWFILFSHPADFTPVCTTEFVAFQEVYPELRELDCELVGLSVDQVFSHIKWIEWIAENLDTEIEFPVIADTGRVADTLGLIHPARPTNTVRAVFVVDPEGIIRAILYYPQELGRNIPEIVRMIRAFRVIDAEGVAAPANWPDNQLIGDHVIVPPASDIETARKRKDEYECYDWWLCTQSRG

SEQ ID NO: 67981 - protein, 362 aa, Mycobacterium sp. MCS
MSQTVRGVISRSKQQPVEVVDIVVPDPGPGEVVVDIIACGVCHTDLTYREGGINDEYPFLLGHEAAGTVESVGEGVTNVVPGDFVILNWRAVCGQCRACKRGRPHLCFDTHNAAQKMTLTDGTELTPALGIGAFADKTLVHEGQCTKVDPAADPAVAGLLGCGVMAGIGAAINTGAVGRDDTVAVIGCGGVGDAAIAGAALVGAKKIIAVDTDDKKLQWAREFGATDTINARSVDDVVEAIQELTDGFGTDVVIDAVGRPETWKQAFYARDLAGTVVLVGVPTPDMRLEMPLVDFFSRGGSLKSSWYGDCLPERDFPTLISLYLQGRLPLDKFVSERIGLDGIEDAFHKMHAGEVLRSVVVL

SEQ ID NO: 67982 - protein, 300 aa, Corynebacterium diphtheriae NCTC 13129
MRIAYLGPEGTFTEAALWKFATRLGLESVDTIAATNPREAIAAVAAGQADYACVAIENSVDGPVTPTFDALATIDGVRIFHELDLPIAFAIMQRTGAPLRRFATHPVAYQQVKTWLAANAPAAEFVPASSNAEAARMAKENIVDFAAAPARAAEVYGLDIIADGVADVTGARTRFVLVGHADTPTARTGHDRTSVVFTLKNEPGSLVGALSEFAMRGVDLTRIESRPIEEGLGTYRFHVDINGHIDDLNVAEALRALYPRCNALKFIGSWPAISGQPVTAVDPTVAQAASAWVEAARNGA

SEQ ID NO: 67983 - protein, 495 aa, Catharanthus roseus
FFIFLFFVFLLINGRRKSTRTKTINLPPGPWKLPILGNLHNMMMGSVPHRLLRDLAKKHGDLMLLKLGEFNAIVVSSPRMAKEVLKTHDLSFLNRPIIQAPKILCYDNSDLVFSQYGDSWREMRKIFVLELLSTKRVRSFQPIRQDEGSRLVSLIKESVGKSIDLSEKINSYTTSMVARAAFGKVNDAGVTFLKLVKEASEVAGGFDPADIFPSYKFLNVFFNSRSKLLKIHGKTDMILEEMIDEHIKNHEMGKKANGENGKEDVIDILLSIKDSGELQFPFQMNNVKALIFDMFAAGTETSSSTVEWAMSELIRNPDVMAKAQNEVRQVLKGKQIVDESVLQELEYLKLIVKEVLRLHPSSPLLIPRECGEDCQIDGYDIPVKTRVFVNIWAIARDDKYWKDPESFIPERFENTCFDFTGNNFEYLPFGSGRRMCPGMTFGLANVDLVLALLLYHFNWKLPPGVNDIDMTERVGLGATKKHSLVLIPTLYDPSF

SEQ ID NO: 67984 - protein, 1119 aa, Arabidopsis thaliana
MGFQRSISSSSALKWLGFVTAVWVQSISGNNYTFSNYSGALKSLMNLNQLELNNLSVAKDVGKAFGILAGLASDRLPTPVILLIGCFEGLLGYGVQWLVVSRTIQPIPYWQMCIFLCMGGNSTTWMNTAVLVTCIRNFRRNRGPVSGILKGYVGLSTAIFTDLCTALFSNDPASFLVLLAVVPFAVCLTAVFFLREIPPASSAAEENEETRYFTIFNIVAVVVAVYLQSYDIIGIKTGVFSVAFASILLFLLASPIAIPFHSFIKSLNYGEQDDLEGRIQEPLLRSEIAAAEKEVIVVAAVAAEEEEKKRKKPVLGEDHTIMEAVLTVDFWVLFVSFLCGVGTGLAVMNNMGQIGLALGYTNVSIFVSMTSIWGFFGRILSGTLSEYFLKKAGTPRPLWNAASQILMAVGYILMALAVPNSLYIGSMVVGVCYGVRLAITVPTASELFGLKYYGLIYNILVLNLPLGSFLFSGLLAGFLYDAEATPTPGGGNTCVGAHCYRLIFIVMALASVIGVGLDLVLAYRTKEIYAKIHASKKSKKSGGFRVSSTTFYQCKACNFEVYMAASDQHRSRRHDESSSRPNKKKKVSRNPETNLLFNLNSCSKSKDLSAALALYDAAITSSEVRLSQQHFQTLLYLCSASITDISLQYLAIDRGFEIFDRMVSSGISPNEASVTSVARLAAAKGNGDYAFKVVKEFVSVGGVSIPRLRTYAPALLCFCEKLEAEKGYEVEEHMEAAGIALEEAEISALLKVSAATGRENKVYRYLHKLREYVGCVSEETLKIIEEWFCGEKAGEVGDNGIGSDVGMLREAVLNNGGGWHGHGWVGEGKWTVKKGNVSSTGRCLSCSEQLACVDTNEVETQKFVDSLVALAMDRKTKMNSCETNVVFSEFQDWLEKHGDYEAIVDGANIGLYQQNFVDGSFSLSQNPFLAILISHTCGIEQLESVMKELYRESGNNKWPLILLHKRRVKTLLENPTHRNLVEEWISNGVLYATPPGSNDDWYWLYAAAKLKCLLVTNDEMRDHIFELLGSTFFQKWKERHQVRYTFVKGNLKLEMPSPFSVVIQVCLPSQSFFSPVSIVSQLRFDKIRNQRKGHGISRSHAKTMKSLQELGCVLADKVF

SEQ ID NO: 67985 - protein, 430 aa, Catharanthus roseus
KLGGFNTIVASSPRMAKEVLKTHDLSFLNRPIIQATKILCYDNSALVFSQYGDSWRQMRKIFVLELLSTKRVRSFQPIRQDEGSRLVSLIKESVGKSIDLSEKIKLYTTSMVARAAFGKVNDAGVTFLKLVTEAAEVAEGFDPADMFPSYKFLNVFFNSRSNLLKIHGKTDMILEEMIDEHIKSHQMGKKANGENGEEDVIDILLSIKDSGDLGISHWMNNVKALIFDMFSAGTETSSATVEWAMTELMKNPSVMRKAQDEVRQAFKGKKTIDESDLEELKYLKLVVKEVLRLHPFAPLLVPRECREACQIDGYDIPVKTRVFVNVWAIGRDEKYWKDPESFIPERFEDNSLDFTGNNFEYLPFGCGRRICPGMTFGLANVHLVLALLLYHFNWKLPPGVNDIDMAERPGLGASKKHGLVLVPSFYQPSF

SEQ ID NO: 67986 - protein, 408 aa, Corynebacterium diphtheriae NCTC 13129
MGFVRSKQNVLAIVLAGGEGKRLFPLTEDRAKPAVPFGGTYRLIDFVLSNLVNAGYLKICVLTQYKSHSLDRHISQAWQFSGPTSQYIASVPAQQRLGKRWYMGSADAILQSLNLVYDERPDYVLVFGADHVYRMDPEQMVADHIASGKAVTVAGIRVPRSEASAFGCIQADENNNITEFLEKPADPPGTPDDPSMTFASMGNYVFSTDALIQALKEDENNPDSEHDMGGDIIPYFVSMGQANVYDFNKNVVPGSTDRDRAYWRDVGTVDAFYEAHMDLISVHPVFNLYNQQWPIRSTERGDLPPAKFVQGGIAQASMVAQGSIVSGSTVRNSVVSTDVVVEEGATVEGSVIMPGARIGKGAVVRHCILDKNVVVSDGQVIGVDRERDEQRFQISPGGVVVVGKNFVV

SEQ ID NO: 67987 - protein, 229 aa, Corynebacterium diphtheriae NCTC 13129
MAKASLDKKPLDVAKMFDGVGKNYDITNTVLSFGRDKKWREKTRERLQLKAGERVLDLAAGTAVSTVELTRSGAWVVACDFSQGMLAAGKDRNVPKVVGDGMKLPFADNSFDAVTISYGLRNVHDFRMALREMARVTKPGGRITIAEFSTPNLPGFKTIYKEYLTKLLPLIAKVVGTNPEAYEYLAESIRAWPEREELAAAINENGWHDAGWQNLSLGIVALHSAVKPS

SEQ ID NO: 67988 - protein, 204 aa, Magnetospirillum magnetotacticum MS-1
MTVFLVRHGQSEGNRDVVFSGLSDHPLTPLGRAQAAEAGRSLLGLRFAHVLTSCLSRAVETCDLLLAASGSEVGNRRRLERLNERNFGVFEGNADDSATLAADPIRRSVAYDVAYRPEGGESMLDCLERSVICFEADILPLAVDGHVLVVTHGNVVRSLALYHLGWPVDMLPEMPSRNCLITRIEPLGWVKPARTARWPGGSHP

SEQ ID NO: 67989 - protein, 482 aa, Xyris involucrata
  misc_feature (17)..(17): Xaa can be any naturally occurring amino acid
  misc_feature (20)..(20): Xaa can be any naturally occurring amino acid
  misc_feature (38)..(38): Xaa can be any naturally occurring amino acid
  misc_feature (41)..(41): Xaa can be any naturally occurring amino acid
  misc_feature (69)..(69): Xaa can be any naturally occurring amino acid
  misc_feature (87)..(87): Xaa can be any naturally occurring amino acid
  misc_feature (474)..(474): Xaa can be any naturally occurring amino acid
  misc_feature (477)..(477): Xaa can be any naturally occurring amino acid
KNIGRIAQIIGPVLDVXFPXGKMPNIYNALIVKGRDTXGQXINVTCEVQQLLGNNRVRAVAMSATDGLXRGMEVIDTGAPLSVPVGXVTLGRIFNVLGEPVDNLGPVDTSTTSPIHRSAPTFIELETRLEIFETGIKVVDLLAPYRRGGKIGLFGGAGVGKTVLIMELINNIAKAHGGVSVFGGVGERTREGNDLYVEMKESGVINEKNLTESKVALVYGQMNEPPGARMRVGLTALTMAEYFRDVNKQNVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPRIVGTEHYETAQRVKETLQRYKELQDIIAILGLDELSEEDRLTVARARKIERFLSQPFFVAEVFTGSPGKYVGLAETIRGFQLILSGELDGLPEQAFYLVGNIDEATAKAINLXIEXWRVIS

SEQ ID NO: 67990 - protein, 295 aa, Burkholderia mallei ATCC 23344
MLKVTKAVFPVAGLGTRFLPATKASPKEMLPVVDKPLIQYAVEEAINAGITEMIFVTGRSKRAIEDHFDKSFEIESELEARGKEKLLELVRGIKPSHVDCFYVRQPAALGLGHAVLCAEKLVHGEPFAVILADDLLHGDQPVLKQLVDVFNHYHSSVIGVETIEREDSRSYGIVEGREWEEDIIKLSGIIEKPAPEHAPSNLGVVGRYVLMPSIFEHLRKIKPGAGGELQLTDAVQSLLTEEQVLAYRYYGTRFDCGSKLGYLKATVELALRHPEVGREFEAYLRNCLPALAAVA

SEQ ID NO: 67991 - protein, 401 aa, Staphylococcus aureus subsp. aureus MW2
MVTRSVLKYGGSSVSDFTKIKRIAEMLKERVNQDEQLIVVVSAMGNTTDQLMTNVSTLTKAPKQQELALLLTTGEQQTVSYLSMVLNDIGVNAKAMTGYQAGIKTIGHHLKSKIAQINPQTFEQAFQENDILVVAGFQGINEHQELTTLGRGGSDTTAVALAVSNQIPCEIYTDVDGVYATDPRLLPKAKRLDIVSYEEMMEMSALGAGVLETRSVELAKNYNIPLYLGKTLSNVKGTWIMSNEEILEKKAVAGVALDKHMMHVTISYPLPDNQLLTQLFTELEEGAVNVDMISQIVNLDGLQLSFTIKDSDFHQISMILETLKNQYEALAYKINEHYVKISLIGSGMRDMSGVASKAFLTLIENNIPFYQTTTSEISISYVIDDFNGQQAVEKLYDAFNI

SEQ ID NO: 67992 - protein, 625 aa, Mesorhizobium sp. BNC1
MLNINDLSLRVAGRLLIEQASLTLPAGTKAGLVGRNGTGKTTLFRAITGELSPETGSISLPKGTRIGQVAQEAPGTEEPLIDIVLKADTERDRLMREAETAEDPHRIAEIQTRLADIDAHSAEARAAAILAGLGFGPAAQKRPASSFSGGWRMRVALAAVLFAEPDLLLLDEPTNYLDLEGTLWLEGYLAKYPYTVLLISHDRDLLNHAVNNIVHLEGKKLTFWRGGYDQFARQYAEKAELQEKMRTKQEAQKKHMEAFVERFRAKASKARQAQSRLKALERMKPIAATVNENVRPFRFPNPVKTVASPIVAIDSGAVGYEPGRPILKNLTLRIDNDDRIALLGSNGNGKSTFAKLIAGRLKLESGTMTLAPGLKVSIFAQHQLDDLRPEENAHQHVRRLMPDAPEAKVRARVAQFGLSTEKMDTPAKELSGGEKARLLMGLASFEAPHLFILDEPTNHLDIDSREALVEALNEFEGAVILISHDRHLIEACADRLWLVNHGTVQPYDGDMEDYRALTTGGGSRNRERREADKASKADRRREAAKRRAALEPLAKEIKATEGLIERTRKRIEAIEAQMADPGLYARDPGKISTLGKERADLAQALARQEEKWLELSTEYEEGVAE

SEQ ID NO: 67993 - protein, 338 aa, Saccharomyces cerevisiae
MSTTASTPSSLRHLISIKDLSDEEFRILVQRAQHFKNVFKANKTNDFQSNHLKLLGRTIALIFTKRSTRTRISTEGAATFFGAQPMFLGKEDIQLGVNESFYDTTKVVSSMVSCIFARVNKHEDILAFCKDSSVPIINSLCDKFHPLQAICDLLTIIENFNISLDEVNKGINSKLKMAWIGDANNVINDMCIACLKFGISVSISTPPGIEMDSDIVDEAKKVAERNGATFELTHDSLKASTNANILVTDTFVSMGEEFAKQAKLKQFKGFQINQELVSVADPNYKFMHCLPRHQEEVSDDVFYGEHSIVFEEAENRLYAAMSAIDIFVNNKGNFKDLK

SEQ ID NO: 67994 - protein, 329 aa, Helicobacter pylori J99
MRYIDDGLENQTILITGGAGFVGSNLAFYFQENHPKAKVVVLDKFRSNTLSSNNRPSSLGHFKNLIGFKGEVIIADINNPLDLRRLEKLHFDYLFHQAAVSDTTMLNQELVMKTNYQAFLNLLEIARSKKAKVIYASSAGVYGNTKAPNIVGSNESPENVYGFSKLCMDEFVLSHSSDNVVGLRYFNVYGSREFYKEKTASMVLQLALSAMAFKEVKLFEFGEQLRDFVYIEDVIQANVKAMKAQKSGVYNVGYSQARSYNEIVSILKEHLGDFKVSYIKNPYTFFQKHTQAHIEPTILDLDYTPLYDLESGIKDYLPHIHAIFKEQHA

SEQ ID NO: 67995 - protein, 413 aa, Chlamydomonas reinhardtii
MHAQDEVSGAVQSQDTTQLRLAALFIILIAGLCGALPPLFMKAFRNHDGLASQLSRSLAAGVILALALVHIIPEAIEDMSGLGGMTYPLGGLCVLGGVALMLLLEHLSQILHNSQAAVAAAAGTGGCGHSHGSSSRGRDSGLVNDHRRRAGTAHLAGDPKHQGHGAHAHAKHTLPPHHPGAHGHTAEQQHKPHAQQHPASYEQLPPQHQHTCVTYGNAPSLLTIAVGNGGEAAVGGDAAAAGGLGGGSLRLRLLAYMFELGCVFHSLIIGVAVGVITEDVAQVRALLIALSFHQWLEGLGLGSVIARGGFSTLKAAAMAGFYSLTCPAGVAAGMALARLYDPESEVARGVQGTLDGVSGGMLLYISLVQLVAEDMGRFVPAGGEGGAGAGRRLMSFAALCGGAGAMCLLAVWT

SEQ ID NO: 67996 - protein, 116 aa, Brassica napus
  misc_feature (21)..(21): Xaa can be any naturally occurring amino acid
  misc_feature (78)..(78): Xaa can be any naturally occurring amino acid
  misc_feature (81)..(81): Xaa can be any naturally occurring amino acid
  misc_feature (108)..(108): Xaa can be any naturally occurring amino acid
  misc_feature (115)..(115): Xaa can be any naturally occurring amino acid
MASSMLSSAAVVTSPAQATMXAPFTGLKSSAAFPVTRKANNDITSIASNGGRVSCMKVWPPVGKKKFETLSYLPDLTXVEXGVKEVDYLLRNKWNFLCVEFELEHGFXVYREHGXH

SEQ ID NO: 67997 - protein, 323 aa, Chlamydomonas reinhardtii
MSLLRAGRVVLDALVFRDQEGMLTRLVRSFSAGVILALALVHIIPEAVEEMAGLGGIEYPLGGTCVLFGVALMVFLEHLAHIMHGPHSHAPAADSAAAAFTALPSSCTDIEAGATPCGAAKRATAQTSSNCEADPSGVLASDSSVPMNTSPAATQAASGSLRLKILAYMFELGCVFHSFIIGISLGVNTTDLVEVRALLIALSFHQFLEGVSLASVVLRGGFSTLKGAIMILTYSLTCPVGIAVGMAIASSYDAESERARGVQGTLNGVSGGMLMYISLVQLVAEDMGRFVPGSPSGGASARLLSFLALFLGAGSMCILAVWS

SEQ ID NO: 67998 - protein, 476 aa, Sulfolobus tokodaii str. 7
MSSYEDLLKVLDSRKVTRLYWIITILAAIGGFLFGYDTAVIGTAAEFAPYHYSGFLLGYEIASASLGAAIGAIIAYFYTDRYGRKSLLILDAGIYTAAAVLSALTINGIMLLVMRTIIGIAIGADSAVATAYITEYAPKDKRGSLAIMQQWMITIGILGSYLVGSAILYFLPSLAYVFDWRLILGLAAVPALIGLIFRFMMPESPRWLIYTGQFDKLKRELAKFGISVSDDVLERTRTEIQSEMSIKLDTAAKKALLLVGLWLVFQQITGINVPFYYGPILLSKLHIFSSTTNPVYSAIDGVLESTILAVINVAATYIAFRYIDKIGRRTLGISAYIGMAIFDLIGGISTLFGFDIGLLISFAGFIIFFAYGVGGTGWLIQAEYFDTRIRGRMAAIGALIDWLANFALIEVFPVMLSTVGLGGSMFIFFILDLVALVFVYFFIPETKGMSLEDVVKMFSSVPISKIKNGREIVLSK

SEQ ID NO: 67999 - protein, 257 aa, Mannheimia succiniciproducens MBEL55E
MKPLVIKLGGVLLDTPAAMENLFTALADYQQNFARPLLIVHGGGCLVDDLMKRLNLPVQKKNGLRVTPADQIDIIVGALAGIANKTLVAQAAKFKLNPVGLCLADGNLTQATQFDPELGHVAMVVAKNPALLNNLLGDAFLPIISSIAVDDNGLLMNVNADQAATAIAALINADLVMLSDVDGVLDANKQRLTELNSAQIEQLIEDKVITDGMIVKVNAALDAAKILNCGVDIANWKYPEKLTALFAGEIIGTRINP

SEQ ID NO: 68000 - protein, 195 aa, Prochlorococcus marinus str. MIT 9215
MANLNQPPSRVTPNLLHILNAFTDSSNTIINTIVELNSNTINKYELITETGHLKLDRVGYSSLAYPFAYGCIPRTWDEDGDPLDVEIVSVTEPLIPGSIVEARIIGVMKFDDGGEVDDKVIAVLADDKRMDHISSYEDLGEHWLKETKYYWEHYKDLKKPGTCTVNGFFGIEEAIKVIKDCEDRYKKEIDPKLVN

SEQ ID NO: 68001 - protein, 263 aa, Nocardia farcinica IFM 10152
MDWYTGNTGYDTVLTIGFAFAAFVIVGGLFAQSPYGRFAPASLGFNLSPKLGWWLMELPATVVFAVFFLTGPDRFEPVPLVLAGIWLLHYANRGWFFPLAIRQVPDKRSTFNVSVLAAGMFVTTLHGYLNGAFFSHDYKHQYGTEWLTDPRFLIGLAGYLCGFALLVRSESIVRNLRDKRDPGAAEYRIPYGGGFRFVSSPAYLGELIAWAGFALLTWSLAGVVIFLITAGNLVPRAFATHRWYREKFADYPRNRKALIPFVI

SEQ ID NO: 68002 - protein, 283 aa, Prochlorococcus marinus str. MIT 9215
MNDSQRVSILSEALPYIQSFSGRKIVIKYGGSVMENDNLKNAFFRDIALLSTVGVCPIVIHGGGPEINNWLKKLEISPKFENGLRITDQKTMEIVEMVLMGRVNKQIVKGINKTGSLAVGISGLDGNLIQSRELGDGSHGLVGEVTKINPEILDPLISKGYIPIISSIGSTLEGISHNINADFVAGEIAAAINAEKLILLTDTQGILKEKDNKNSLVEKTNLKEARDFIDKKIVTEGMIPKTECCIRALAQGVKAAHIIDGRIEHSLLLEIFTNSGIGTMIVA

SEQ ID NO: 68003 - protein, 89 aa, Zea mays
MAGTIQSVMARQIFDSRGNPTVDVDEYCSDGTFARAAAPTGALTGVYEALELRDGGSDYQGKGLYNAVNNVNGDIGPVLIDKDPTAHTE

SEQ ID NO: 68004 - protein, 449 aa, Clostridium difficile 630
MEKAKKLGLFSMILLGINSIIGSGIFLLPGKVYNLAGQNSMFIYIFATLLVLSILLCFAEVGSMFDKNGGAYLYSKKAFGDFIGFEVGTMSWVIRIISWSTLAVGFATALGSFWPESATEYKGYIAAILVTLLSINSLFGIKSTKIMNNVITIAKLVPLIVFVIVGIFFIKFVNIVPSGNVVNSSMGPAIILVFYAFTGFESFIVASGEMENPKKNLPVALITTIFICAIIYILIQIVCMGILGDRLFENSIPIADASSVFVGNYGKVFISVATLISIFGINIGSSIVTPKCGSSLAEEGSLPAFIGKTNKYGAPYVAIIISLICCIPLVLTGSFEQLAVMSVIARFAQYIPTCLSVIVLRKRTDVKASFKIPFGPVIPIVAILGSLWLLQQAWAEDISKPITQNRVLIGLGAMLLIAPLYIFMKKNKEIEHKNKSEDSKLYISREKIQ

SEQ ID NO: 68005 - protein, 626 aa, Chlamydomonas reinhardtii
MAHSWSRWVWEVASGKCLFSIAHKQVAKDNWPVLHWAPHDSAFVYMVTNTVHVYSRNDNFATYRKVTIKGIGGLALSPVAAPGGGLPQLAAFLPEAKGTPAGAGLYGLEGSPEPTATVRKSFFRSQGAQLMWNSLGTACLVLSYADYDATNQSYYGEQKLHYLPADPAKAEDAVTVPLPKEGPVHDVQWSPAGDYFIAVAGFMPAKVTLFNALCKPVYDLGSGPYNLVRWNPFGRFFAICGFGNLPGDIMLFDKKTSGSCKQMGAVRSPAVSAEWSPCGRLLLTATTAPRLRVDNNVKVFTYYGEQKAHVPFATLLDAAWRPVAKDTYQDRPQSPERLSAAAKGEVATSAPTKPSYVPPHLRAAGVTSTAAVSSGAKFSLARDDDDRPGKIGAAGGRRTVLPPGAEFIAGGGNAKAASKNAKRRAKKKAGEASGEGDEGEEAGGAEGAEAATAALASSSLQDLDTPIADLEQALKRAVTKEDFKSAARLRDAIQQKQSISKLAVEDANRRFYDAFMSGRVEEMDKIVGLGEHVQVVHPGSATIAGRAQVMDSWRAIMRNVRPGAFKVVLEDVRVYAREDFGYVTCVEIIDADDSAGRIIATNLFEKQDGAWRIVQHHGSPAAGRFR

SEQ ID NO: 68006 - protein, 213 aa, Magnetospirillum magnetotacticum MS-1
MTVKIAPSILSADFARLGEEVKAIDEAGCDWVHIDVMDGHFVPNLTFGPAIIKAIRPYTTKVFDVHLMIDPAQPYIEDYAKAGADIIVVHAEADKHLDRSLQLIRSLGKKAGVSLNPATPESVIEYVMDKLDLVLVMSVNPGFGGQSFIEAQLDKITRIKKMIGHRMIDLEVDGGVTADNAHRVAAAGANVLVAGSAVFKTKDYAANIAALRR

SEQ ID NO: 68007 - protein, 691 aa, Andrographis paniculata
MASVATWDRSASSPYLQEQSGKEKVKWNFASLAERGEYFSEKPPTPLLDTIDYPIHMKNLSTKELKQLADEPRSDVIFNVSKTGGHLGSSLGVIELTVAIHYVFNAPQDRILWDVGHQSYPHKILTGRRNMMPTLRQTDGLCGFTKRSESNYDCFGAGHSSTTISAGLGMAVGRDLQGRKNHVVAVIGDGAMIAGQAYEAMNNAGYLDSDMIVILNDNKQVSLPTANLDGPIPPVGALSSALSRLQSNRPLRELREVAKGVTKQIGGSMHELAAKVDEYARGLISGSGSTLFEELGLYYIGPVDGHNIDDLTAILKEVKSTKTTGPVSIHVVTEKGRGYSYAEKAADKYHGVAKFDPATGKQFKSSTPTQAYTTYFAEALIAEAEQDNIIVAIHAAMGGGTGLNLFDRRFPTRCFDVGIAEQHAVTFAAGLACEGLKPFCAIYSSFLQRAYDQVVHDVDLQKLPVRFAMDRAGLVGADGPTHCGAFDITYMACLPNMVVMAPADEAELFHMVATAAAIDDRPSCFRYPRGNGIGVELPPGNKGIPLEIGKGRILLEGERVALLGYGTAVQSCMTAAALMEPHGLQLTVADARFCKPLDQGLIRRLANSHEVLITVEEGAVGGFAAHVAQFMALDGLLDGKLKWRPLVLPDRYIDHGSPADQLMEAGLTSHHIAATVFNILGKAREALQIMS

SEQ ID NO: 68008 - protein, 424 aa, Novosphingobium aromaticivorans DSM 12444
MAQDIVARARQLIEDRIISRAALARAAGLHPNTLRDALSPDWNPTVDTLTKLERAMDDSEDDDFALASVEEIIAEVRNGRMVVLVDDEDRENEGDLLIPAQMATPETINFMATHGRGLICLCLTSDRASNLGLELMSRHNGTRHGTAFTVSIEAREGVDTGISAADRARTIAVAVDATKTRDDLVTPGHVFPLIARDGGVLVRAGHTEAAVDLPRLAGLNPSGVICEIMNDDGTMARLDDLIPFARKHGLKIGTIRDLIEYRRRHDHLVECANQAPFHTDYGGEWTIKTYRNKVDGSAHLVLQKGAVVPGKPTLVRMHAISVLSDVLGQPGPRKRILQRAMTAIGEAGSGVIVLLMPTDPQQLMNEVAGTAGHDMELRSYGIGAQILADLGVHDMVLLTNSHHNLVALEGYGLSIVGEQAIPEA

SEQ ID NO: 68009 - protein, 451 aa, Geobacter metallireducens GS-15
MEFKEFNLHPQVMAGVTAAGYTTPTPIQAQAIPTVMEGRDVMGLAQTGTGKTAAFALPILHRLAQGERGRVRALVIAPTRELAEQINDSFVTLGRQTRLRSVTVYGGVNVNPQIQKLKAGAEIVVACPGRLLDHMAQGTIDLSHLEVLVLDEADQMFDMGFLPDLRRILKQLPPKRQTLLFSATMPIDIRVLAQEILRDPVTVQVGTVAPAVTVTHALYPVEQHLKTPLLLELLRHTDTESVLIFTRTKHRAKRLGEQMEKAGYKAASLQGNLSQNRRQAALDGFRDGTFQILVATDIAARGIDVSQVSHVINYDIPDTAEAYIHRIGRTGRAARSGDAFTMVTSEDTAMVRTIERKLNTSLERRTMAGFDYSVPAPKKDTEFARPPRQPMPSRRPTEAKKGGARQGASHQPGSAKPAEGRRSQPQAAKANPARTAGTGGQRTGQQRRQPR

SEQ ID NO: 68010 - protein, 519 aa, Oryza sativa
  misc_feature (242)..(242): Xaa can be any naturally occurring amino acid
MAAAAATSPARAAAWTFAAATCVKLLLVPTYRSTDFDVHRYWLALTHALPARRWYTDASSQWTLDYPPFFAYFSRLLALPAPLVDASLVSLPVPDAPPSFAYLLYLRLTVAFSDLLLLLSSVLLLATDALTRRRRRPFLSLALVLWSPALLAVDHVHFQYNGFLMGLLLLSLHFLEQGRDLAGGVVFAALLCSKHLFLVAAPVYFVYLFRHYCCGRGVVRGLGRLVLMGAGVAAVFAAAFVXPFLYYGQMQQLFNRLFPFGRGLCHAYWAPNFWVFYILLDKIFAFLLRRLGFNIQIPEASFTGGLVGNSSPFAVLPKVTPITTFLLVILAMSPCLMKAFSKPQPRHIIRWVSYATTCGFMFGWHVHEKASLHFTIPLALIAMDSLEDAKHYFVLSIVSCYSLFPLLFENQEYPIKVMLLLTYATLMWVGFSSHFAAKSPQEGKKVNESGSVVRKNSFIGWISFSYLLGIVAIELWSQVFHHYVFGSRFPFLPLIMVSLYCGVGMMYSWMWQLAWIVRH

SEQ ID NO: 68011 - protein, 245 aa, Xylella fastidiosa 9a5c
METATVTRVNSTQPANACAPSHIPIIINNPMSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKLPLPIEVIPMARSLVARQIMARTDGQPVWREGVITDNGNVILDVHHLRITDPVKLEQELNQIPGVVCVGLFARRCADLVIIGSEPPHIL

SEQ ID NO: 68012 - protein, 78 aa, Mesorhizobium sp. BNC1
MSDTAERVKKIVVEHLGVDADKVTEQASFIDDLGADSLDTVELVMAFEEEFGVEIPDDAAETILTVGDAVKYIEKATA

SEQ ID NO: 68013 - protein, 426 aa, Neisseria meningitidis FAM18
MENSLKEAALKFHELPVPGKISVTPTKSLATDKDLALAYSPGVAAPCMEIHADPQNAYKYTAKGNLVAVISNGTAVLGLGDIGALAGKPVMEGKGVLFKKFAGVDVFDIEIDEKDPQKLVDIIAALEPTFGGINLEDIKAPECFYIERELRKRCKIPVFHDDQHGTAIITAAAVLNALRFTGRKIEEATLVCSGAGAAAIACLNQLLDLGLKRENVTVCDSKGVIYKTREDKDRMDESKQFYAIEDNGQRVLADAVKGKDIFLGLSGANLLTPEMLNTMNEKPIVFAMANPNPEILPPLAKETRPDVVIGTGRSDFPNQVNNVLCFPFIFRGALDVGATTINEEMKRACVYALADLAMEEVTEEVVAAYGKKFEFGAEYLIPTPFDSRLLPRVATAAAKAAMESGVATRPIADLEAYAAKLSEWKL

SEQ ID NO: 68014 - protein, 360 aa, uncultured archaeon GZfos27B6
MQELYRINIVTREMKSHNRSSELGSIGGAYAAIFEDAYKRNLEGRGPDTLYKPIIDLLGRGGKRLRPSLCLMACELVGGEIKKALPTAICIEFFHNFSLAHDDIEDDSKLRRGEPALHVKYGIPIAVNAGDGLYALSYEALKANRNLLGLERAWKIFEEIAELCVVLSEGQAMDLEFKERKEMGELEVIETLRKKTAKLFGVSAKCGAIAGGASHETAEDLSSAWEDIGIAFQIRDDILNVLGEEEKYGKRIGEDIAEGKPTLLLVNCLEHCEAREKENIYECFHNYDKAKIEEVVDLFRKYGSIEHSEEIAMRYLRSGTDKIGKIDIRGKGKGEIEGKSREEIREYMVALAKYFVERER

SEQ ID NO: 68015 - protein, 466 aa, Magnaporthe grisea 70-15
MAADFSHISSRMRDTVELITPLIDEALATKSHCIDLATAENWLLRSELRQMYSASIAGHMEEKASILGDEDLRASLAEFFGAYFRPRVDVTSSHIVATPGATHCMDALLTSICDSGDSVLVPVPYWNGFGLHFRLRPRVNIIPVIPEWTAGRLDENPQPLGEGLLPALKQAMAGVADKAKVKALVMTNPNNPLGQCYPEGVLQEALDFCREAGLHYISDELYALSQLGAGGGFVSALSLDARGRGTNGDLGAADQARGVASDSDATTAASCNDKKQTPDATQYSASTKRDKCDNKQQEALVHVIWSTSKDMCSSGVRIAALVSQSREAKPILTSVGLLSSMHVSSLSSLATTLLLRSPALPGLVAALSRRLARAHAIAHARFRRWGVPFLPADAGPFVLVRLGSRAARQDIMARLRLAHVTVAEGKSFGGGWCDGDGGFWVRLTVAVPPPMLWDGLNQIGFALGHS

SEQ ID NO: 68016 - protein, 243 aa, Zea mays
MESKCVNDQDTLIDLESGNGTAVINHSNDLESGCVCACANGCPRDDRNNQHMDCSSPASDAVARSGDDRKSEGEEKLGLGLLDSSGGDKAKKKRSKKKPPRPPRPLTPTPLDVSDQKLLNELSELAVLKRARVERMKALKKMKNAKQGFSGGNLCPLIVTVIFCVVILWQGFFSGHGPAVSFHGSPESSIRGTRSSLISIRFYKNHSNTRPPPFSETTAAPDNVVETGPRLRNRNQARRLLAR

SEQ ID NO: 68017 - protein, 456 aa, Oryza sativa Indica Group
MARGAPLVGVLPSLLAKGPVAFIRHHYEKMGSVFTVSLLQQKVTFLVGSEAASHFYKGLDSEISQDEVSQFTIPTFGPGVAFDVDYATRHEQFRFFGDIMKPAKLRTYVDLMVAEVEGYFARWGQSGTVNMKQEFEQLVTLIASRCLLGEEVRDKMFDEVSTLLRELNDGMRLVTILFPRLPIPAHRRRDRARARLGEIFSDIVRSRRGSSVGGGGGAPHDDMLQCLIDARYKDGRATTETEVAGMLVAALFAGQHTSSSTSTWTGARLLTNPDHLRAAVEEQARLLRRHGGDRVDHAALAAMDTLQRCVKETLRLHPPALMLLRHARRSFVVHSEDSGGGEREYEVPEGHTMASPLLLHNALPRVYRDPGEFDPGRFGAGREEGAGGLAYTAFGGGRHACVGEAFAYMQIKVIWSHLLRNFELQLVSPFPETDWTVVMPGPKGKVMVTYKRRKLT

SEQ ID NO: 68018 - protein, 390 aa, Enterococcus faecalis V583
MLEEVLAIHQKNIGVLSLEATEAVLNHHDLAKMYTPGVAELSLMIAQNHELAREWTISGKLIAVITDGSAVLGLGNMGTQAGLPIVEGKALLYKNLAGVDAIPLALEQKSVDEMVQTIENLQNSFAGIHLEDISAPKCFEIEEKLQQRLNIPVYHDDQEGTAIVVLAGLINAAKIKGKPLNELRVVINGVGASGVATAKLCIQAGITHLTLVDRQGVLREEDPTLNPYQRALLRQVIKPSVENKDLATAVVNQDVFLGLSEADVLTPALIKSMNQDPIIFALANPKPEIEPALAQANGVRLLATGSSKYPNQVNNILVFPGLFKGLLAAKGRKVDVGLQMTVARSLAAMISEPTVEKFIPNVFDGGVVDTVFNAVLDYIKQEKTTAEEGT

SEQ ID NO: 68019 - protein, 486 aa, Oceanobacillus iheyensis HTE831
MISSETKHMQNYINGKWVDAKSGKQEVIPNPATGETIATVTISDVEDVDMAVAAAKEVFPEWSDIPVPNRTRYLLDYWKLLQDNKEELAKIITLENGKSLRDAQGEVQRGIEVVELATSTPSMMMGDALPSIAKGIDGSIWRYPLGVVAGITPFNFPMMVPLWMFPLAIACGNTFVLKTSERTPILAERLVELFYEAGFPKGVLNLVHGGKEVVNRFLTHPDIEAVSFVGSEPVAKHVYQTGTAHGKRVQALAGAKNHAVVMPDCDVEKTIQGVLGAAFGSSGERCMACSVVAVVDDIADEFLEKLVKETKKLRVGDGMDDSNFIGPVIRESHKERVLSYIDSGVDEGAHLLVDGRKIKEETPDGYYVGATIFDHVTQDMKIWQDEIFAPVLSVVRVSDLEEGIRVTNQSKFANGAVIYTNSGKSAQQFRNRIDAGMIGVNVNVPAPMAFFSFAGNKASFYGDLGTNGKDGVQFYTRKKVVTERWF

SEQ ID NO: 68020 - protein, 184 aa, Prochlorococcus marinus str. MIT 9215
MDLSSIPPSPMKGTVNIVVEIPAGSRNKYEYCSDAGIMALDRVLHSSVRYPFDYGFIPNTLADDGAPLDAMVIMDEPTFAGCLIKARPIGVLDMYDCGEYDGKLLCVPIANPRQANIVSINQIAPNQLEDVAEFFRTSKGLDGRTVQINGWRDFDVVENLLKSCIPLKKKNFKVLKKSNISNLN

SEQ ID NO: 68021 - protein, 267 aa, Shewanella sp. MR-4
MHPMLTIAVRAARAAGQTIMRAYTELDRVEVSAKGVNDFVTSVDKEAEAAITYQIRKSYPDHTIVGEEKGENRGENKDYVWIVDPLDGTNNFVRGIPHFAVSIALQHKGKTEVAVVYDPVREELFTAIRGKGAKLNDFRIRVTNVTELAPTIIGTGFPFKARQHTESYMAIFGEVFGQCSDLRRAGSAALDLAYVAAGRLDGFFEIGLKPWDIAAGDLICREAGGTVTDFTGGHNYLISGNIVAGSPKVTTELVKTMRPLLNEGLKR

SEQ ID NO: 68022 - protein, 637 aa, Clostridium difficile 630
MIVLSCNNLNKSFGIDSILENISFTVNEGDKIGIIGVNGTGKTTLFKIISGIYGYDSGDIYTSKDCEIGYLEQNTNFYSDNTILEEVLEVFKNLIEMESYLRELEVKISEESTKTNSPIIEKIMDEYSHKLELFSDLNGYGYKSEAKGVLKGLGFSDNDMDKPISILSGGEKTRVLLGKLLLKKPTLLLLDEPTNHLDSEAIEWLEVFLKQYKGTVMLISHDRYFLDQSVNRIFEVHNKKLKVYNGNYSKFVELSKIEKELELKKFEDQQKEIKKQEESIERLKAYGREKHLKRARSKEKALDKVDVLDKPEAYRKKARIQFTPSVQSGNDVLQIRDVSMGYGERILFKDLDLDIYRGEKVALIGANGVGKSTLFKIITNELQPLSGNIKFGTNVHVSYFHQEQKTLNLDNTIIDEIWENNTHLTQTTLRNMLGAFLFVDEEVFKKISTLSGGERARVAILKLILSNANLLLLDEPTNHLDIDSKEVLEEALTNYDGTIFTISHDRYFLNTVVDKILVLDENGITEYLGNYDYYIDKKRQIQEMSIIEEKEEKTRTQIKDEKRKEREQREIEKKNRIKRQNIEKEIEKLEIEIEKLDILLCQEEVYSNPDKAKEVSQEKINLENNLASLYDEWEEFM

SEQ ID NO: 68023 - protein, 273 aa, Shewanella sp. MR-4
MGVIARLKEDIESIYHRDPAARGAFEILVNYPGMHAIWLHRISHKLWKRDWRLMARCLSTFSRWLTGVEIHPGATIGDRFFIDHGMGVVIGETAEIGDDCTLYHGVTLGGTTWQAGKRHPTLGNNVVVGAGAKILGPITMHDGARVGSNSVVVKDVPKDTTVVGIPGRVVATPSPQSKEKSERRSAMAKKYGFDAYAVSPDNPDPVANAIGQMLDHMHLMDSKVQELCQAIQRLGGDVCTERLPELNVGEFNDAEKAAADKRQSALDEFDPSI

SEQ ID NO: 68024 - protein, 134 aa, Brassica napus
MSIFRNSECRFIDRVMTRSDDSAEIHDMKARSGNEMKKTLTWWDLMWFGVGAVIGSGIFVLTGQEARERSGPAVVLSFVVSGVSAMLSVFCYTEFAVEIPVAGKRIFIFLSTENNHQNILKTRLKLSYISLFCL

SEQ ID NO: 68025 - protein, 303 aa, Aeromonas hydrophila
MKKTPLVVRKAVLPVAGLGTRMLPATKAIPKEMLPVVDKPLIQYVVREAIAAGIKEIILVTHSSKNSIENHFDKSFELEATLEKRVKRQLLEEVQHICPKDVTIMHVRQGEAKGLGHAVLCARPLIGDNPFAVLLPDVLIDEVASNLKQDNLAEMVHMFEEDHISQIMVEAVPESEVDKYGIADIKGEALSEGMSLPMQAIVEKPPRDEAPSNLAVVGRYVLSSNIWPLLEKTPAGAGDEIQLTDAIAMLMEQEQVNAYFMKGRSHDCGSKMGYMKANVEYAVRHPELNGEFIAWLKQFVKQL

SEQ ID NO: 68026 - protein, 385 aa, Triticum aestivum
IRHEALQMGEYVSNVSHGIDTFSIREPLGVCAGICPFNFPAMIPLWMFPIAVTCGNTFVLKPSEKDPGAAMMLAELAMEAGLPKGVLNIVHGTHDVVNNICDDEAIKAVSFVGSNTAGMHIYSRASASGKRVQCNMGAKNHAIILPDADRDATLNALIAAGFGAAGQRCMALSTAVFVGGSEPWEDELVKRASSLVVNTGTANDADLGPVISRQAKDRICKLVQSGADSGARLVLDGREIVVPQFEDGNFIGPTVLADVKSDMECYQEEIFGPVLLLMKAESLDDAIQIVNRNKYGNGASIFTTSGVSARKFQTDIEAGQVGINVPIPVPLPFFSFTGSKASFAGDLNFYGKAGVQFFTQIKTITQQWKESSPQRVSLSMPTSQK

SEQ ID NO: 68027 - protein, 278 aa, Robiginitalea biformata HTCC2501
MSTITDIQGTFELNNGVQMPYLGLGVYQAEEGGEVERAVQWALEAGYRHIDTARAYGNEAGVGKALRESGVDREEVFVTSKVWNSDQGYESTLKAFDSTMDDLGLDYLDLYLVHWPVEGKYKDTWRALEHLYDTGRVRAIGVSNFLQHHLEDLLADAEVIPAVDQLEFHPYLVQQPLQDYCQAKKIQYEAWSPLMQGEIFKLPEMEAMADSYGKSIAQVVLRWDLQKGVVTIPKSSKKERIRANADLFDFELSEEDVAKLDAMDRGHRFGPDPDNFDF

SEQ ID NO: 68028 - protein, 487 aa, Geobacillus kaustophilus HTA426
MSSVTETKTLKNFIGGQWVASTSGKEEVVPNPATGEVLAKVPLSSREELDAAVAAAKEAFREWRKVPVPRRARILFRYQQLLVEHWDELARLVTLENGKVYEDAYGEVQRGIECVEFAAGIPTLMMGQQLPDIATDIESGMYRYPLGVVAGITPFNFPMMVPCWMFPLAIACGNTFVLKPSERTPMLANRLAELFTEAGLPPGVLNIVHGAHEVVGGILEHKDIKAVSFVGSQPVAEYVYKTAAAHGKRVQALAGAKNHSIVMPDADLDMAVTNIINAAFGSAGERCMACSVVVAVGDIADELVRRLKEAADRIQIGNGLDKGVFLGPVIRESHKERTIKYIEIGEKEGALLVRDGRRDSATSGQGYFIGPTIFDHVKPGMTIWTDEIFAPVLSVVRARDLDEAIEIANRSEFANGACIYTDSAKAIRQFREEIDAGMLGVNVAVPAPMAFFPFSGYKNSFYGDLHANGRDGVEFYTRKKMVTARYQ

SEQ ID NO: 68029 - protein, 542 aa, Oryza sativa Japonica Group
MVKVNWELQGCCDRDQKIFIAAVGVSTVVILLLWRTFLLTPFKLITVFLHETSHALACKLTCGDVEGMQVHPNEGGVTQTRGGIYWIILPAGYLGSSFWGMVFILASTNLLTTRIAAGCFILALIVVLFVAKNWFLRWLCIGVMNSLFSVYGASSRLSFFAHQYTLDWLYCLERKAVLPSFLYKYNMSQAQPGTGTRTGGFGSAARAPPPPRAARSRSTPVIAGLERRRDDREWERLAAAGLHAPGFEAAPVPEDYIDGGGGFGADPDEDYINDAARFNLTRRVEALFPKIDVDPADGAVTPAELTAWNLASARREVMHRTARELDLHDRDHDGRIAFSEYERPSWAWRFDDHNSSNDGVGWWKEEHFNASDMDVFSLVYFVQLLTSSRYYEPKANKLVVQRRSQVGDSTGYSLESRERDKDNDGKLNFQEFYNGLFYSIRHFDEEASTDDSNASDAPARKSFTHLDLDNDGLLSADELKPIIGNLHPPEHFYAKQQADYVITQADTNKDGQLSLQEMIENPYVFYSALFTEDDYGFHDELR

SEQ ID NO: 68030 - protein, 764 aa, Legionella pneumophila subsp. pneumophila str. Philadelphia 1
MLKILKRIVQDVTAASDLKEALGILVQRINTAINAEAVSVYLIDNKNAEYVLIATEGLNKQAEFRVRIALDCGLIGLIGRREEPINIENAPSHPDFYHNPLIGEDHLNAFLGVPIIQHRKLYGVLVVQQLEQRYFDDAEESFLITLAAQLGGIIAHAEATGELAELTQPKKGIGVDKVEATYTALTGIGSVPGIGIGTAVVVYPPADIDAVPRNPVEELEDEINAFYEALETTRDDIRRLSKRMKETVAEEEHALFDVYLRILDRDSLGAEVEHVIREEKISAQAALATVIKKHVQQFESMGDDYLRERASDFRDLGRRVLAELQRTQREEIVYPKRTILIGEEITAAALAEVPEGQLAGVVSAKGSNNSHVAILARALGVPTVMGLRGLKVELVSRRALIVDGYYGHVYISPSKSLLAEFKQLAQEEQELNQSLVSLRDKPAETTDNYRVSLQVNTGLAMDAGLSMSVGAEGVGLYRSEVPFMSRDRFPSEDEQTIIYRQTLKAFAPRLVTMRTLDIGGDKILPYFPVEEENPYLGWRGIRITLDHPDVFLIQVRAMMRASEELDNLRIMLPMVTTLSEVEEAVYLIEQAFEELVEEGCEIVKPKIGVMIEVPAAAYLAREMAKRVDFISVGSNDLTQYLLAVDRNNARVAALYDPLHPAMLRTLLKIVEGGHAAGVEVSICGEMASDPLAVILLIAMGFDTLSMNSASLPRVKWVIRNFAIANARKILAEVLEFEHPAEIRFHLQKALEEEGLGGLIRAGKS

SEQ ID NO: 68031 - protein, 379 aa, Arabidopsis thaliana
MATQGQVITCKAAVAYEPNKPLVIEDVQVAPPQAGEVRIKILYTALCHTDAYTWSGKDPEGLFPCILGHEAAGIVESVGEGVTEVQAGDHVIPCYQAECRECKFCKSGKTNLCGKVRSATGVGIMMNDRKSRFSVNGKPIYHFMGTSTFSQYTVVHDVSVAKIDPTAPLDKVCLLGCGVPTGLGAVWNTAKVEPGSNVAIFGLGTVGLAVAEGAKTAGASRIIGIDIDSKKYETAKKFGVNEFVNPKDHDKPIQEVIVDLTDGGVDYSFECIGNVSVMRAALECCHKGWGTSVIVGVAASGQEISTRPFQLVTGRVWKGTAFGGFKSRTQVPWLVEKYMNKEIKVDEYITHNLTLGEINKAFDLLHEGTCLRCVLDTSK

SEQ ID NO: 68032 - protein, 100 aa, Triticum aestivum
AANYKQVKKGGNEATKTLNRGISEFVVMAADTDPLEILLHLPLLAEDKNVPYVFVPSKQALGRACGVTRPVIACSVTSNEGSQLKQQIQGLKDSIEKLLI

SEQ ID NO: 68033 - protein, 269 aa, Haloarcula marismortui ATCC 43049
MPEMSDAMSKPHTERFRLENQRAIITGASSGIGRAIAEEFAADGADVVVCSREQDNVGPVADEINDSDRPGEAVAIECDVTDREAVEALVEATVDEFGGLDVLVNNAGASFMSGFDDISENGWKTIVDINLHGTYHCTQAAGDALAADGGGTVINLSSVAGEQGAPYMSHYGAAKAGVSNLTSTLSAEWADRDIRINCIAPGFVATPGVESQMGVSADNIDREAVERRIGLSEEIADIALFLASPASSYIVGQTITAAGVPRLEETPDI

SEQ ID NO: 68034 - protein, 267 aa, Zea mays
MAAAEGQWVLMATGRTPTNIAVIKYWGKRDEALILPINDSISVTLDPDHLSATTTVAVSPSFPSDRMWLNGKEISLLGGRFQSCLREIRKRARDFEDKEKGVKIKKEDWDKLHVHIASYNNFPTAAGLASSAAGLACFVFTLGKLMNAKEDYGELSSIARQGSGSACRSIYGGFVKWCMGEKDDGSDSIAVQLADETHWNDLVIIIAVVSSKQKETSSTSGMRDSVETSPLLQYRAQTVVPGRVLKMEEAIKNRDFESFANNLADSN

SEQ ID NO: 68035 - protein, 422 aa, Staphylococcus aureus subsp. aureus MW2
MPEVKVPELAESITEGTIAEWLKNVGDSVEKGEAILELETDKVNVEVVSEEAGVLSEQLASEGDTVEVGQAIAIIGEGSGNASKENSNDNTPQQNEETNNKKEETTNNSVDKAEVNQANDDNQQRINATPSARRYARENGVNLAEVSPKTNDVVRKEDIDKKQQAPASTQTTQQASAKEEKKYNQYPTKPVIREKMSRRKKTAAKKLLEVSNNTAMLTTFNEVDMTNVMELRKRKKEQFMKDHDGTKLGFMSFFTKASVAALKKYPEVNAEIDGDDMITKQYYDIGVAVSTDDGLLVPFVRDCDKKNFAEIEAEIANLAVKAREKKLGLDDMVNGSFTITNGGIFGSMMSTPIINGNQAAILGMHSIITRPIAIDQDTIENRPMMYIALSYDHRIIDGKEAVGFLKTIKELIENPEDLLLES

SEQ ID NO: 68036 - protein, 303 aa, Triticum aestivum
MGDGVAFEAARKIIMHPLYASRSSPWLDLKVFYVRVSNCMVDESAPDHLTLNHIPLSPDTVIEVNGRRSSMHTEFVSSSLRRDRIDKKTEEATYVSTDSIRMTGSVRFQVFDKNDLLLTGDLELCNANGVVGEPKSSSKKWNIKCHSSASSSGFLKGKMSTGPDSAHPVVEVYVAGTFSGTPIILTKTVQFISRRKSQMKLKLDSIPENEATELHTENSHGDSLKVSEFYDPKSETDVDMDYNSLYSRQDFLEGEDGELSWFNAGVRVGVGIGLGICVGVGLGVGLLVRTYQGTSRNFRRRLP

SEQ ID NO: 68037 - protein, 521 aa, Saccharophagus degradans 2-40
MFNLIYRTPNNVKNDLLSGLTVALALVPEAVAFAFVAGLEPMVGLYAAFMMGLITSLIGGRPGMISGATGATAVVMVALVMEYGAQYLFAAVLLAGVIQIGAGILKLGKYIRMVPHPVMLGFVNGLAIVIFLAQLGQFTVKNEVGESVWMEGTMLYTMIGLIALTMAIIHFLPKLTTAVPSSLVAIAVVTLLVHFTGLEARTVIDFVRDMLPAEEAATATLKGELPSFAIPAIPFTWETLRIIFPVGLIIAAIGLIESLLTLTLIDEITGTRGHGNRECVGQGVANTVNGFFGGMGGCAMIGQSMININSGGRGRLSGVTAAIVLLGFILFGAALIEIIPLAALVGVMFMVVLGTFEWSSLRIIRKIPLSDAIIIILVSGITVIADLAIAVIVGVIVSALVFAWKHAQHIHAEVTTDENGTKIYSLRGPVFFGSVANFKELFTPETDPDNVIIDFVRSRVSDHSGIEALDGLAEKYTALGKNLSIRHLSKECIQLLEKAGNLCEVNVLEDPDYHVATDKLG

SEQ ID NO: 68038 - protein, 337 aa, Shewanella sp. MR-4
MAIKIGINGFGRMGRLALRAAWEWDDVEFVQINDPAGDAATLAHLLEFDSVHGRWRYPVTASHDGIQIQDKTIHTTGNKTIAETDWSGCDVVIEASGVMKTKALLQAYLDQGVKRVVVTAPVKEEGVLNVVMGVNHQLYDPTIHPIVTAASCTTNCLAPVVKVIHEQIGIRHGSMTTIHDITNTQTILDAPHKDLRRARACGLSLIPTTTGSATAITHIFPELKGKLNGHAVRVPLANASLTDCVFELERRVTEAEVNALLQSAAEGELKGILGYEERPLVSVDYKTDPRSSIVDALSTMVVNGTQLKLYVWYDNEWGYANRTAELARLVGQLDMPR

SEQ ID NO: 68039 - protein, 397 aa, Saccharophagus degradans 2-40
MFDRLSLLSADPILGLIGQFTADSNPNKIDLGVGVYRDAQGHTPILATVKKAESILWEAEQTKSYIGPAGNQQFNRLVLELILGDEHTALADNRAIAMQTPGGCGALRVAAELIVAANPKAKIWVSDPTWGNHVPLLGDSGMEIATYPYYDYESHGIRFADMLTTLRESAVAGDLVLVHACCHNPSGADLSLAQWLQLTNLCAEKGLIPFVDMAYQGFGDGLDQDAAGLRMMADQLPEVIFAYSCSKNFGLYRERIGAVGVVAANTERATAVASQIMRIVRGIYSMPPSHGAAIVETILADPVLCQAWVDELALMRNRIQTMRQALLDAMTAQGYGDRFHFITGEKGMFSFLGLTPEQVQRLIKEHSVYMVDSSRINVAGLTPTNIDPLVKALTAVL

SEQ ID NO: 68040 - protein, 127 aa, Taraxacum japonicum
NDDFRRGKPTNHKVYGEDVAVLAGDSLLAFAFQHIASATVGASPARVLAAVGELAKSIGTEGLVAGQVVDIASTGAKDVGLEQLEFIHIHKTAALLEAAVVLGAIVGGGSDTQVEKLRKFARCIGLL

SEQ ID NO: 68041 - protein, 413 aa, Mesorhizobium sp. BNC1
MDQKLENNIYDVEAIRRDFPILAREVYGKPLVYLDNAASAQKPQAVIDAVTQAYSNEYANVHRGLHFLSNAATDAYEKARETVRRFLNAGSAEEIVFTKSATEAINTVAYGYAMPRIGEGDEIVVSIMEHHSNIVPWHFLRERKGAKLVWAPVADDGSFHIDEFEKCLTERTKLVAITHMSNMLGTVTPVADIVRIAHERGIPVLVDGSQGAVHQPVDVRALDCDFYICTGHKLYGPSGIGVLYGKREKLQEMRPFQGGGEMIEDVSVDNVTYNDPPHRFEAGTPPIVQAIGLGAALDYMEAIGREKIAAHEAEISKYAHERLGQINSLRVFGTAPGKGAILSFELAGLHAHDVAMVIDRSGVAVRAGTHCAQPLLKRFGVTSTCRASFAMYNTKAEVDALAEALDKARKFFG

SEQ ID NO: 68042 - protein, 173 aa, Triticum aestivum
  misc_feature (79)..(79): Xaa can be any naturally occurring amino acid
MAPTVMASSATSVVPFQGLKSTAGLPVSRRSNGASLGSVRNGGRIRCMQVWPIEGIKRWETLSYLPPIRTEALLRQVDXLIRSKWVPCLEFSKVGFIFREHNASPGYYDGRYWTMWKLPMCGCTDPTQVINEVEEVKKEYPDAYVRIIGFDKLRQVQSVSFIAFKPPGCKESG

SEQ ID NO: 68043 - protein, 442 aa, Prochlorococcus marinus str. MIT 9215
MTIRLVLVRHGQSTFNKKGLIQGRTDDSLLTEEGYEQAMKAGKALSKINFDKIFSSPLVRAANTAKTIKKSFKKEQNIVFDKNLLEVDLSEWSGLKIDEIKNKYPEVYPIWKNDPESLTLKRSDNKTYKPIQELFDQATCFIEDLLKRYLDKDDVNILVVGHNAILRCLILFLLGKPKQGFRKIRLENASFSILNISRKDNSFKTQIECLNQTSHLNKNIPDQIGDSRIFLIRHGETNWNKEGRFQGQIDIPLNTNGKDQARKTSEYLSNISFNKAFSSSMHRPYETAQIILQNKKSLKIKKIDSLVEISHGLWEGKLESEIREQWPILLKNWHDKPEEVIMPEGEPIKDVSERSIEAFDKICSSQKDDDLSLLVAHDAVNKTLMCHILGINYSNIWMIKQGNGGITVIDLFNDPIKPPVISALNITTHLGGIIDSTASGAL

SEQ ID NO: 68044 - protein, 798 aa, Mycobacterium sp. MCS
MSGSAYVTFFEEIGIDDVPLVGGKNASLGEMYQNLSGQGVRVPHGFAITAAAYRHMLDEADAWGRLHAELDDIDPADVAALARKGKRAREIVYGAGLPDDLAAQIRDAYRTLQQEYGEDVSLAVRSSATAEDLPTASFAGQQDSYLNIKGDESLLDTCRRCFASLFTDRAIHYRIDQGFDHFKVSLSIGVMKMVRSDIASSGVMFSLDTESGFRDAVFLTGAYGLGENVVQGAVDPDEFYVHKPTYLAGHRAVLRRRLGDKAVKMVYVEGETKNTTRNIPTPKADRARFCLDDEDVLELAGYACAIEQHYGRPMDMEWAKDGLDGQLYIVQARPETVASQQSVTALETYVLESHAEVLAEGRSVGERVASGAVKRIEHLSQLAEFQPGQVLVADTTTPDWEPVMKTAAAIVTNRGGRTCHASIIARELGIPAVVGTGDATVNVPDGAMVTVSCAEGDTGRVYDGALGFHVDRTEVGDIARPRTEIMINLGNPELAFKTSFLPNDGVGLARMEFVISEYIRFHPLALLHPEKVDDPAIRRDIERLTQGHRDGGAFFVERLSEGIGTIAAAFWPKPVVVRMSDFKTNEYASLLGGRVFEPTESNPMLGFRGASRYAHPAYAEGFALECRAMRRVREEMGLSNVILMLPFVRRVAEADLVLQTMADLGLRRGENGLKIYAMCEIPNNVILIDEFAKRFDGFSIGSNDLTQLTLGVDRDSEVVAFDYDERDDGVKEMIRLAVEGCRRNGIHSGLCGQAPSDYPDMAEFLVRVGIDSMSLNPDTVVRTTRLVLAAEQQLASLS

SEQ ID NO: 68045 - protein, 548 aa, Oryza sativa Japonica Group
MLRRSRHFLPPRPRRRPRPRREAPAAEPPTPTYTRDVVRRVDAILRGHPWSAARPLLLSLPGLAWDSHTVARVLKAHPPLHKAFLFFRLAAGAGGGFRHDRFTYTSMLHLLGEAGRVPAMMRLLAEMLRAGVDPDAATFTTVMHWLAHAGDVDAAMRVWEEMRARKGKCRPTLVSYTACVKILFDAGRPAEAREVFQEMVAEGLRPSCKTYTVLIEHLANVGKFEATMEIMDKMQEAGVEPDKALCNILVQKCSRAGETSVMTRILQYMKENFIVLRRPIFLEALEALKANGESDNLLREVNPHLAFEGIECDPAFTDLGYITVRSTILYLLASRNWSAVEHMINEMTPKNIKVESHILSDIIQASCANCRPSCGLAVLRYSLRIGNELDRSAYGSLLGHYIRNGSFDLVFEIVEILIKSGCNLGTYLSSILIIKLACAGHSSTAVRIFGLLTTDKNVVTYTALMSAYFQDGKVDKALQLFLQMSANGVSACPGTYEVLIHGLQMAGRKQESEHYRRERMEMQWHLQYRNEHSPEDSLCNHLFCDFHG

SEQ ID NO: 68046 - protein, 205 aa, Lentisphaera araneosa HTCC2155
MAVNYMTSIGDPKQLEALLKESGALAGKSEKRIVFAGRSNAGKSSLLNCLTRSKIAQISREPGKTRKVNLFHCSFLKKVLADLPGYGFAKRTKKERRLWEELITSYLDADRDNIERIILVTDCRHGPADSDLDAMQFFKDHGFQVTVVLSKSDKLNQKATSKRRKEIKELLQDSKPEKTFWISSLKGTGVRELSRDIVNDATRTD

SEQ ID NO: 68047 - protein, 421 aa, Clostridium difficile 630
MSGKDVNVFEMAQSQVKNACDKLGMEPAVYELLKEPMRVIEVSIPVKMDDGSIKTFKGFRSQHNDAVGPTKGGIRFHQNVSRDEVKALSIWMTFKCSVTGIPYGGGKGGIIVDPSTLSQGELERLSRGYIDGIYKLIGEKVDVPAPDVNTNGQIMSWMVDEYNKLTGQSSIGVITGKPVEFGGSLGRTAATGFGVAVTAREAAAKLGIDMKKAKIAVQGIGNVGSYTVLNCEKLGGTVVAMAEWCKSEGSYAIYNENGLDGQAMLDYMKEHGNLLNFPGAKRISLEEFWASDVDIVIPAALENSITKEVAESIKAKLVCEAANGPTTPEADEVFAERGIVLTPDILTNAGGVTVSYFEWVQNLYGYYWSEEEVEQKEEIAMVKAFESIWKIKEEYNVTMREAAYMHSIKKVAEAMKLRGWY

SEQ ID NO: 68048 - protein, 514 aa, Rhodococcus sp. RHA1
MSGSRGSSQPGTQRRGSCCSRCGRPQEKRADRARNHIADAGDRRPRAACKVCRSTTPSFRGLLNHYMAKIDRSRTAALTQAPTLHEPDAGVRRTVLPGGLRVVTEYVPGVRSASVGVWVGVGSRDEQPTVAGAAHFLEHLLFKATPSRSALDIAQVMDGVGGELNAFTSKEHTCFYAHVLDDDLPLAIDLVSDVVLRGRCRSADVDVERQVVLEEISMRDDDPEDLLGDAFLTALYGDHPVGRPVIGSVESIESMTRTQLHSFHVRRYTPPRMVVAVAGNVEHEPTVELVRRAFAGHLDSASEPAPRRAGTLRLRAEPTLSLTNRDSEQVHLSLGVRAFGRHESHRWALSVLNAAVGGGLSSRLFQEVREIRGLAYSVYSGIDTFSDTGAFSIYAGCQPENLGEVTTVIREVLSNVAADGITDAECARAKGSLRGGLVLGLEDSGSRMHRIGRSELNYGNHRSITETLSKIDAVTTDEVRDVARVLLQRPFGAAVVGPYRRKRDLPASVRGIVR

SEQ ID NO: 68049 - protein, 143 aa, Shewanella sp. MR-4
MAIERTFSIIKPDAVAKNHIGAIYNRFETAGLKIVAAKMLHLTKEQAEGFYAEHSERGFFGALVAFMTSGPIMVQVLEGENAVLAHREILGATNPAQAAPGTIRADFAQSIDENAAHGSDSLESAAREIAYFFSAEELCPRTR

SEQ ID NO: 68050 - protein, 368 aa, Rhodococcus sp. RHA1
MKIRGAVLEEIGRTRPFAESAPISISELDLDEPGEGEILVRIEAAGLCHSDLSVVDGNRVRPVPMLLGHEAAGRITQLGAGVDDVTVGQRVVMTFLPRCGECEGCATDGRMPCVPGTGANNDGTLLDGGVRLHRGGDTVHHHLGVSGFATHAVVNRRSVVPVGDDVPADVAAVLGCAVLTGGGAVLNAGDPQPGQAVMVVGLGGVGMAAILTAVSRGAGEVIGVDAVPEKLQTARELGATAVYTPAELEEAGVRAPIVIEAAGNARAFESAVRATAPGGKTITVGLPSPDARSSISPLTLVAEARTIIGSYLGSAVPSRDIPIYEDLWRAGKLPVEKLISSRITLDDINRGMDELADGKAIRQIIVFD

SEQ ID NO: 68051 - protein, 613 aa, Nostoc sp. PCC 7120
MSDLFKGFEQLIELVKTLEEKAEKGEIKTDFQINSRSMSSIPRTGNIPRPNNMANDIGTSRIRTQPSPNSDSGNGDSSDVVVPPDAPSGNSLKDVGGLGEVVKELKELIAIPLKRPDLLAKLGLEPTRGVLLVGPPGTGKTLTARGLAEELGVNYIALVGPEVISKYYGEAEQRLRGIFEKAAKNAPCIIFIDEIDSLAPDRSAVEGEVEKRLVAQLLSLMDGFSHSQGVIVLAATNRPDHLDPALRRPGRFDREVQFRVPDVKGRRDILQILTRAMPLEETVDLDAIAERSVGFVGADLKALCQKAAYTALRRQMPSVESAVPENMTVSQADFLQALKEIKPAVLRSVEVEVPHIAWDDIGGLDTIKQTLRESVEGALLYPELYLQTKALAPKGILLWGPPGTGKTLLAKAVASQARANFIGVNGPELLSRWVGASEQAVRELFAKARQAEPCVVFIDEIDTLAPARGSFSGDSGVSDRVVGQLLTELDGIEVGSTILVIGATNRPDALDPALLRAGRLDLQMKVDLPDLASRLAILLVHSQGRPLDGVDFNYWAEMTQDWNGADLTLLCNQAAVEAIRRFRSQGLTDPSEIKITTDDFNYAYKVLTEQRPD

SEQ ID NO: 68052 - protein, 164 aa, Shewanella sp. MR-4
MRRIISVLLENQSGALSRVVGLFSQRGYNIESLTVAPTDDNTLSRLNITVVADEKVLEQIEKQLHKLVDVLKVSNVTESAYIERELALVKVRAQGELREEIKRTADIFRGQIVDVTANLYTIQLVGTTEKLDAFIHSMGEVTKVVEVSRSGVVGLARGEKAMRA

SEQ ID NO: 68053 - protein, 319 aa, Geobacillus kaustophilus HTA426
MKTLDVVTFGETMVLFTSEAMTPLEYSSHFSKQIGGAESNVAIGLQRLGHSVGWFSKLGNDPFGRYIHKFVRGEGVDTSRCIYTDEAPTGIFFKEKRSPSNIKVYYYRRNSAASLLSPDDLDEEYIANAKFLHITGITPALSTSCRETVFKAIEIAKRHRVKIVFDPNIRLKLWTIEKARQVLMEIAAEADIILPGLDEGELLSGRNTPEDIARFFGEEKLVIIKLGERGAYYQFGSEEGYVKGFAVPQIVDPVGAGDGFAAGVISGLLQNVPISEAVRRGNAVGAIVVGTNGDVEGLPTREELDEFLQGAAYQRDVKR

SEQ ID NO: 68054 - protein, 404 aa, Vibrio cholerae O1 biovar eltor str. N16961
MQNIGMSSKLDNVCYDIRGPVLKHAKRMEEEGHKILKLNIGNPAPFGFDAPDEILVDVIRNLPTSQGYCDSKGIYSARKAVVQYYQKKGIRSLDVEDVYIGNGASELIVMAMQALLNNGDEMLVPAPDYPLWTAAVALSGGKAVHYICDEEADWYPDLDDIRSKITPKTRGIVLINPNNPTGAVYSRDFLLEIIEIARKHKLMIFADEIYDKVLYDGAVHTSIATLADDVLVVTFNGLSKAYRVCGFRGGWMFLTGPKQQAQGYIAGLDMLASMRLCANVPMQHAIQTALGGYQSINELILPGGRLLEQRDRAWELINQIPGISCVKPKGAMYLFPKIDTKMYPIKDDQKMVLDFLVQEKVLLVQGSGFNWPKPDHFRIVTLPHVEDLEIAISRFERFITTYSQ

SEQ ID NO: 68055 - protein, 382 aa, Picrophilus torridus DSM 9790
MSVLKCPVCGNEYDINRSNYLCDKCGNILEVIHENDFVKENFRGVWRYKSIIHPGIDKRLIVTRGEGNTFVYGHENISSYSGIKNIKLKHEGENPTGSFKDRGMTVAVSEAMRLGYKKTLCASTGNTSASAASYSAMAGIENFVLIPDGKIAVNKLAQAYVYGSKIIKVPGNFDDAMGKLMNIISKNNNFYVLNSINPWRVEGQKTIAFEILEENEPDFIALPAGNLGNTTAIGKAIKEFHDLGLIKKIPRIVSVQAEGASPFYNLVNNHEGSLNPVNPETIASAIRIGNPVNWKKALKYIKFTKGIVEKVTDDEILNAKRIIDRSGIGCETASAASLAGVKKLSDAGIIDRNDEVFCILTGNVLKDIHIENINSMDINILS

SEQ ID NO: 68056 - protein, 443 aa, Arabidopsis thaliana
MGSGRDRDDPLSFTSNPSTASSPVTVSDYLDNFLGEPTSRSGSFQSESLLGGGGGESINDADFGFARPDFRSEQLAGTVQFYERHVFLCYKKPSVWPARIEAAEFDRLPRLLSAAVSARKGSMKKETRLTICEGHDGTETSNGDVLIFPDMIRYRRLTHFDVETFVEEVLVKDGEWLPGNPELLKGSYVFVCSHGSRDRRCGVCGPSLVSRFREELEFHGLQGKVSISPCSHIGGHKYAGNVIIYRSNINREVTGHWYGYVTPEDVPILLEQHINKGEIVDRLWRGEMGLSEEDQKKTQEGRFQLNGTVHSVKINGKVSQESSVHNADVSCCQSRAAEPNGCCQQNGNSSSCCQDDTTLMLSLGTSEDNQLESENNTEKLTPGRKIAEKTFFRINSDKGSSTRKVCGIPTWLESWEREDTYAALAVVCAAASVAVAYTCYKQL

SEQ ID NO: 68057 - protein, 475 aa, Arabidopsis thaliana
MSVQEYLDKHMLSRKIEDAVNAAVRAKTSDPVLFIANHLKKAVSSVITKVKARQILDSRGIPTVEVDLHTNKGVFRASVPSGDSSGTYEAIELRDGDKGMYLGNSVAKAVKNINEKISEALIGMDPKLQGQIDQAMIDLDKTEKKSELGANAILAVSIAACKAGAAEKEVPLCKHLSDLSGRANMVLPVPAFTVLSGGKHASNTFAIQEIMILPIGASRFEEALQWGSETYHHLKAVISEKNGGLGCNVGEDGGLAPDISSLKEGLELVKEAINRTGYNDKIKIAIDIAATNFCLGTKYDLDIKSPNKSGQNFKSAEDMIDMYKEICNDYPIVSIEDPFDKEDWEHTKYFSSLGICQVVGDDLLMSNSKRVERAIQESSCNALLLKVNQIGTVTEAIEVVKMARDAQWGVVTSHRCGETEDSFISDLSVGLATGVIKAGAPCRGERTMKYNQLLRIEEELGDQAVYAGEDWKLSL

SEQ ID NO: 68058 - protein, 158 aa, Neisseria meningitidis FAM18
MNTIAPNLDGKHLRIGIVQARFTNEIGSEMLKVCCRTLQELGVADENITVATVPGALEIPIALMNLASSEKFDALIAIGVVIRGETYHFELVSNESGAGVSRVALDYNIPIANAVLTTENDAQAIERIEEKASDAAKVAVECANLVNLLLEEQFEDEE

SEQ ID NO: 68059 - protein, 402 aa, Haloarcula marismortui ATCC 43049
MPSHRVPQGMDAAPTVGELTPPDRTLMGPGPSDVHPRVLKAMSTPLVGHLDPSFIEIMDEVQNLLRYTFRTDNKWTIPVSGTGSAAMEAAIGNVVEPGDTMLVPTNGYFGDRMASMAERAGGEVVTVDAPWGQPLDPAAVEAAFDEHSPDVFGFVHAETSTGVLQPSVPELTDIAHANDALVIADSVTSLGGVELRVDEWGIDVAYSGPQKCLSCPPGASPLTLNDDAMDKVLSRESEARSWYLDISLLEGYWGEERAYHHTAPITNVYALREALRLVAEEGIEERWDRHLRVAGALKAGVEGMGLEMNAPDDFWLPSLNTVRVPDGVDDGAVIQYLLDEYDLEIASGLGALEGDIWRIGCMGHSARRQNVSYLLAALGNALGEQGAAIDVDAGLAAMSERF

SEQ ID NO: 68060 - protein, 700 aa, Candidatus Kuenenia stuttgartiensis
MFAMTMNNIQTKQNICTGEEAPCVMACPIRQDARDYVQLIARGLFKEAYRLVRERNTLPASCGRICTHPCETKCRRNSTDKPVAIAWLKRFLSDNYSENIYTRPEQTYPERIAIIGAGPAGLAAANDLALMGYSCTIFESNPHPGGMLRMGVPTYRLPRNAIDQDVEFIRQLGVEIKYNTTLGKDVTFDSLKKEGYAAIFIGVGLFDSRNLPIEGAEYDGVLKGISFLREVNATGTVEIGKNVLVIGGGAVAMDCARTALRLKTEKVSVACLESRNEMPTTDFEIEEAVHEGVILYNSVGPKRILGEHGRATGLETLRVKYVFDEQKRFHPAFYEGSESVIEADTIILAIGQTSNLSFLKNQEEIEVSRGATIVVDPNTFETSMPGIYAGGDIVLGRGTLTEGLAQGKKAAISIHNALRNEKRSDEKWADKPEVPKLADARVPLVKKEQKQDMPMLSLAKRLNSFDEVELGFSPEVAVREAQRCMNCGAGAYVDEHLCVGCITCVRVCPFDVPEFRNGEITAYIGGDCQSCGLCIVECPAKAIRFKTPLEDSGRERLKALFQDVSVQKTRPLIINFYCQYGSPVVGSVEGKSNAVIEKHVKRIGVLGLGKVEPSLYLNALEWGADGVLITACKEDECHFCAEYEWIKKRSEYVSGFLSEIGMDARIFQTHLVSSQTDNAFVDIAVQMVKDVEQINLVKSV

SEQ ID NO: 68061 - protein, 557 aa, Bradyrhizobium sp. BTAi1
MNSPAPRIAPFTCEKQPATGSRGMVVTNHPLASSAGAEMLMRGGNAIDAAVAALFALTVVEPMMVGLLGGGLSHIRLADGRHIVLDGLSTAPLRATPAMYDPVSDEIALARETRDRRNVVGALAVAVPGALKGWCEALTRFGRLPLAEVMAPAIRLAEHGFVASAYLNDCVRLVAADLARDPALSALFLPGGEPVRAGTRVIQADYAASLRLIAEHGPDALYQGPLGAALADDMARSGGLIDMADLAAYKVIERAPVRGTYRGHEIIGPPPPSSGGVHIVQMLNILEGFDIGALGFGSADAAHLLAEALKIAFADRAVATADPAFVDVPVERLTSKTYADERRAQIEIGRARHFGPGLSPTESANTTHVTVADAEGNVVASTQTINGLFGACVQIPGTGMTANNYMYNFDPHPGRALSIAPGKRVFTSMAPMMATRDGRLRYALGLPGGLRIFPSALQALVNLIDHRMSLQEAVEAPRLWTQGGELELEPAFSDSVAQELAARGHAIKREPIVAGGMNAIAFGDDDGLTGAACWRADGTPIAISGGRARAGLRFAIA

SEQ ID NO: 68062 - protein, 142 aa, Staphylococcus aureus subsp. aureus MW2
MLKKDKSELTDIEYIVTQENGTEPPFMNEYWNHFAKGIYVDKISGKPLFTSEEKFHSECGWPSFSKALDDDEIIELVDKSFGMLRTEVRSEESNSHLGHVFNDGPKESGGLRYCINSAAIQFIPYEKLEELGYGDLISHFDK

SEQ ID NO: 68063 - protein, 411 aa, Nicotiana benthamiana
MGSLRAILKNPEDLYPLVKLKLAARHAEKQIPPSPNWGFCYSMLHKVSRSFALVIQQLPVELRDAVCIFYLVLRALDTVEDDTSIPTDVKVPILISFHQHVYDREWHFSCGTKEYKVLMDQFHHVSTAFLELRKHYQQAIEDITMRMGAGMAKFICKEVETTDDYDEYCHYVAGLVGLGLSKLFHASEKEDLASDSLSNSMGLFLQKTNIIRDYLEDINEVPKCRMFWPREIWSKYVNKLEELKYEDNSAKAVQCLNDMVTNALPHVEDCLTYMSALRDPSIFRFCAIPQVMAIGTLAMCYDNIEVFRGVVKMRRGLTAKVIDRTRTIADVYGAFFDFSCMLKSKVNNNDPNATKTLKRLEVILKTCRDSGTLNKRKSYIIRSEPNYSPVLIVVIFIILAIILAQLSGNRS

SEQ ID NO: 68064 - protein, 767 aa, Sulfolobus tokodaii str. 7
MQSSTKVIPKFDKFKFLDVAVISGLVIVSILIRTVNMLAFPQSVNEFDPWYLFYNALLIAQSGGNWYAVPPDVHGWFPWGYFIELGNTIGLPWLVSLFSLPFYGQFGSNAVYTVAVLSDILLDGLGVVAAFLAIDVITENRIGAYIAAAIVAVSPSLTYKNLLGGLPKTSWGGVFVLFSIYFVTLAIKRKNPLYGIPAGIMIFLANITWGGYTYIDLSLAISAFLLVLLNKNDEITAKTLTILAVTSAFLTSLAPNNIGFMSGLAHGLSLLVIPLFLYIELYIRQIIPKEILDSKNILIGAAIVFILALGILGLAALGKSPIPSRYYAIVNPFYQFSVPIDRTVAEYIPQPVTAMIQDFGISLFLSIIGMYFVITRRAQLPGLWLLILGVASIYGTSEQPYLFNYTAYIVAALAGLGVAEIANRFAESKSRGIRIAPLIMLGIIGVSLLADAGISMEISYEPTAIYNAATSFLTTNYAWISALDWINHNTPKNAFILSWWDYGYWIEVVGNRSVIDENNTLNGTQIKLMAEMFLNNESFAVNVLESDFHLYPYGSPNYTIPVYIVAYDAVTQYISSSGQSVWFIGYPTNFPGEFIGYTTSLGDIAKAMGAMTIIAGYNMYSYVNFTYVNETATTLAEAGQTQLASIVANSLPMAWTPKAYNSLIVNMFIEGVQALNQGPVQAPFSISLSQLSSALGGNATLINPSGILPNVVLPYFRPVYISLYPVTAEPAVGGEAIVYIIVVVYQFVEPNVILPLIIQENGTTINT

SEQ ID NO: 68065 - protein, 392 aa, Oryza sativa
  misc_feature (86)..(86): Xaa can be any naturally occurring amino acid
MGLHDAPSRGGAGGGKLSLLASVGLAGAGGGGSGGVGGGGGGGGGGGGYKELLVMALPKDDDLDAGKVADVLGFRLPVVEGAVRAXFFRSREVREFASGALAGAMSKAVLAPLETIRTRMVVGVGSRHIGGSFVEIIEQNGWQGLWAGNTINMIRIIPTQAIELGTFECVKRTMAEAQEKWKEDGCPKIQIGKVKIEFPLQFLSPVAVAGAAAGIAGTLVCHPLEVIKDRLTINREVYPSISVTFSKIYRTDGIRGLYAGLCPTLIGMLPYSTCYYFMYDTIKTSYCRLHKKTSLTRPELLVIGALSGLTASTISFPLEVARKRLMVGALQGKCPPHMIAALAEVIQEEGLPGLYRGWGASCLKVMPNSGITWMFYEACKDILLADKDKRKA

SEQ ID NO: 68066 - protein, 346 aa, Prochlorococcus marinus str. MIT 9215
MFGLIGHSTSFEDAKRKASMLGFDHIADGDLDVWCTAPPQLVENVEVRSATGISIEGSYIDSCFVPEMLSRFKTARRKVLNAMELAQKKGINITALGGFTSIIFENFNLLQHKQIRNTSLEWERFTTGNTHTAWVICRQLEINAPRIGIDLKKATVAVIGATGDIGSAVCRWLTNKTGISELLMVARQQEPLALLQKELDGGTITTLDKALPQADIVVWVASMPKTIEIDTDNLKKPCLMIDGGYPKNLDEKFQGENIHVLKGGIVKFFNDIGWNMMELAEMQNPQREMFACFAEAMILEFEKCHTNFSWGRNNISLEKMEFIGAASLKHGFSAIGLDKQPKVLTV

SEQ ID NO: 68067 - protein, 585 aa, Shewanella sp. MR-4
MKFPSLVSLMPGLAQMLQYEKQWIRDDVRAGLSVAAVALPVAIAYAQLTGVNAAVGLYSCVLPMLVYALFGTSRQLIVGPDAATCAVIAAVVTPLAAGDSMKHWQLVMTMTAMTGFWCLIASRFRLGVLADFLSKPILMGLLNGVAITIIVGQFSKIFGFTFDERYLIERLTGAPSYLTKTHWPTLLMGVVTLATYALVKRYRPLWPASMCAMAMAAFLVWAFNLTSFDINVVGEVSAGLPSFQAPAFDLGIARELVVPALNLAMVSFVSMMLTARSFAAKNGYDIDADKEFRALGIANIASALSQGFAVSGADSRTAVNDANGGKSQLVSIIAAVLIALVALFFTAPLKYIPSSALGVVLVIASISLIDLKALWNLRVRDRSAFLLACTTLFSVLFIGVIPGITLAVLLGLFQFLATVMRPTDQVLGLDQKGVIRSVDDSGKAKSVPGVFIYRFNSPLTYFNATYFKRRLLEKFIREPEPVDCIIIDAVPCFTHLDLSVMAMLADLHQLLKKRGIRLVLAGRKRQMLGWFEQAGMQSGEGGILIRPDLYLALKMNQSYKQALAEGQAPVIKKAPEDDVLLHSHL

SEQ ID NO: 68068 - protein, 128 aa, Glycine max
MTGETVNPKAYPLADAQLAITILDLVQQAANYKQLKKGANEATKTLNRGISEFVVMAADTEPLEILLHLPLLAEDKNVPYVFVPSKQALGRACGVTRPVIACSVTTNEGSQLKSQIQQLKDAIEKLLI

SEQ ID NO: 68069 - protein, 506 aa, Pseudomonas fluorescens Pf-5
MIYAQPGTPGAVVSFKPRYGNFIGGQFVPPVAGQYFSNTSPVNGEVIAEFPRSSAADIDLALDAAHAAAEAWGKTSVQDRSRVLLKIADRIEQNLEILAVSETWDNGKAVRETLNADVPLAADHFRYFAGCIRAQEGGAAEINELTTAYHFHEPLGVVGQIIPWNFPLLMAAWKLAPALAAGNCVVLKPAEQTPLSIMVFAELIADLLPAGVLNIVQGFGREAGEALATSKRIAKIAFTGSTPVGSHIMKCAAENIIPSTVELGGKSPNIFFEDIMQAEPKFIEKAAEGLVLAFFNQGEVCTCPSRALVQESIYEPFMAEVMKKIVKIKRGNPLDTETMVGAQASQQQYEKILSYLQIAQEEGAELLTGGAAELLEGDLASGYYIQPTLLKGHNKMRVFQEEIFGPVVGVTTFKDEAEALAIANDSEFGLGAGLWTRDINRAYRMGRAIKAGRVWTNCYHLYPAHAAFGGYKKSGVGRETHKMMLDHYQQTKNLLVSYDINPLGFF

SEQ ID NO: 68070 - protein, 497 aa, Legionella pneumophila subsp. pneumophila str. Philadelphia 1
MLLKIPAKMQVNYATIWNVMTTPLYPIILAGGSGTRLWPLSRQNFPKQFLKLNGELSLIQQTMKRAMGLPGNQTIIVSNDAHYFICQDQLQDFNAQTTYLLEPCARNTAPAIACAAHYLANTVGKDAVMLVLPSDHWIADDEIWLAAMLEGGQFASENNAIVTFGIKPDSPKTGYGYIEAGTTLSSDIKQVLSFREKPDAHTAAQFVSKGNYFWNSGMFICRAGVYLEELEQFEANIYQFSQQALTLAQHHHDFLRLDLDCFSQCKEESIDYAIMEKTDKAVVIPISIQWSDLGCWTAVADANKQDEQGNTLIGNVIAQDSHNCLINSEELLVTTVGIQDQIIVATSDAVLVADKRYSQQVKDLVHSLRKDHPHLTQDHQRVPRPWGYYEVLAEGTSFKVKRLMVKPGAKLSLQTHQHRAEHWVIVGGEAEVVNGNNTFRLSKNQSTYIPKNALHRLSNPHNEPLYVIEVQSGSYLGEDDIKRFDDIYLRKEVELAE

SEQ ID NO: 68071 - protein, 511 aa, Clostridium difficile 630
MKHELVLVIDFGGQYNQLIARRVRENNVYCEILPCTASIERIKEKNPKGIIFTGGPNSAYLEDSPTISKEIFELGVPILGICYGIQIMSHVLGGVVRKGNKQEKEYGKTAITYGKSSLFEGITTNSVWMSHTDLIEKVPEGFTIVANTNDCPVAAMENVERNLYGVQFHPEVEHCLEGDKILTNFLYNICKVKGDWTTDSFIEDKIKELKEKIGDKKALCALSGGVDSSVAAVLIHKAIGDNLTCIFVDHGLLRKNEGNDVERIFREKFDINLIRVNAEDRFLSKLKGVSEPEAKRKIIGEEFIRVFEEESNKLGKMDFLVQGTIYPDVIESGHGNAATIKSHHNVGGIPEDVDFQEIVEPLRELFKDEVRKIGLELGIEEGLIFRHPFPGPGLGIRVIGDVTKEKCDILREADAVYMDELRKAGLYREIWQAFATLPDVKTVGVMGDERTYAYLVGLRAVTSSDGMTSDWYKMPYDVLERISNRIINEVDGVNRVVYDITSKPPGTIEWE

SEQ ID NO: 68072 - protein, 312 aa, Debaryomyces hansenii CBS767
MADTSQLDLKEIHEFAFDVAERAGKMLVAASQNRTADENIRLKKNTVDIVTETDEEVEKFIKTEINNRYPEHKFIGEETYSAGKSKKYLVDDDPTWIVDPLDGTVNYVHLFPMICVSIGFAVGGKSVVGVVHAPFLSQTYSAYPGGGAWLNKLIQLPLQNLPMPENAPKGCIFLCEWGKDRRYAPGLNLQRKVDSFINMATDYCHGVRSLGSASLDLCFVATGAFDIWWEGGCWEWDVAGAVAILNEAKGLVTTGNPPENPDVIPEVELGSRLYLAVRPCQGTDTETPRQSQERVIRQVWKRVNTLDYVRPQ

SEQ ID NO: 68073 - protein, 504 aa, Oenococcus oeni
MAEKKTTKATASSTSKVAKRTRGSKSTQTKASVSNEKDLAEGTVLQVIGPIVDVQFPDNKKLPDINNALKVQRIDGSELTIEVSIDLGDSVVRTIAMDSTDGLTRGMKVLDTGAPIEVPVGEATLGRVFNVLGEPVDGGDPIPNSVDRHPIHRSAPKYDELATSAEVLETGIKVIDLLEPYLRGGKTGLFGGAGVGKTVLIQELIHNIAQGHNGISVFTGVGERTREGNDMYYEMKASGVLKNTAMVYGQMNEPPGARMRVGLTGLTMAEDFRDQEGKDVLLFIDNIFRFTQAGSEVSALLGRIPSAVGYQPTLATEMGQLQERITSTKKGSVTSIQAVYVPADDYTDPAPATTFAHLDATTNLERSLTQQGIYPAVDPLESTSSALTPDIVGEDHYEVATQVQHFLQRYKELQDIISILGMDELSDEEKTIVNRARRIQFFLSQPFSVAEQFTGVPGQYVPVEDTVRGFKEILDGKHDDLPEEAFRNVGTIEQAVEKAKKLES

SEQ ID NO: 68074 - protein, 50 aa, Arabidopsis thaliana
  misc_feature (15)..(15): Xaa can be any naturally occurring amino acid
  misc_feature (17)..(17): Xaa can be any naturally occurring amino acid
  misc_feature (38)..(39): Xaa can be any naturally occurring amino acid
  misc_feature (46)..(46): Xaa can be any naturally occurring amino acid
MPLLWLLSGQATMVXPXNGLKSSAAFPATGKANNDITXXTSNGGRXNCMQ

SEQ ID NO: 68075 - protein, 428 aa, Saccharophagus degradans 2-40
MSKIANVIGFEVMDSRGNPTVMAEVVLESGVVGTACAPSGASTGSREALELRDGDKSRYLGKGVLKAVANINETIKPLLVGKDVAAQRELDDIMLKADGTENKANLGANAILAVSLAAAKAAAQDKGIPLYAHIADINGTPGKYTMPVPMMNIINGGEHADNNVDIQEFMIQPVSAPNFTEALRMGAEVFHSLKKVLAGRGLNTAVGDEGGFAPNLPSNEAALEAIAEAVAAAGYKLGEEITLALDCASSEFYKDGVYDMSGEGKKFSPEEFADYLAELASKYPILSIEDGMDESDWDGWKVLTEKIGSTCQLVGDDLFVTNTKILKEGIDKSIANSILIKFNQIGSLSETLDAIKMAQEAGYTAVISHRSGETEDTTIADLAVATAAGQIKTGSLSRSDRVAKYNRLLRIEAELGEKAPYRGRAEFK

SEQ ID NO: 68076 - protein, 424 aa, Parvularcula bermudensis HTCC2503
MTAIIDINAREILDSRGNPTVEVDVFTEDGVMGRAAVPSGASTGVHEAHERRDGGERYGGKGVRGAVDAVNSSIFEAIVGLDVEEQVFIDEAMIDLDGSPNKASLGANAILGVSLAVAKAAAKQTGQPLYRYVGGVSADLLPVPMMNIVNGGAHADNPIDIQEFMIMPTGAGSFAEALRMGAETFHALKAELKAAGHNTNVGDEGGFAPTLSSTDEALDFIMKAIDKAGYTAGDDMHLALDVASTEFYKDGKYHLEGEGKTLDAAGMTDYLVRLVDAYPIISIEDGMAEDDWDGWVTLTEKIGDRCQLVGDDLFVTNEKRLVTGLEKGAANSILVKVNQIGTLTETMRAVSRAHRGGYTAVMSHRSGETEDTTIADLAVATACGQIKTGSLARADRTAKYNQLLRIEEDLGPSARFAGKSILRG

SEQ ID NO: 68077 - protein, 368 aa, Debaryomyces hansenii CBS767
MASILMGKAQRAEMYEQERLHHTPWVEKYRPKNLDDVASQDHAVKILKKTLESANLPHMLFYGPPGTGKTSTILALAKQLYGPHLYKSRVLELNASDERGISIVRQKIKNFARLTISNPSKEDLENYPCPPYKIIILDEADSMTNDAQSALRRTMENYSGVTRFCLICNYITRIIDPLASRCSKFRFRLLNNSNALNRLKYIVGQEEIALDNEDVLEEVLNISNGDLRKAITYLQSAARLHASFNNRIDANGDIEMVDADTKSKITQDSVQEIAGVLPEASLDQIISAIESLDTRTILQKIEEIVLQGWSAQQVVDQLHDKFILNDSLESSTKNKIAKILFETDRKLNNGTDEHIQLLNLCLQIKKVL

SEQ ID NO: 68078 - protein, 432 aa, Anabaena variabilis ATCC 29413
MIDIYILDLFVIGLLLLIVTLGSGWIARLPLSFALIYLLVGIILGPYGFGLIQLRRDDVFNADLLERITEFVVIISVFSCGLKIIHPRRRRVWDITARLIGFLMPISIFAIAIVAKLFLAMNWGEAILLGAILAPTDPVLASEVQLTDINDKDELRFGLTSEGGLNDALAFPFVYFGLFAIKDDNWNTWFKQWVVIDLIWAIAAGLIMGFVVAKAIVWIDQKIQKRRSADALMEDFVALSAILLTYSLTEVVNGYGFLAVFIAGLVFQDTYRNPERPLAQLEFIERLEKLLEVGTILLLGSILLWQPIVNYGYQSLIVIIFLFLIIRPVGAWISTIGKRPLASHRRHFHPATRWLFGWFGIRGVGSLYYLAYAFGHGLKDGVGEEIAWITYTTIVVSVVIHGISATPLMSWYERNIANEKKTSLPETLSDLE

SEQ ID NO: 68079 - protein, 155 aa, Saccharophagus degradans 2-40
MRIGQGVDVHAFGDGDKIVIGGVVIPYERGLVAHSDGDVLLHALCDALLGAAALGDIGKHFPDTDSAYKNACSRTLLRMVYSKLKAKGYSLVNADMTIVAQAPKMAPHISDMRAKIAEDLDTHIDNINVKATTTEQLGFNGRKEGITALATVLIK

SEQ ID NO: 68080 - protein, 644 aa, Candidatus Kuenenia stuttgartiensis
MNNILDSVEFPEDLKKLNPEDLPKLASEIRSFIVDVISKNPGHLSSNLGVVELTMALHYCFDFRKDRIVWDVGHQAYVHKILTGRKTHFSILRQYKGLSGFPDKNESVYDPFTCGHSGDAISSALGLSCADEIIGYKRSIVVVVGDGGIGAGMSLEALNHAGDIKKNLLVVLNDNEMSISNTVGAVSKYLNKIRTMPIYADIRKELRGLIKILPVLGKPMEKTLEHLVELVKIGATPGRIFEDLGFNYFGPIDGHDFKVLTETINDIKHLNGPVLLHVITEKGRGFEPAYQNPTQFHSSGKFKLSEGKIEKEVQDAGKISYTKVFSDALVEFSKTNPSIVGITAAMPDGTGMISFGEKFPDRYFDVGICEQHAVGLANGLSTEKLKPVVAIYSTFLQRAYDQVFHDICLQKNPVVFVMDRSGVVGNDGPTHNGVFDIAYLRNLPGIVLMSPKDGSELRAMLKIAIDSDEIIAIRYPKENIPDEKIDLECKPFGIGEAEILREGKDGVLLAYGCMVQRCLQAAEQLSGKGVEATVVNARYAKPLDKKLILSLVRKHKLILTVEDHALAGGFGSAVLEMVSDEKEDAGKIVRMGIPDRFMEHGPREVILKNLGLDADGIADTFIASLDLTEIKGSFANTGKRHLAV

SEQ ID NO: 68081 - protein, 514 aa, Bradyrhizobium sp. BTAi1
MHRREWERQMTKVDVHAALKPPFAARYDNFIGGAWKAPNAGKYFDNISPITGQPVCQIARSDASDIEAALDAAHAAKDGWARTSVTERAQILNKIADRMEANLAKLALAETWDNGKPIRETTAADIPLAIDHFRYFAGVIRAQEGSIAEIDHDTIAYHFHEPLGVVGQIIPWNFPILMAAWKLAPALAAGNCVVLKPAEQTPASILVLMDLIGDLLPAGVLNVVNGFGLEAGKPLASSNRIAKIAFTGETSTGRLIMQYASQNLIPVTLELGGKSPNIFFKDVCAEDDDFFDKAIEGFVMFALNQGEVCTCPSRALIHESIYERFMERALQRVGAIVQGSPLDPATMIGAQASAEQLSKILSYIEIGRNEGAQLLIGGERNVLGGDLAGGYYVKPTVFRGHNKMRVFQEEIFGPVVSVTTFKTEDEALAIANDTLYGLGAGVWSRDANTCYRFGRNIQAGRVWTNCYHAYPAHAAFGGYKQSGVGRETHKVMLDHYQQTKNMLVSYSPKKLGFF

SEQ ID NO: 68082 - protein, 291 aa, Sulfolobus tokodaii str. 7
MIIIGGTATNGIDENLSKIISVPLLKVEHKVFPDGESYIRIPQHITNQEILVVQSLYPPQDKHFVELLLILETLADMKNNKITAIVPYLAYSRQDRRFKEGEALSIKTILNAIARAGADVLIVIEPHKEEELSYFGKEVKIADPMPELAKEVSKKVEKPFVLAPDRGALERAKRLAEQLNAEYSYIEKERDRDTGEVRIKNLPELRLSGKDVIIVDDIISTGGTMIQATRAAYEHGARKVISVAVHSLFLDNAYEKLINSGVKEIVTTNTIPQDPSKVTVVDVSPAIARKI

SEQ ID NO: 68083 - protein, 509 aa, Triticum aestivum
  misc_feature (62)..(62): Xaa can be any naturally occurring amino acid
  misc_feature (362)..(362): Xaa can be any naturally occurring amino acid
  misc_feature (378)..(378): Xaa can be any naturally occurring amino acid
MAVAAPGQLNLDEFPSWGSRGVDCFEKLEQIGEGTYGQVYMAKETETNEIVALKKIRMDNEXREGFPITAIREIKILKKLHHQNVIQLKEIVTSPGPDRDEQGKPIDGNKYKGSIYMVFEYMDHDLTGLADRPGMRFTVPQIKCYMKQLLTGLHYCHVNQVLHRDIKGSNLLIDNEGNLKLADFGLARSFSSDHNGNLTNRVITLWYRPPELLLGSTRYGPAVDMWSVGCIFAELLNGKPILPGKNEPEQLTKIFELCGTPDELIWPGVTKMPWYNNFKPPRVLKRKVKDAFKHFDRHALDLLERMLTLDPSQRIPAKEALDAEYFWTDPLPCDPKSLPSYEASHEFQTKKKRQQQRQAEEXAKRQKINHPPPHSRLXPPIQHPGQSHQIRPGHAPPVAGGSSHYAKPRGPGGPNRYPQGGNQGAGYNNPNRGGQGSGYGSAPYPQQGRGPPPFPAAGAPRGGAGSGYGVGGPNYPPGGPPYGTSGPGRGGPNYPQGGSRNQQQYGSWQ

SEQ ID NO: 68084 - protein, 550 aa, Legionella pneumophila subsp. pneumophila str. Philadelphia 1
MSAEENMTKESEIKIPDIGGANQVDVIEILVKEGDQIEVDTPLITLESEKASMDIPSPISGTVTQILVKVGDKVSEGDLIVKAKSDTTTNISSSQEQKTEPEKQNLQTRAEEQSVDTKATASTPSSKDIEISIPDIGGANDVDVIDILVKPGMEVEKDQALITLEGDKATMDIPSPYAGKVIEMKIKLGDKVSQGTPILTLKTLGKSETPEIEKSQIKNISEQSIKEIEKPYEELKSEAISINNLEIAESKSILISAGPAVRRLAREFGVDLSLVQGSGRKSRITKEDLQNYIKVRLSEKTTSGGFSLPSNPAIDFSKFGSIETKPLNKIKKLTGTNVHRSWITIPHVTQFDEADITDLEAFRKSESESAKNQDYKLTLLAFVCSVVCKALHAYPQFNASLDTSGENLIYKKYYNIGIAVDTPNGLVVPVIKNVDKLSVIDIAKEMSRLSTKAREKGLTPIDMSGGCFTISSLGGIGGTAFTPIVNSPEVAILGLSRSIIKPIYDNKEFKPRLMLPISLSYDHRVIDGAEAARFTRFLCDCLGDIRRVLL

SEQ ID NO: 68085 - protein, 328 aa, Triticum aestivum
  misc_feature (318)..(318): Xaa can be any naturally occurring amino acid
SARAGLSGQLQKAFVTGVPALKRSELQAACEDFSARGGCLSDYMMYKGTLSSGVEIAVISTTKKSGKEWSKHCEARFRKKITSLSRVNHKNFVNLLGYCQEEQPFTRMMVFEYAPNGTLFDHLHVREDGHLDWPTRLRVAVGIAYCLEHMHQLSPPEILKTLDTSTVYLTDDFAAKIADVFFCSDDADASSTRAEMASLQSLLALSDRESVVYSYGMVLLEIMSGRFTASAGGLLEGWAASFLRGERQLRDVMDPDLSWNAPLHAETVNRLDGVIRSCTDREARRRPAMAEVARRLREITAMPPDAATPKVSPLWWAXELEIISTEAT

SEQ ID NO: 68086 - protein, 421 aa, Mycobacterium avium 104
MALVVQKYGGSSVANADRIRRVAERIVATKKQGNDVVVVVSAMGDTTDDLMDLAQQVCPAPPPRELDMLLTAGERISNALVAMAIESLGAQARSFTGSQAGVITTGTHGNAKIIDVTPGRLQAALDEGRIVLVAGFQGVSQDTRDVTTLGRGGSDTTAVALAAALGADVCEIYTDVDGIFSADPRIVHNARKLDTVTFEEMLEMAACGAKVLMLRCVEYARRYNIPVHVRSSYSDKKGTVVVGSIKDKPMEDPILTGVAHDRSEAKVTVVGIPDIPGYAARVFRAVADADVNIDMVLQNVSKVEDGKTDITFTCSREAGPTAVAKLDALKDEIGFTQLLYDDHIGKVSLIGAGMRSHPGVTATFCEALAQVGVNIELISTSEIRISVLCRDTELDKAVVALHEAFGLGGAETATVYAGTGR

SEQ ID NO: 68087 - protein, 471 aa, Herbaspirillum seropedicae
MARTAAEVLKMVKDNEVKFVDFRFADTRGKEQHVSVPVSHFDIDKFESGHAFDGSSIAGWKGIEASDMLLIPDPNTANIDPFMEETTLFMQCDVIEPSDGKGYDRDPRSIAKRAEAYLKSSGLGDTAYFGPEPEFFIFDGVRWGADMSGSFVKIDSEEASWSTGAKIEGGNSGHRPTVKGGYFPVPPVDSFQDMRSEMSLIIESLGIPVEVHHHEVAGAGQNELGTKFSTLVERADWTQTMKYVIWNVAHTYGKTATFMPKPLVGDNGSGMHVHQSVWKDGKNLFAGDGYAGLSEFALYYIGGIIKHAKALNAITNPGTNSYKRLVPGFEAPVKLAYSARNRSASIRIPHVANPKGRRIETRFPDPLANPYLCFSALLMAGLDGVQNKIHPGEAATKDLYHLPPEEDKLIPTVCSSLDEALEHLDKDREFLTRGGVFTDSMIDAYIDLKMQEVQRFRMTTHPIEFDMYYSL

SEQ ID NO: 68088 - protein, 346 aa, Zea mays
MGRSALAVRLASLLAFGLVLVSVEASLGDVDPRYRTCVRECQATGIVGENVISHCQSKENYTSVGVSWYNQEQIYIQWKELNCRTDCRYFCMMQREGERQSLGLSPVKYHGKWPFLRVSVFQEPLSTALSAVNLLMHFTGWLSFFLLVNYKLPLRPQTKRTYYEYTSLWHIYAILSMNAWFWSSIFHTRDIELTEKLDYSSAVALLGYSLILSLLRAFNVKDEASRVMFAAPILAFVTTHILYLNFYELDYGWNMKVCVVMAAVQLLTWAVWAGVSRHPSRLKLWTVVFGGALVMLLELYDFPPYMGFADAHSLWHASTIPLTYLWWSFIKDDAKFRTSTLSKKAK

SEQ ID NO: 68089 - protein, 348 aa, Neisseria meningitidis MC58
MKMQAVVVNKNVAGDVEVIEREVRPLEYGEALVEVEYCGVCHTDLHVAAGDYGEKPGRVLGHEGIGLVKEVADGVKNLKVGDRVSIAWLFQSCGSCEYCNTGRETLCRSVLNAGYTADGGMATHCIVSADYAVKVPEGLDPAQASSITCAGVTTYKAIKVSGVRPGQWIAIYGAGGLGNLGVQYAKKVFGAHVVAIDINDDKLAFAKETGADLVVNAAKEDAAKVIQEKTGGAHAAVVTAVSAAAFNSAVNCVRAGGRVVAIGLPPESMDLSIPRLVLDGIEVVGSLVGTRKDLEEAFQFGAEGLVVPKVQLRALDEAPAIFQEMREGKITGRMVIDMKKECGCGHHH

SEQ ID NO: 68090 - protein, 638 aa, Vitis vinifera
MAGKAAATQSAAAFEFELFEGDPDHLRTVVATPNLISPWIDPATLKLRHRIGRGPFGDVWLATQHLFAEDYDEYHEVAIKMLHPIKEDLMKVVLDKLENLFSKCQGLKGVCWLHGISVISGKICIIMKFYEGSLGDKMAHLKGGKLSLRDILRYGIDLAQAILELHSKEILVLNLKPYNFLLDQNDEAILGDLGIPYLLLQIPLPSSDIARRLGTPNYMAPEQWQPEVRGPLSLETDSWGFGCSIVEMLTGVQPWCGKSVEEVHDSVVRKQEKPFIPSGLPPAVERVIIGCFAYDFRSRPSMKNILEAFKSSENAVYSDGGWTGLGSRTITDNFIVNGYSEWFLSKENFLVGDLVRSRKPPHSCKPENMDVPGGTVVGLERDSDQDGYVLVRVLGIHDPLRVHKYTLERVTSGLAAGDWVRLETEDRRNSRVGILHSISRDGSVDVGFIGMETLWKGSCTNLQMAESYCKGQFVRLKANVLSPRFEWPRKRGGAWATGRIWQVLPNGCLVVNFPGRLPIGDECSSFLADPAEVELVSFNTSPGLVKKYQHLEDFHWAVRPLLIALGLFSAMKFGIFVGKKIGIGRSKEKRGQSTMTQNESQRLDNQTAGNAAWLPQTVAVSSEKVLAQVMAGKFLPKS

SEQ ID NO: 68091 - protein, 511 aa, Arabidopsis thaliana
MEILTSIAITVATTIFIVLCFTIYLMIRIFTGKSRNDKRYAPVHATVFDLLFHSDELYDYETEIAREKPTYRFLSPGQSEILTADPRNVEHILKTRFDNYSKGHSSRENMADLLGHGIFAVDGEKWRQQRKLSSFEFSTRVLRDFSCSVFRRNASKLVGFVSEFALSGKAFDAQDLLMRCTLDSIFKVGFGVELKCLDGFSKEGQEFMEAFDEGNVATSSRFIDPLWKLKWFFNIGSQSKLKKSIATIDKFVYSLITTKRKELAKEQNTVVREDILSRFLVESEKDPENMNDKYLRDIILNFMIAGKDTTAALLSWFLYMLCKNPLVQEKIVQEIRDVTFSHEKTTDVNGFVESINEEALDEMHYLHAALSETLRLYPPVPVDMRCAENDDVLPDGHRVSKGDNIYYIAYAMGRMTYIWGQDAEEFKPERWLKDGLFQPESPFKFISFHAGPRICLGKDFAYRQMKIVSMALLHFFRFKMADENSKVYYKRMLTLHVDGGLHLCAIPRTST

SEQ ID NO: 68092 - protein, 369 aa, Arabidopsis thaliana
MMWLCVIVILQDMGQKRWFFLLAIFVCLVSSSCGRVLKFKSDDGRPVYNHTLAITLVEYTSAVYMSDLSELFTWTCERCNGLTKGFEVIEIIVDVEHCLQAYVGVAKDLNAIIIAFRGTQEHSIQNWVSDLFWKQLDLNYPDMPDAMVHHGFYSAYHNTTVRPAVLDAVKRAKESYGANLNIMVTGHSMGGAMASFCALDLVVNEGEENVQVMTFGQPRVGNAAFASYFNLLVPNTFRIIHDRDIVPHLPPYYHLFPQKTYHHFPTEVWLTELSILNIVIRGVEKVCDNTGEDPTCSRSVMGNSISDHLTYFGVELMGETWRQCNIVMGHEMESYSRKDSKGNIFLSRTVPSTEVIKTKSISKTGISSL

SEQ ID NO: 68093 - protein, 543 aa, Nostoc sp. PCC 7120
MLFSILWILIMGFFAGQIARRLTAPPLIGMILVGIFVGPQVGNVISQDVLGAADELRTVAVTIILMKAGLGLDREKLAEQGSVALRLGFLPATTEAIAIAIASIIIFKFDFPTGLLLGCVIGAESPAVIVPGMLRLKSLGLGVTKGIPDAILTGSALSDVLLLLVFSLLLNFLGDGGVEQITLIGVFTLNTLYLLPIQILMQIVLGLLLGYLAARLIVLLLTKQNWTQNVVQDTVISASLALFLVIIANALPYFSGYLATIAMGFFLIELDAPLARRLRGGFDGLWVVAEIFLFVLLGATIQLQVLENILLPGILILAIGLFIGRMIGWYLSTLGSNWNWHERLFLLPGNSAKATVQAAIGAIPLAQGIAGGEIILAIAVLSILITAPLGAWATTVFAPKLLTRGEVDPTKVTIATRTLLLAAVDTSSLATEVLTKVADLARRSNGEAIVLHVVNTSHRQDVEQVQAQAKQLLSDIRYQFLTVTGAVPEEILRIAETYNATAIVMGKRGHQPWEKVLIGSVSQAVLENSSIPVILLDTRPEKN

SEQ ID NO: 68094 - protein, 589 aa, Zea mays
MSATIDRLATPSHEGRAHSDEKRECNSDEENSEGERKPKKDSFKKRAVTTGYRFRHSLRRKSKTKNDNHIASIEDIRDVQELEIVERFRQCLLDDGLLPEHHDDYHTMLRFLKARKFNIDKAKHMWSEMLRWRKEFGADNIEEFDYTELDEVVKYYPQFYHGVDKDGRPVYIELIGKVDTNKLVQITTIDRYLKYHVKEFERCLQMRFPACSIAAKRHIDSSTTILDVKGVSLKNFTKDARELIMRLQKINNDNYPETLYQLYIINAGQGFKILWGTIKSFLDPETASKIHVLGNKYQTKLLEIIDGSELPEFLGGKCRCEEYGGCPKSDKGPWKDPEIFKRVINGEANYGRQVLAVSSINQKEVGCTEHTTVEDVSSSTALVDPIISPNLTHVDELKFQGHASSSDAPPIIGDSIPAAGKVMDACSNPRNSSTPSSSGSFSLRNIPATLGGLKTRIVAWSTFVILTLSAFLCSVLSIVTKRLSNQAITCDHYSADFHQGYMGNGTLTSVLTRLGELEEKVQALEAKPPQVPFEKEELLHTAVYRVDVLEAELISMKKALYETLIRQDELLAYIDQQQTAKFCRQKFCF

SEQ ID NO: 68095 - protein, 322 aa, Oryza sativa Japonica Group
MAARSFQARSPKEESDAAVHEAVTLGLKNAAISGTVVAVPTLVGCRVLPWAKANLNYTAQALIISAACIAGFFITADKAILRNARQNTIGKIDRLKQHKTGSDLCNARTDDVRGDKQPFAPGRMREACAPVPPGAHEEACIEQSDDRSEDGSFSGSSIGSSCSSASDLSDDGSSYRPGDYLEPSSSSSSASSSTLQLDSEGPLCDLSSLIAQLPIRRGLSNYYQGKSQSFTSISDATCVQDLAKKITYNKRMKACKSYAAGLDMNQRSNHLPKPCNKMIAKRPSKGSFTCLLSRPSSTSLLCSSAKPPTHQSKKDVQMHINS

SEQ ID NO: 68096 - protein, 170 aa, Anaplasma phagocytophilum HZ
MREVLVPYAGVSPSVDSTAFIAGNARIIGDVCIGKNASIWYGTVLRGDVDKIEVGEGTNIQDNTVVHTDSMHGDTVIGKFVTIGHSCILHACTLGNNAFVGMGSIVMDRAVMEEGSMLAAGSLLTRGKIVKSGELWAGRPAKFLRMMTEEEILYLQKSAENYIALSRGYL

SEQ ID NO: 68097 - protein, 500 aa, Acinetobacter sp. YAA
MSEKLDFITKNNLWTDKQRDAADKVLAEIDSLGLEMIRLSWADQYGLLRGKALSVAALKAAFSEGSEVTMAPFSFNLVSEWVFNPFTAGGGFGIDEFDELGGVPSVVMVPDPTTFKVLPWADKTGWMLADLHWKSGEPFPLCPRGIMKKAVKSLSDEGYLFKCGIELEWYLTKIVDRSLSPESLGAPGVQPDAIQVQPVAQGYSYLLEYHLDQVDDIMSKVRKGLLELNLPLRSIEDELAPSQMETTFDVMEGLEAADAALLIKSAIKQICSRHGYHATFMCKPAINGFSVASGWHMHQSLVDKDTRKNLFIPSEGEVVSPLGRAYAGGLLANGSAASSFTTPTVNGYRRRQPHSLAPDRRAWAKENKAAMVRVISATGDPASRIENRIGEPGANPYLYMASQIVSGLDGIKIKRDPGGLQGAPYGAQVPMLPTALAEALDALEHDSELFRSCFGDTFIKYWLQLRRSEWARFLDAEGAEAAEPTGAVTQWEQKEYFNLL

SEQ ID NO: 68098 - protein, 250 aa, Legionella pneumophila subsp. pneumophila str. Philadelphia 1
MTNQKQTTHFGFKSVDWNEKEKKVAEVFHSVAKNYDRMNDLMSLGIHHLWKRYTIELSHVRPGQSVLDLAGGSGDLTRLLLQKVGDSGQVILADINAAMLHVGRDRLLDEGLFKNIRYVQGNAQCLPFADNSFHCITMGFGLRNVTDKDEALQSMYRVCKPGGKLMVLEFSTPVFPGLKPVYDWYSFNILPKIGKFVANDEASYQYLAESIRMHPDQETLKAMIERVGFEDCHYHNLSGGIVALHIAYKY

SEQ ID NO: 68099 - protein, 618 aa, Candida albicans SC5314
MSEQAQTQVSADQQQHQHNHHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSAGVILYVMLCGRLPFDDEFIPALFKKISNGVYTLPNYLSAGAKHLLTRMLVVNPLNRITIHEIMEDEWFKQDMPDYLLPPDLSKNKNSKIDVDEDVIRALSVTMGYDRDEIVNVIEKANKQVAAGNSSSQQSKSSNEILDAYLLMKENHALVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVDFKFDGWESAHGNAGTDSPQSHRQQDLDEVGSFSAYPFLHLATRLIMELAVNSQSG

SEQ ID NO: 68100 - protein, 544 aa, Allium cepa
AVATDDGRCSVIGKDVLKEGGNAIDAAVAASLCLGVVSAASSGIGGGAFMLIRMANGEAHAIDMRETAPLLASQNMYDGNAILKGSGILSVAVPGEIAGLHRAWKQHGKLQWKRLVMPAAKIAKAGFKISKYLHMQMNRTKAEILKDKGMRDIYTTNGTLLMPGDICRNKKLAHALREIAVHGPKVFYNGSVGIKLVKDIQKLGGILTMNDLRTYRVKVNKPISANVMGYEILGMPPPSSGGAGMILILNILAQYRIPSGVSGSLGLHRFIESLKHMMAIRMNLGDPDFVNVSQVLSEMLSPKFAEDLKKKIYDNMTFDPSYYGPKWNVVNDHGTSHLSIVDSERNTVSMTSTVNSYFGAGIASQTTGIVLNNEMDDFSIPSNSSSNNNLPPPAPTNFIAPLKRPLSSMSPTIILKDGKLVASLGASGGGMIIAAATHIFLKLFAEKLDPLSSVLSPRSYHQLIPNVVQYEDWMTVIGDHFLVAENDRTALEKKGHVLKPLAGGTICQFIIQGEDDAKELSSGIANGDLMAVSDPRKGGIPAGY

SEQ ID NO: 68101 - protein, 446 aa, Marinobacter sp. ELB17
MSNNALFYLTSNDMPLVSHADGIYIWDTTGRRYIDACSGAITCNVGHNHPTVKRAMVEQLDKVAFSYRTQFESQVALDLANRLVGLTDGELDKVFFVGSGSEAVESAIKLAVQYFVAKGQPERCKFVSLRPSYHGSTMGALGLTGYEPLEAPYRSITISSVKVPSPDLYRYQEVSVEEHIASVLEQTESAILAAGPETIAALALEPVGGASTGGRMVTKAYMEGLRALCDRYGFLFIMDEVLSGMGRTGAWFAYQHFGVVPDILALAKGLGSGYYPIAAMMARQELVDEVSRSGGFMHGHTYAGNPLACATGLAVIGVMDSEQLVNNAVEQGAYLRQQLDQLALKYDRIGNVRGIGLLQGVELVQDKASKQPFPASFNAFEKLTALAKVRGLLIYPRRCLNGLEGDHVLITPPLTVTAADIDDIIALLDDSLAAFEQVSLRQEVCS

SEQ ID NO: 68102 - protein, 259 aa, Aspergillus nidulans FGSC A4
MDLHSKLQAAWYRLINTYRPGTIELTGSIATQTVGFILPATLYLLIDTLFPEFSKRHKIQSAGRQPTRPQILHCVKVTLFNHVWVVAIHAMLVYWAGLDHAIMNLDPIVPPWREFIVDFVFALLAREILFYYIHRTLHHPRIYAYIHKMHHKYTTPVAFAGEYAHPVEHVIANILPITLPLYLKGAHYLSIIAFVSFELWEAAADHSGYDFLKLPPAELHDLHHEKFRVHYGTIGLMDWIHGTDVVGWDRPETDKRDEQ

SEQ ID NO: 68103 - protein, 546 aa, Triticum aestivum
  misc_feature (195)..(195): Xaa can be any naturally occurring amino acid
SFSFWRRIQYKPIFWLVIVSMEMASSAKWFAVALVFITVILLRVIRGRRMAAAPASEKPPPPVVNGFALLGLLPRLLTMDLRTKINCLHDKYGSVFTVSPFGLTNVTFLIGPEVQSHFFQGLESEINHGNLLEFLVPMFGQEIGQGVDAATRTEQSRFYLDALKQSKLRRHLDPMLQEVESYFGKWGPGRRSLIXKHEFEEVAHCLISSRCLLGKEVREKMFDEFYKLFRDVENGVNMISVFFPYIPIPANRRRDKARLKLIELLSGTVRSRKSSPSVEEDVLQRLIDSKYKDGRSTTETEVTGMIIALIFGGKHTSSLASTWTGACLLTHPKFLAAASQEQKEIMMKYEDKIEYDALLEMNTLHNCIKEALRLNPPTTMLVRKALKHFTVRTRQGQEYGIPKGHTLASPIIQNNYLPYIYKDPEVYDPDRFGPVRQEDVVGGKFSYTSFGGGRHFCSGDAYAYMQVKVIWSHLLNNFDLKLLSPYPKTDWSKLIPEPQGNMMVSYKRRQLLGLACYIYHLHEEHRLACLCLYGCITYYLYLCMFL

SEQ ID NO: 68104 - protein, 252 aa, Brassica napus
  misc_feature (186)..(186): Xaa can be any naturally occurring amino acid
  misc_feature (234)..(234): Xaa can be any naturally occurring amino acid
MVLSKTASESDVSIHSTFASRYVRTSLPRFEMPENSIPKEAAYQIINDELMLDGNPRLNLASFVTTWMEPECDKLMMESINKNYVDMDEYPVTTELQNRCVNMIARLFNAPLGDGEAAIGVGTVGSSEAIMLAGLAFKRQWQNKRKAQGLPYDKPNIVTGANVQVCWEKFARYFEVELKEVKLRRXEYYVMDPGKAVEMVDENTICVAAILGSTLTGEFEDVKLLNDLLVEKNXQTGWDTGIHVDAASGGFI

SEQ ID NO: 68105 - protein, 185 aa, Triticum aestivum
  misc_feature (144)..(144): Xaa can be any naturally occurring amino acid
  misc_feature (158)..(158): Xaa can be any naturally occurring amino acid
MTSVWKTKVLPGLNKIFDKDGKKAAAAEFLKSFNKEEIDKEIEDKKTELEPKVVETIEASPPEIKGLIKDKKTSKIRKNSVAVTKFLDDLAKIDFPGAKLVSDAVAKSGTTPLSPASLHLGQGCPFVPAPKEEPRSTRVAAAAXAEETTTARSVEEEXRGGDPLRPNLRPRSPWRKETTPDKKRA

SEQ ID NO: 68106 - protein, 119 aa, Trichophyton rubrum
MAAQNSAGIQTLLDAEREAQKIVQTAREYRTKRIKDAKTEAQKEIEDYKKQKEEEFRKFEAEHSSGNQKAENDANKDAEAQLLEIKKSGKEKGNKVVEDLIKTVLDVNPQVPEKLAKKA

SEQ ID NO: 68107 - protein, 328 aa, uncultured bacterium
MSLKKSSISIIKAPIEKEMKQFDSYFKESMKSKVRLLDIINNYIIKRKGKEVRPILTFLSARLLGDIQESTYVAAALTQLLHTATLIHDDVVDEAYERRGFFSINALWKSKAAVLVGDYLLSKGLLVALENKEYDQLQVVSDAVREMSEGELLQLEKSRKLDITEDVYFDIIYKKTASLIASCTQLGALSVGATKDQQEKLKRFGECLGVAFQMKDDLFDYEKQGNIGKPTGNDIKEKKLTLPLIYVLRNVSDKERKWALKIIRKHNKNSEKVNELIQFVKEKGGIDYTRDKMLEYKQKSLEILSNFPESEANTSLKELVEYTISRTK

SEQ ID NO: 68108 - protein, 631 aa, Parvularcula bermudensis HTCC2503
MGEYIVLAVTLIGILGIGAQWLAWRTNMPAIVLMSIAGLIIGPLFGILRPEEQFGDFYRPIISIAVAVILFEGGLQLKFSELRGLGRGVGQIVFIGGPLAWLFGAIAGHYVAGLDWPTAILFAGIMIVTGPTVIIPLLRQAKLSTRPSALLKWEGIINDPIGALAAVITYEFVITQYGESLPAFQVFGSLFVGTILCVVWGVLIGLGLAEVFRRGWAPEYLKAPILLSAVLLAFEMANLLQEEGGLLAVTAMGVAMANSKMPSINQIRHFKETIAVLLVAGVFVLLTANLTPQILGQIDLKIMFFVGVMLFVVRPAAIFLATIGTELKWSERALVAWIAPRGIVAVAVSGLFAASMGPDSGFEEGGLMVPLAFAMVFATVVLHGFTIAPLGKLLGLASDAPPGVLIVGASPWSIELAKKIHDLDVPVLVTDPNYRALRGARNAGIPTYYGEILSEVSEHHIEFVRYGHLLALSGNEAHNSLVCTDLAPELSHNSTYQLSAGGKDDSRTSVSFALQGRSFLSDKMGLEDLLQRHWAGWKFQFTRLSEAFPPESYLEQLDDEAIIVMVQRRQGLTFQTAESPIRLQPGDRVLSYVPPEKESRKANAPVDAEGKSEEVRQIEQRKEEVIDDVTP

SEQ ID NO: 68109 - protein, 161 aa, Brassica napus
  misc_feature (113)..(114): Xaa can be any naturally occurring amino acid
  misc_feature (152)..(153): Xaa can be any naturally occurring amino acid
MAASMQLCGVRTSGLAFDSKSIEFGSKGLNLLAPVFTRDINHSCRKNRSLRVTCEARSAELLERKNTETFKLNRTEIKLTCVMKFGGSSVASAERMREVANLILSFPDEKPVXXVLSAMGKTTNNLLMAGEKAVCCGVTNINTIEELSYIRXXHIRTAHEL

SEQ ID NO: 68110 - protein, 509 aa, Yersinia pestis KIM
MMSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 68111 - protein, 695 aa, Haloarcula marismortui ATCC 43049
MVQNLELTISVDEANESIAVPTTVGTRLGLGGNGAVLIRKQRGQVQAATVRQADSVPAETARVGPQTAETLGLRDGDRVTVEAADPAVATHISVAPVPQLSIRGGEGLVRDAVGDRPLLDGDTITVSLFDGSLTVPVRVVSTQPAGPVTLVDDTVIEITDGPAPRRSNSGLDPLAETAVGGYADTVATLETAVSTALLASDDVPGSVRNRAGVLLVGAHGVGKTHLLQHVAWLVNATIHSVDAGRLLSLDQDGARAYLDDVARAAQGSERGIVHIDGLDTVSADGGDKTRLLLRQWLDDISTLDGVAAVGEATSEDDVPVDIVQATRLSRTVTVPEPSRRDRAEILKTVATGAMVSAEADLKATGEQAFGYVAADIVALWLHAVEAAVARDGAGGDPVVVSAADLEAARDAVEPSGIRGTVPEIPSTSFSDIGGLDGPKRELIRAVNWPLTKPDLFDSLDIDPPAGVLLYGPPGTGKTMLARAVASTSDANFIPVNGPELMNKYVGESERAVRRVFDQARSNAPSIVFFDEIDALGTTRSDDNDSGASARTVSQLLTELDGIEGREGVTVIATTNRRDRLDDALLRTGRFDRIVEVSLPDAADRAEIFDTHIGDRITGQVDLEAFAARTAGYSGSDIAAVVREAGLLAIEEHLRAQGDSDRSRKPVSLRESHLEKALQSVESSGADQAGETGHRS

SEQ ID NO: 68112 - protein, 364 aa, Debaryomyces hansenii CBS767
MIRTSIRRLTISRNHDIKLPFVPLVSENGFPQAIGNTPLLRLPRISDKIGRNVYAKAEFMNPGGSIKDRAALYVINDAEEKGLIKPGGTIVEGTAGNTGIGLAHVCRAKGYKCVIYMPNTQSKNKIETLRLLGATVHPVPAVAFDNPENYNHQAKRFAESQENAAWTNQFDNVANRQAHIETTGPEIWSQLNGKVDAFTCSTGTGGTFAGVTRYLKEISNGATKCVLADPPGSVLYSYIKSNGETMERGGSSFTEGIGQGRVTDNLKQEIPLVDDALKITDEESIEMLYRLLDEEGLYIGGTGALNVVAAVKVAQSLPEGSNVVTLLADSAHKYSDRIFSKSWLQSKGLFDALPSHLKKYATLE

SEQ ID NO: 68113 - protein, 364 aa, Candida albicans SC5314
MFNTTDSSRNYLVIENPSANYISDKEEERYSNDNDIVHNSSNYYIPSLDDISSISTSASSHGTTFFSNNQSNSNRYGTPRSLSKLRSIESEIDNLPLVFKTNIWSNDYSVTHNKTANMFANFTLETGNVACSLNTANCDKSQLQYNDASYAVTTPQVSPIGNNPIAAAGNSSCTFESTTPGINANAAVSGSAYSPPPSCLTFRTYTGAIFTVPKTSKFFVIKSYNILDVNASFIHNIWTSTELGNRRLDKAYTELSKTNNPDVDGKIFLFFSVNSSGKFCGIAEMKSAIDFTTASNIWCEQTRWKGIFPVEWLLIKDVPNKFFQHLKIPANDYKLVTNSRDTQEIPFDIGISMLKIVSSFKSND

SEQ ID NO: 68114 - protein, 364 aa, Bacillus clausii KSM-K16
MEKQILLLPGDGIGPEIIAETKRVLEEIARLYHHTFQFVEGRIGGDAIDATGSPLPEETLDLAKGSDAILLGAVGGPKWDGNAPEKRPEKGLLQIRKALGLYANLRPVRVLKPLMGASTLKEEVLADVDLLIVRELTGGLYFGEPRERRQINGEDGAVDTLLYTRGEIERIVHQAFQFARTRKKRVVSVDKANVLESSRLWREIADEVAREYPDVTLSHMLVDNAAMQLIRDPRQFDVIVTENLFGDILSDEASMITGSLGLLPSASMNTSKVGLFEPVHGSAPDIAGTGAANPLATILSAAMMLQYSFGLADEAKAIEVAVDRVLAQGVRTKDIAKASENAVSTTAITNAVMEALALKSASSR

SEQ ID NO: 68115 - protein, 181 aa, Anaplasma phagocytophilum HZ
MRKIFPNLLTIFRVLAIPAVVASFYINYGACTQYVTLLIFIFACVTDFFDGYLARMWGVQSRFGRIFDPAADKLIVLSTFVMLVYTNKITGIPVLFVIIIMCREVLVSCMREFLIAANISVPVSEVGKVKTVMQMIATALLILNYEFIVRLGEIFLCIAAILSLHSMCLYTRNAIMETNKK

SEQ ID NO: 68116 - protein, 388 aa, Anabaena variabilis ATCC 29413
MKLAARVSQVTPSITLAIAAKAKAMKAEGIDVCSFSAGEPDFDTPAHIKAAAAKALDEGKTKYGAAAGEPKLREAIAHKLQKDNHLDYKPENVIVTNGGKHSLYNLIVALIDPGDEVIIPAPYWLSYPEMVTLVGGKSVIVPTDASTGYKITPEQLRKAITPKTKLFVLNSPSNPTGMVYTPEEIKALAQVVVDADIYVVSDEIYEKILYDGAQHISIGSLGKEIFNRTLISNGFAKAYSMTGWRLGYLAGPVDIIKAASSIQGHSTSNVCTFAQYGAIAALEDSQDCVEEMRQAFAKRRQVMLDRLNAIPGLSTAKPDGAFYLFPDISKTGLKSLEFCDALIEEHKVAVIPGIAFGADDNIRLSYATDLATIEKGLDRLEKFVRSRI

SEQ ID NO: 68117 - protein, 485 aa, Bacillus halmapalus
HHMGTNGTMMQYFEWHLPNDGQHWNRLRDDASNLRNRGITAIWIPPAWKGTSQNDVGYGAYDLYDLGEFNQKGTVRTKYGTRSQLESAIHALKNNGVQVYGDVVMNHKGGADATENVLAVEVNPNNRNQEISGDYTIEAWTKFDFPGRGNTYSDFKWRWYHFDGVDWDQSRQFQNRIYKFRGDGKAWDWEVDSENGNYDYLMYADVDMDHPEVVNELRRWGEWYTNTLNLDGFRIDAVKHIKYSFTRDWLTHVRNATGKEMFAVAEFWKNDLGALENYLNKTNWNHSVFDVPLHYNLYNASNSGGNYDMAKLLNGTVVQKHPMHAVTFVDNHDSQPGESLESFVQEWFKPLAYALILTREQGYPSVFYGDYYGIPTHSVPAMKAKIDPILEARQNFAYGTQHDYFDHHNIIGWTREGNTTHPNSGLATIMSDGPGGEKWMYVGQNKAGQVWHDITGNKPGTVTINADGWANFSVNGGSVSIWVKR

SEQ ID NO: 68118 - protein, 289 aa, Aspergillus nidulans FGSC A4
MGIDIDLTVAVIGCGTLGTAIAAGILDPKDKSGINIKRLIATVGTEPSKQRVRDALSTHESRLTVLTHGGNVRAIQEADVVLLAVKPFKRAEVFCAPGFKEAIRNKLVLSIMAGITTKEFARLAIGDGAAPGILQVVRAMPNMAAKIREAMTLYTPSPGTSPENLSIASWIFGQVGESHQIPEASFDICAVLVGCAGSLLLLAVDGLLDAAVAEGVRRSEVQNLVVNSAIGMLKLVPAGDHPSVLREKIASPGGCSIQALLELERLGARSAFTRAIMAAAEKSKAMSSS

SEQ ID NO: 68119 - protein, 172 aa, Bacillus clausii KSM-K16
MKRTITVLVNNKSGVLNRMTGLFARRQYNIDSITVGVTENPTISRMTFVVFVDSMENVEQMIKQLHKQVDVLKIKDITDEAIVERELALVRVGATPQQRGEIASLAETFRAQAVDIGKESMTLQITGNNEKIEAFIELVKPYGIQELARTGVTAVNRSSKVSTDTSRLTLIN

SEQ ID NO: 68120 - protein, 499 aa, Propionibacterium acnes KPA171202
MSHMDSATQATTPTEGPTEEPQLQRGLKNRHLQLIAIGGAIGTGLFLGSGKTISLAGPSILLVYLIIGAVLFFVMRAMGELLLSNLAYKSFADFATDLVGPGAGFYMGWTYWMCWVVIGNADTIAMCGYLAAWFPHLDKWIPATCIVLLLTCLNMVAVKLFGEMEFWFAMIKIVTIIALILVGGYLAITGFQPPRSGVPAASFSHLWDRGGFFPTGFMGFIAGFQIAIFSFQGIEMAGTAAAETADPEHNLPKAINSIPARVLIFYVLALGVIMAVQPWDLINPQASPFVEMFSFIGILIAFHIVNFVVLTSAASSANSGVFSTSRILYGLAREKDAPPVFAKLSSRHIPRNALILTAMCIAPAIVLVTLEDSVMDAFSLVAGVSSVLYLSVWGLILVCYLKYLGKHPQRHAESAFKMPAGRVMSWVGILFFITILIMLGFSADSRQALIAAPVWVIFMMVLYRLLASTRADHTRIDFDAERIRALEELHRTQEDEHQA

SEQ ID NO: 68121 - protein, 1137 aa, Ustilago maydis 521
MSFSSEKGSSRRGSISLASKRRGSGTEKLETHHELRSFNCTSIGLAISTCSLETPTIWSLSSPTLLSSFFFSPIVTMSYLLQASLSLCVERAALTLNSLVKSSLTKQIASWHTSSHKHEENPHAHEEQLKQTYERFEKLFTITPQRLRMITDRFVGVLEEGLQKDGQTVPMLPAYVFGWPTGDEVGSYLALDLGGTNLRVCHVVLKGAGKFEITQSKFRLTEEQKQTEGQELFDFCADCLATFIKDHFGDQNGDVILEEELALGFTFSYPMEQDKIDHGKLVRWTKGFGNPNTEGRDCAAMFRKSLDKFNLPVKMVSIINDTTGTLIASNYVNRETRIACIFGTGCNAAYMEHMKDIPKIKHLGLPEEEDMAINCEYGAFDSFQHEHMAEIRTKYDEHIDLHSNKPHEQSYEKMIAGLYLGEIFRLCICDLIDEGTLFLGQNTYKLEKTNAFDTAFLSLIESDPTDELLTVTGLFTHFFGIDTTIEERQFFRKLAKLIGTRSARLSSCGIAALVTKMGYLDKGCGVGADGSLYSKYPGFADRLHQALEDIFGEKGRNIRTYQAEDGSGVGSAIIAAMTKARKEEGKTLELTSLSDGYAQDRAEMREVARSLVLPFLLGWVWCIGLRDATFTIRDYDINTLQRKEKKRNSRDCRLRVAGNVCIAEKSPVSSCSCQLPHSRAIRTKANLGMCCEFWWSFMIELVGRFLVLMRQRMSVHCDRPNLRNIAVVEGGNRALHRRLEDVMKSCIAAQKSTVLSGTFSGTLTRNIRRGQFVPTARAPALAVGLYKLASSSHHPIIPATILSSRSITSFATMPATHFKLNSGASIPSVGLGTWQSPKGEVRDAVCHALKSGYRHIDCAWGYQNEDEVGEGIKLSGVPREEIWITSKLFEFHHNHVRQAVQDTLDKLDVKYLDLYLMHWNIAFVPEDVPAGQLPRDSKKDPATGKHLLDLETTENFVKVWAELEKLVDEGIVKNIGISNFSIRRTKELLKSCRIKPVVNQVELSFTFPQPELVGWLKKQDILPQAYSPLGSTGASQASLSVVDEIAKKHGVQGANVLISWQVARGCNPLPKSVTPARIENNIKLIDLSAEELDQLEKGALAQTPKKVCDQSDLVVPSYDIFEANNPTNNDKVQAAQD

SEQ ID NO: 68122 - protein, 174 aa, Triticum aestivum
MAPAVMASSATTVAPFQGLKSTAGLPVGRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 68123 - protein, 611 aa, Propionibacterium freudenreichii subsp. shermanii
MAENNNLKLASTMEGRVEQLAEQRQVIEAGGGERRVEKQHSQGKQTARERLNNLLDPHSFDEVGAFRKHRTTLFGMDKAVVPADGVVTGRGTILGRPVHAASQDFTVMGGSAGETQSTKVVETMEQALLTGTPFLFFYDSGGARIQEGIDSLSGYGKMFFANVKLSGVVPQIAIIAGPCAGGASYSPALTDFIIMTKKAHMFITGPQVIKSVTGEDVTADELGGAEAHMAISGNIHFVAEDDDAAELIAKKLLSFLPQNNTEEASFVNPNNDVSPNTELRDIVPIDGKKGYDVRDVIAKIVDWGDYLEVKAGYATNLVTAFARVNGRSVGIVANQPSVMSGCLDINASDKAAEFVNFCDSFNIPLVQLVDVPGFLPGVQQEYGGIIRHGAKMLYAYSEATVPKITVVLRKAYGGSYLAMCNRDLGADAVYAWPSAEIAVMGAEGAANVIFRKEIKAADDPDAMRAEKIEEYQNAFNTPYVAAARGQVDDVIDPADTRRKIASALEMYATKRQTRPAKKPWKLPLLSEEEIMADEEEKDLMIATLNKRVASLESELGSLQSDTQGVTEDVLTAISAVAAYLGNDGSAEVVHFAPSPNWVREGRRALQNHSIR

SEQ ID NO: 68124 - protein, 285 aa, Populus trichocarpa
MAKDMEVAEAGSFSAKDYHDPPPAPLFDAKELTKWSFYRALIAEFIATLLFLYITVLTVIGYKSQIDGSADSCGGVGILGIAWAFGGMIFVLVYCTAGISGGHINPAVTFGLFLARKVSLIRAVMYMVAQCLGAICGVGLVKAFQKSYYKKYGGGANTLADGFSTGTGLGAEIIGTFVLVYTVFSATDPKRSARDSHVPVLAPLPIGFAVFMVHLATIPITGTGINPARSLGAAVIYNQDKAWDGHWIFWVGPFAGAAIAAFYHQFILRAGAVKALGSFRSAQRF

SEQ ID NO: 68125 - protein, 313 aa, Oryza sativa
MEVFENARSVRLRSHLGTYLCAADDGGGGGGEAVTHGYRRNCRGTVWAVETSGDDYVRLQGHRGLYLCATELPAALDGGCRGSAACCWVIQAGSPPSPNDGAFLWTPRREGEHLTLTGLYGRLLRARFGLTPRENAVTVDRDAAPEESSWVVEVVPESEAPPPRCRALSCDARLEAATSEPDTAFTTAFVRFYSAKELKVVKPPPPPEEGEEEEEPPSEAAPGALVARTIFYNTARDDGRVDDFDQGTWRYFTFKEQSLAALRRRLEEEARREDFVVCRRRCAAPPPGLFPVVLDLPPGNRDMEFVLVLHSSR

SEQ ID NO: 68126 - protein, 259 aa, Oceanobacter sp. RED65
MELDIYQVDAFAKKVFEGNPAAVCPLEEWLTDDIMQSIAAENNLAETAFFVPNENGFYIRWFTPTKEVSLCGHATLASAHILFSELNYQGESIVFDCMSGELIVKKAETGYEMDFPSQPGEVCDKFDEAEEIFSKRPIACLKHEDYVLVFDDEEFIRNANFDISLLKAWDLRGVMITAASTEYDFISRFFAPNYGINEDPVTGSSFTKLIPYWADKLNKQTMFAKQLSPRGGEVHCQLNNDRVLISGGAITYLKGKIIV

SEQ ID NO: 68127 - protein, 527 aa, Populus trichocarpa
MHSNHLLLEEPIRMASILEPSKSSFFPAMTKIVGTLGPKSRSVEVISGCLKAGMSVARFDFSWGNPEYHQGTLENLKAAVKTTKKLCAVMLDTVGPELQVVNKSGNPISLLADGFVILTPDQEQEASSKVLPINFDGLSKAVKHGDTIFVGQYLFTGSETTSVWLEVSEVKGNDVVCVIKNSATLAGSLFTLHASQIRIELPTLSDKDKEVISTWGVQNKIDFLSLSYTRHAEDVRNAREYLSKLGDLYQTQIFAKIENIEGLTHFDEILQEADGIILSRGNLGIDLPPEKVFLFQKAALYKCNMAGKPAVVTRVVDSMTDNLRPTRAEATDVANAVLDGSDAILLGAETLRGLYPIETISTVGKICAEAEKVFNQDLYFKKTVKYVGEPMTHLESIASSAVRAAIKVKSSVIICFTSSGRAARLIAKYRPTMPVLSVVIPRLKTNQLKWSFSGAFEARQSLIVRGLFPMLADPRHPAESTSATNESILKVALDHGKASGVIKSHDRVVICQKVGDASVVKIIELED

SEQ ID NO: 68128 - protein, 89 aa, Glycine max
  misc_feature (65)..(65): Xaa can be any naturally occurring amino acid
  misc_feature (81)..(82): Xaa can be any naturally occurring amino acid
  misc_feature (84)..(84): Xaa can be any naturally occurring amino acid
FKGYRNENWQENDGTLNTTSMTHPRLPIEQPNCLIKPDSHCELLQPGIRHYKFIEGDHITFIIAXRTFDLIYDNIFKNLQXXMXGRNLG

SEQ ID NO: 68129 - protein, 767 aa, Potamogeton distinctus
MGEALMSETVSEVLIPLAAVIGIAFSLAQWYLVSRVKVIGADPVQRARSERKNGLGDYLVEEEEAIDDQSVIDKCADIQKAISEGATSFLFTEYKYVGMFMTAFAVLIFLFLGSVEGFSTKSQPCTYTKDTMCKPALANALFSTVSFLLGAITSVVAGFFGMKIATYANARTTLEARKGVGKAFILAFRSGTVMGFLLAASGLLVLYVAINLFKIYYGDDWEGLFEAITGYGLGGSSMALFGRVGGGIYTKAADVGADLVGKVERNIPEDDPRNPAVIVDNVGDNVGDIAGMGSDLFGSYAESSCAALVVASISSFGNNHEFTAMCYPLLISSMGIIVCLLTTLVATDFFEIKSVKDIEPTLKKQLIISTALMTVGIAIVSLLALPSTFTIFDFGVQKEVKNWELFFCVSVGLWAGLIIGFITEYFTSNAYSPVQDVADSCRTGAATNVIFGLALGYKSVIIPIFAIALSIYISFSIAAMYGIAVAALGMLSTIATGLAIDAYGPISDNAGGIAEMAGMSHRIRERTDALDSAGNTTAAIGKGFAIGSAALVSLALFGAFVSRAAISSVDVLTPKVFIGLIVGAMLPYWFSAMTMKSVGSAALKMVEEVRRQFNTIPGLMEGTVRPDYASCVKISTDASIREMIPPGALVMLTPLIVGTFFGVETLSGVLAGALVSGVQIAISASNTGGAWDNAKKYIEAGASEYARSLGPKGSDAHKAAVIGDTVGDPLKDTSGPSLNILIKLMAVESLVFAPFFAVHGGILFKLF

SEQ ID NO: 68130 - protein, 475 aa, Vitis vinifera
MMSEVLVCFIALLVTWISHLVHGWWLNPKCKGRLPRGSMGLPIIGETIPFFSPHSFYGIPHFISKRMTKYGSVLKTSLVGNLVVVSGDSELNQYIFKEGKSVYCSYKESALKIMGEQSLLAYHGVFHKYLKNLTLSMIGPESLKEVLLHETDAITRKYLHSCSNYASFDVKEESANMVFEYFAKKLFGCEEAKAYRRNLRESYKAFLDGIISFPLNIPGTAFHACLKGRENAIKVINNVINERKSSQKLCHDFLDFLLEEAKSKDTILNEAIIVDLVFLLLFASYETTSEAITLVMKFLSDHPSVVVELTKEHEEILKNRKNEELGITWTEYKSMTFTHMVINETLRLGNIVPGIFRGVTKDIEMKGTTIPAGSTVMVCPSAVHLNPAKYNDPLAFDPWRWEGQELHAGSKNFVAFGGGSRLCAGAHFAKVQVAVFLHYLVTKYRWKKIRGGDIIRKPGLVFPDGLHIQISAKYK

SEQ ID NO: 68131 - protein, 205 aa, Candida albicans SC5314
MGQEVEGDSVGDEFKGYIFKITGGNDKQGFPMKQGVMHPTRVRLLLSKGHSCYRPRRTGERKRKSVRGCIVAQDLSVLALSIVKQGDNEIEGLTDTTVPKRLGPKRANHIRKFFGLTKEDDVRDFVVRREVTKGDKTYTKAPKIQRLVTPQTLQRKRALKAKKVKNAQQQRDAAAEYAQLLAKRLHERKEERAEIKKKRAESLKN

SEQ ID NO: 68132 - protein, 419 aa, Pyrococcus furiosus
VEADPYEIVIKQLERAAQYMEISEEALEFLKRPQRIVEVTIPVEMDDGSVKVFTGFRVQHNWARGPTKGGIRWHPEETLSTVKALAAWMTWKTAVMDLPYGGGKGGIIVDPKKLSDREKERLARGYIRAIYDVISPYEDIPAPDVYTNPQIMAWMMDEYETISRRKTPAFGIITGKPLSIGGSLGRIEATARGASYTIREAAKVLGWDTLKGKTIAIQGYGNAGYYLAKIMSEDFGMKVVAVSDSKGGIYNPDGLNADEVLKWKNEHGSVKDFPGATNITNEELLELEVDVLAPAAIEEVITKKNADNIKAKIVAEVANGPVTPEADEILFEKGILQIPDFLCNAGGVTVSYFEWVQNITGYYWTIEEVRERLDKKMTKAFYDVYNIAKEKNIHMRDAAYVVAVQRVYQAMLDRGWVKH

SEQ ID NO: 68133 - protein, 426 aa, Oryza sativa
MAAAEEGQWVLMATGRSPTNIAVIKYWGKRDEALILPVNDSISVTLDPDHLSATTTVAVSPSFPSDRMWLNGKEISLSGGRFQSCLREIRKRAQDVEDEKKGIRIKKEDWGKLHVHIASFNNFPTAAVFTLGKLMNVKEDHGELSSIARQGSGSACRSIYGGFVKWCMGKNNDGSDSIAVQLADEAHWNDLVIIIAVTVVPERVLKMEEAIKSRNFESFARIISLVEKWNQSEGTPQVAYTFDAGPNAVLIAPNRKNATILLQKLLYYFPPQDNDLSSDDAALLAVLSNAAELGCYAPALRLDSAARRPLSSSLSKDDGAARWTCRAAVDLARVVESAAPEEMPPPLTVDEEVRLECFAKSSGAVLFRLYHGCLFELSLATMEVRMTVKMKPVVALFLVTVLIASHGAMMQWAAEAETCNYPIYKC

SEQ ID NO: 68134 - protein, 388 aa, Oryza sativa Japonica Group
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 68135 - protein, 149 aa, Staphylococcus aureus subsp. aureus MW2
MERTFLMIKPDAVQRNLIGEVISRIERKGLKLVGGKLMQVPMELAETHYGEHQGKPFYNDLISFITSAPVFAMVVEGEDAVNVSRHIIGSTNPSEASPGSIRGDLGLTVGRNIIHGSDSLDSAEREINLWFNENEITSYASPRDAWLYE

SEQ ID NO: 68136 - protein, 459 aa, Prochlorococcus marinus str. MIT 9215
MIKKILEFEFDLIVVGAGSGGLAAAKRAASYGAKVAIIEANQIGGTCVIKGCVPKKLMVYAAKSKKNMDYSEGYGLKNEGINFESNILLKNIREEVSRLSNLHRNSLKKLNIAIFEGLGRFITQNELEIICSNTKKIKNKISSKKILISVGGKPKKLNIPGVDLAWTSDDIFELEKFPKSILIVGGGYIACEFASIFRNLGTEVTQLIRGQHLLNGFDEDLSSCLEESPTFTEINIISNTKLKSIKKVNGNLESTLDSGDKLLTNNILIATGRKPNLLPLNLDFLNLKMDGQYLDVDELNQTSNANIFAVGDIINKPNLTPVAIEQGRVFSDNFFNDQKRKVNYEYIPKAVFTIPEISTVGLSEKRAKEIYSEKNIKIFKCKFTPMSNVFRENKSKCMLKIVVHKPTDKVLGCHMFGETSSEIIQMVSISLNAGITKKDFDITMALHPTISEEFVTMYG

SEQ ID NO: 68137 - protein, 288 aa, Solanum tuberosum
MAENKEEDVNLGANKYRETQPLGTAAQTDKDYKEPPPAPLFEPGELSSWSFYRAGIAEFMATFLFLYITILTVMGLKRSDSLCSSVGIQGVAWAFGGMIFALVYCTAGISGGHINPAVTFGLFLARKLSLTRAVFYIVMQCLGAICGAGVVKGFMVGPYERLNGGANVVNPGYTKGDGLGAEIIGTFVLVYTVFSATDAKRSARDSHVPILAPLPIGFAVFLVHLATIPITGTGINPARSLGAAIIYNKDEAWNDHWIFWVGPFIGAALAAVYHQIIIRAIPFKSSRS

SEQ ID NO: 68138 - protein, 174 aa, Potamogeton distinctus
SLLLKKEKAIIVQPDRIIVANGPTFGCILMKDFLRALAKRLKKNTTAYDNYCRIYVPDGVPLECKANEPLRVNVLFKHIQDMLSSDTAVIAETGDSWFNCQKLKLPKGCGYEFQMQYGSIGWSVGATLGYAQAAKDKRVIACIGDGSFQVTAQDVSTMLRCGQNCIIFLINNGG

SEQ ID NO: 68139 - protein, 180 aa, Mycobacterium avium 104
MTDAGEATPVAELIASLTRQVPDFPKPGIQFKDLTPLFADATAMTAVTGALARHASGADLVAGIDSRGFLVAAAVADRLHTGVLAIRKGGKLPPPVHAERYDLEYGSATLEIPADGIDLRGRRIVIIDDVLATGGTLAAAARLLRRTGATVTAAAVVFELGALGGRAALAPLPVHRLTCQ

SEQ ID NO: 68140 - protein, 319 aa, Zea mays
GIDIKEMLVGAALMDEETRNTVVKANPAALLALCWYWASEGIGKKDMVVLPYKDSLLLLSRYLQQLVMESLGKEFDLDGNRVNQGLTVYGNKGSTDQHAYIQQLREGVQNFFVTFIEVLRDRPAGHDWELEPGVTCGDYLFGMLQITEVYNILQGTRSALYANDRESISVTVQEVTPRAVGALVALYERAVGLYASLVNINAYHQPGVEAGKKAAGEVLALQKRVLTVLNEATCKDPCEPLTIDEIADRCHCPEDKHNAFPPSITHAQRLLPQIEMIYKIVQHMAANDRAIIAEGSCGSPRSVKVYLGECNVDEDLQAA

SEQ ID NO: 68141 - protein, 336 aa, Triticum aestivum
MGSAASAASDAAPPPPSPAQPHGAAPPYGVGLAGILPQKPDGDDKKEEKVDYLNLPCPVPYEEIQREALMSLKPELFEGLRFDFTKMLTQKFALSHSVLMGSLEVPSQSADVIKVPTSQYEFGANFLDPKLMLIGRLMTDGRLNARVKCDLTENLALKINAQLTSEPHYSQGMFNFDYKGTDYRAQFQIGNNAFYGANYIQSVTPNLSMGTEIFWLGQQRKSGIGFNSRYNTDKMVGTLQVASTGIVALSYVQKVSEKVSLATDFMYNHMSRDVTSSVGYDYILRQCRLRGKVDSNGVVAAYLEERLNMGVNFLLSAEIDHPKKNYKFGFGMTVGE

SEQ ID NO: 68142 - protein, 82 aa, Potamogeton distinctus
NVIKNWNYTGLVDAIHNGHGKCWTTKVVYEDELKTAIKKATEEKEDCLCFIEVMCHKDDTSKELLEWGSRVSAANSRPPNPR

SEQ ID NO: 68143 - protein, 330 aa, Vitis vinifera
MVAAHVGLVSSGCCFPSLPWFPSLSFPKTKPFVMAALGEDPIREWILSEGKATQITRISPVGGGCINLASRYDTDAGSFFVKTNRSIGPSMFEGEALGLGAMYETKSIRVPRPFKVGPLPTGGSYIIMEFIEFGRSRGDQAVLGRKLAEMHKAGKSEKGFGFDVDNTIGSTPQINTWTSDWVKFYAEHRLGYQLKLALDQYGDSTIYAKGEKLMKNLGRLFENVEIEPCLLHGDLWSGNISSDKNGEPVILDPACYYGHNEAEFGMSWCAGFGGSFYNAYFEVMPKQAGFEKRRDVYMLYHYLNHYNLFGSGYRSSAMSIIDDYLRIFNI

SEQ ID NO: 68144 - protein, 290 aa, Picrophilus torridus DSM 9790
MDHDVKEKYLQAGKIGKMALDYAQSLIEPGALFYDVAEKTEAFIRDNGALPSFPVNLSINNEAAHYTPYENDKKKFKTGDLVKVDLGAMIDGYMSDNATTVEVGNTGKFSDLIDATREALNNAIKMIRPGIELYNIGNTIADTINSYGFNPVKNLGGHGINRYDLHSEIFIPNYNDGNGERLKIDKVIAVEPFASTGIGMIHNGMPGNIYIVEETRIDKNEEIYKNFNTIPFAERWVAKLMPDYKEYIRKKLNERYISAFPVLKEHKNSYISQAEHTIMVLSDEIIVTTK

SEQ ID NO: 68145 - protein, 288 aa, Zea mays
MDGLVAPSPSHSGATSGGGASHRKRKLPPSSLSDATGDEDDDTTAPSSPSTAPSSPSRPSSPSSSHSDDDDDDSLHTFNAARLDGAPSGGSASGRPPKPDSSSVSAAAAAAAAAVGGGPKPEPGSANAGDGKEDTKGLFTDNLQTSGAYSAREEGLKREEDSGRLKFLCYSNDGVDEHMIWLVGLKNIFARQLPNMPKEYIVRLVMDRTHKSMMVIRNNIVVGGITYRPYASQRFGEIAFCAITADEQVKGYGTRLMNHLKQHARDADGLTHFLTYADNNAVGYFVKQ

SEQ ID NO: 68146 - protein, 175 aa, Zea mays
MEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAAISKGGKVGPNRCSACRKRVGLTGFNCRCGNLYCALHRYSDKHDCKFDYRTAARDAIAKANPVVKADKLDKI

SEQ ID NO: 68147 - protein, 1501 aa, Debaryomyces hansenii CBS767
MSSTSNSVEHKSKFEDSNSVTEFVPSADQSSVPQYEGFDDATNDIKELARTMSNISRQQTNKTKGSEDLIRYLSHMSQVPGVEPYNNEIEDTLNPDSDNFNAKYWVKNLRKLHDSDPNYYKPSSLGIAYRNLRASGVAADSDYQPTVDNALYKLGGEAFRSLQKDDPSRYFDILKSMDGIMRPGEVTVVLGRPGSGCSTLLKTIASHTYGFKIGEESKISYDGLTPKDIENQFRGDVVYSAETDTHFPHLTVGDTLEFAAKLRTPQNRGNIDRETYAKHMASVYMATYGLSHTRNTNVGNDFVRGVSGGERKRVSIAEVSLCGSNIQCWDNATRGLDSATALEFIRALKTSATILDATPLIAIYQCSQDAYDLFDNVVVLYEGHQIFFGKADEAKEYFINMGWECPQRQTTADFLTSLTNPAERTPRPGFENSVPYTPKEFETHWKNSPQYKKLVEDIEEYFQKTDSDSHGEEYHQAHVARQSNHISPKSPFTVSFFMQTRYIMGRNILRLKGDPSIAIQSIFGQAVMGLILSSVFYNLQPVTDSFYYRGAAMFFAVLFNAFSSLLEIMSLFEARPIVEKHKQYALYRPSADALAGIITELPTKLFMSMSFNFVFYFMVHFRRDAGRFFFYWLMCIMCTLVMSHLFRSLGAVSNSLAGAMTPATVLLMAMVIFTGFVIPTPNMLGWSRWINYINPVAYVFEALMTNEFSGRDFECSQFVPAGPSYQGISPDQRICSTTGSRPGSEVVRGSEYLATSYEYYASHKWRNFGITVAFVVFFLFIYISLTEFNKGSMQKGEVALFLKSSLTDQKKKSGKSETTSKDIENSAIPDEKISQKDQLEANKETETAEKALPSSNDIFHWRDLTYQVKIKSEDRVILNHVDGWVKPGQLTALMGSSGAGKTTLLNCLSERVTTGVISDGVRMVNGHSLDSSFQRSIGYVQQQDLHLPTSTVREALRFSAQLRQPNSVTTKEKNDYVEYIIDLLDMYPYADALVGVAGEGLNVEQRKRLTIGVELVAKPKLLLFLDEPTSGLDSQTAWSICKLMRKLADHGQAILCTIHQPSALLLQEFDRLLFLQKGGKTVYFGDLGENCQTLINYFQKYGAHHCPEEANPAEWMLQVVGAAPGSHANQDYHEVWRSSSEYQGTQAELDNMERELVNLPVDESPEAKKSYAAPIWKQYLIVTKRVFQQNWRSPTYIYSKLFLVVSSALFNGFSFFKADRSMQGLQNQMFAMFMFLIPFNTLVQQMLPYFVKQRDVYEVREAPSKTFSWFAFVAAQITSEVPYQIFCGTIAFLCWFYPVGFYQNAVPTNSVDQRAVLMWMYICSFYVYTSTMGQLCMSFNELADNAANLATLLFTMCLNFCGVLAGPDVLPGFWIFMYRCSPFTYFIQGMLSTGLANTNAECSKAEFLHFKPNEGQSCGEYMSDYIKQAGGYLVDEKASSECQFCPMASTNDFLASVNSFYDERWRNWGIFICFIAINIILTIFFYWLARVPKGNREKKKK

SEQ ID NO: 68148 - protein, 275 aa, uncultured bacterium
  misc_feature (32)..(32): Xaa can be any naturally occurring amino acid
  misc_feature (197)..(197): Xaa can be any naturally occurring amino acid
  misc_feature (237)..(237): Xaa can be any naturally occurring amino acid
  misc_feature (241)..(241): Xaa can be any naturally occurring amino acid
MSAEQPRLILNSGQSMPQLGLGAYKVNQDIAXQLVQHALEIGYRRIDTAALYDNEAEVGAAVRKSGLAREEVFVTSKIWNDRHGYHEAKEAIQESIDRLNIDYVDMMLIHWPCPKQDKFVETWHAFEEVLETGLVKGIGVSNFNQPHLEKLLQHSNITPAINQVELHPQLAQNGLREFNERHGIRTEAWAPLGRARXMQHPLLVEIABSLGKSVAQVIIRWHLQIGNLVIPKSSNPXRLAXNFDVFDFELSHHNMSIIATLNTETRIATNPDDMN

SEQ ID NO: 68149 - protein, 573 aa, Bacillus clausii KSM-K16
MLHSLKGIAASAGVAIAKAFVHEEPDFTIKQKEAKNPSDEIKRLDEALAISREELTAIKEKALNELGEDKAEIFSAHLLVLSDPELVDAVKAKVNEDSVTAEFALNEVANMFITMFENMDNEYMKERAADIRDVSRRVLGHLMGIEVVSLAAIEEDTIIIAHDLTPSDTAQLNPDVIKGFATNIGGRTSHSAIMSRSLEIPAVVGTKEATAKIENGALVIVDGIDGHVIVNPTEEELAAYEQKQADYEAQKAEWAKLVNKKTTTQDTHHVELAANIGTPKDLDGVINNGAEGIGLYRTEFLYMGRTELPSEEEQYEAYKEVVERMDGKPVVIRTLDIGGDKELPYLDLPHELNPFLGHRAIRLCLEKQDMFRAQLRALLRASAHGNLKIMFPMIATLEELRQAKQILHEEKDKLQASNVDVSDEMEVGIMVEIPSTAVAAPQFAKEVDFFSIGTNDLIQYTMAADRMNERVSYLYQPYHPAVLRLIDMVIQAAHAEGKWVGMCGEMAGDEIAIPLLLGLGLDEFSMSATSILPARSQISKLSKAELESFAQEALTKDTADGVEQLVRSKYSQS

SEQ ID NO: 68150 - protein, 76 aa, Brassica napus
PNAYERLLLDAIEGERRLFIKSDELDAAWDLFPPALKELEQKKIVPELYPYGSRGPVGAHSLAFKDNVRWGDFENA

SEQ ID NO: 68151 - protein, 326 aa, Anaplasma phagocytophilum HZ
MTRTVVIEKTGGPEVMQFVDVEIGEPGRGEVLVEHTAIGLSRFDVECRAGIRKVKSLPYTPGVQAVGVVKKVGPDVEALNIGDRVGYCTASGGSYSEERIIDQKYLFKISDVVNDEVAAACIFKAMTAHYLTHRVYDVRPGTFALVYGVSGGVGNIICQWARHKGCEVIGVVGSDGYGVNIARDAGCSYVVNRSDPGVAKEILSITKGKGVNVVYDPIGREVCHLSFSVLGFFGLYISYGQISGPIRNINMSTLGTRSWFVAAPQLQHYKRSRLELALTAMEVFEVVRRGHIKVDVGRVYSFQDIEKAHRDLENRKLSGHCIIRMK

SEQ ID NO: 68152 - protein, 1499 aa, Debaryomyces hansenii CBS767
MSTGSLSSAGRETKDINSQYELTDSSENNEIHEYEGFDNTATGDIRELARTVSHISREQTNKTSDSEDIVRYLSHFSSIPGVEPYTEAEDTLNPDSDLFDARLWVKNLRKLHDSDVEYFKPSSLGVAYRNLRACGVAADSDYQPTVLNGITKYLTDGFRYLQKDDPSRYFDILKSMDGIMRPGEVTVVLGRPGSGCSTLLKTIASHTYGFKIGEESKISYDGLTPKDIENQFRGDVVYSAETDTHFPHLTVGDTLEFAAKMRTPQNRGNVDRETYAKHMASVYMATYGLSHTRNTNVGDDFVRGVSGGERKRVSIAEVSLCGSNIQCWDNATRGLDSATALEFIRALKTSATILDATPLIAIYQCSQDAYDLFDNVVVLYEGHQIFFGKADEAKEYFINMGWECPQRQTTADFLTSLTNPAERVPRPGFENSVPYTPKEFETHWKNSPQYKKLVEDVEEYFQKTDSGNHGEEYHKAHVARQSNHISPKSSFTVSFFMQTRYIMGRNILRTKRNPSVAIQSIAGQAFIGITLGSMFYNLSATTETLYYRCATLFGAVLFNAFSSILEIMSLFEARPIIEKHKQYALYRPSADALAGIITELPTKLALSIAFNFFIYFLSNLRRDAGRFFFFWLMCCMCTLVMSHLFRSLGAISTSFAGAMTPATVLLLAMVIFAGFVLPTPSMLGWSRWINYLNPIAYVFEALMANEYTDRDFECSQFVPSGPGYEDRNSVHRICAATGSKAGSDVLHGDDYLSVSYEYYNFHKWRNFGITVGFIIFFLFVYITLTEFNKGSMQKGEVALFLKSSLTDQKKKSGKSETTSKDIENSAIPDEKISQKDQLEANKETETAEKALPSSNDIFHWRDLTYQVKIKSEDRVILNHVDGWVKPGQLTALMGSSGAGKTTLLNCLSERVTTGVISDGVRMVNGHSLDSSFQRSIGYVQQQDLHLPTSTVREALRFSAQLRQPNSVTTKEKNDYVEYIIDLLDMYPYADALVGVAGEGLNVEQRKRLTIGVELVAKPKLLLFLDEPTSGLDSQTAWSICKLMRKLADHGQAILCTIHQPSALLLQEFDRLLFLQKGGKTVYFGDLGENCQTLINYFEKYGAHHCPEEANPAEWMLEVVGAAPGSHANQDYHEVWKNSTEFQTVKDELANMETELVSLPRDESPEAKKSYATPIWKQYLIVTKRVFEQNWRSPIYIYSKVFLVVSSALFNGFSFFKADRSQQGLQNQMFAVFMFLVPFNTLVQQILPGFVKQRDVYEVRESPSKTFSWFAFITAQITSEIPYQVLVGTIAFLCWYYPVGFYENSVPTNTVDGRAVTMWLYITAFYVYTSTMAHVCISFNELADNAANLAINFFTMCLHFCGVLISPEAMPGFWVFMYRVSPLTYVVQGMMSTGLANNGLQCSSKELLRFEPTSGNTCGEYMSDYISQAGGYLVDSYATSECEYCTMNSTNDWLATFNAYYSERWRNWGIFLCYIAFNMIITVFLYWLARVPKGNREKKK

SEQ ID NO: 68153 - protein, 496 aa, Magnaporthe grisea 70-15
MLLFLVVVLVVSGVRSIRSISARRRFIAENNCKPAPAWPQKDPILALDFILKGLANFKQKKFLDGWTKYYEDLGPTFTTKSAGMLYINTIDPENIKTVLATRFRDFSLAERVEIMGPLLGRGIFVTDGDEWAHSRALLRPNFAKEQVADLGMIDRHFSDLMALLRPHAADGTTVALQPLLMRMTMDTATEFLFGQSTRTLSVEQADSAGNAFSRAFQFSLNEMAHLFRLGPFRILRRQSRELKDSHDICRAYVDGFVDEAWAWKQGGKTDGRTNFLRDLVESTDNKQKVRDELLNILIAGRDTVASVLGSLFRVLAQRPEIWAKVRAEVAQFEGELPRYDQLRDLKYAKYCINEALRLWPAVPLNGRLAVRDTVLPRGGGPNGDEPVYVPKGSLVNYSVYSMHRRTDFYGADAEEFRPERWEGKIQGWQYLPFNGGPRICLGQQYALTEMLVVLVRFAQEFSHIESRESTPWQEELHLTVQPANGVQVALTAANTA

SEQ ID NO: 68154 - protein, 332 aa, Staphylococcus aureus subsp. aureus MW2
MTKITVFGMGSFGTALANVLAENGHDVLMWGKNQDAVDELNTCHTNKKYLKYAKLDVNIIATSDMTKAIQFADIYLMALPTKAMREVASQINDKLTSKKTFIHVAKGIENGTFKRVSEMIEDSISPEYNAGIGVLSGPSHAEEVVVKQPTTVAASSKDKSVSKLTQDLFMNDYLRVYTNDDLIGVELGGALKNIIAVASGIVAGIGYGDNAKAALMTRGLAEISRLGEKLGADPMTFLGLGGIGDLIVTCTSTHSRNFTLGYKLGQGESMDQALSEMNMVVEGIYTTKSVYHLAKEKNVDMPITNALYRVLFENISVKECVKDLMERDKKSE

SEQ ID NO: 68155 - protein, 355 aa, Physcomitrella patens subsp. patens
MVFLRANFHLAKKFGGGSGNMTLDEAERQTHQELERLYMSTRAAKHFQKDVVKGVEGFVSTGKKQLEVESRLAEGCKKYGLEGPSITQNLSRATQHYSSAKNRMEKERENFHRVLASQVVEPLKAMVHGAPLVDARHLKQKYDRLCQEVGERAFDVNRRKSKDANGNPEHAAKLRAAQQKLEENTSAMSAMGKNATSAMTLVEFQQQQTNLQKMLALVAAERAYFQRVTSILDTLHHEIESEVRKASNPSNYGDGASRNSYHGAGPVPEISYPETLYLENTPTVKGIPYQETQDDGELSLSVGDEVLVREVSSSGWSQGECNGQSGWFPSTYVERKQPIRKGRRRPGSGHGSGGS

SEQ ID NO: 68156 - protein, 273 aa, uncultured bacterium
MASPLVTLNDGRLMPQLGLGVYKVNQDIAVQLVQTAIEIGYRRVDTAALYDNEAEVGAAIRKSGLDREEIFVTSKIWNDRHGYHEAKDAIQESVDRLNIGYVDMMLIHWPCPKQDKFVETWHAFEEVLETGLVKSIGVSNFHQHHLEKLLAAANVVPAINQVELHPQLAQNSLRHFNKQHNIKTEAWAPLGRAKFLENPLLVEIAESLGKSVAQVIIRWHLQLQNLVIPKSSNPDRLAENFDVFDFELSQHQMGIIATLNTETRIATNPDDMN

SEQ ID NO: 68157 - protein, 528 aa, Gibberella zeae PH-1
MADTKKTQAVDGLRGQPYDDFNSDERPVADNGSTIDAQNFAFTEDRKIGVTGAVFLILNKMIGTGTTGSVGICLMLWIIGGFLTFCGLSVFLEFGLAIPRSGGEKNYLERVYRHPKYLATCVLASQMILLGFSSGNSLAFGRYILYASGKETPDGWEARGIAVACVTFSVLLHSTLPKWGIRLFNVLGVFKVVILLFIVFSGFAALAGHRRVPNPHNFDNAFRIEDGDGYGGGGAYAYSNALLNIIYSYKGWENANYVLGELKNPRKTLAVAAPIAIGGVTILYVLANVAYFAAIPKSDLAKSEVIVAGLFFRNVFGQGAAARSLPAFVALSNLGNVLAVSFAHARVNQELAKEGMLPFSRFWASNKPFNSPAPSLFLHWLVTVIVLLAPPAGPAYNFIVNLFRYTYPGSWINGFVTAGLIYLHWSKSENWTSPWHTYLPISVIYLLANIFLALVPFIPPDGDWNADGYPYYVFPVVGVGVLILGGVYWAFWTKILPRIGGYKIVADRTFDDAGVETVRYRKVSVRHH

SEQ ID NO: 68158 - protein, 275 aa, uncultured bacterium
MSAEQPRLILNSGQSMPQLGLGAYKVNQDITVQLVQHALEIGYRRIDTAAIYDNEAEVGAAVRKSGLAREEVFVTSKIWNDRHGYHEAKEAIQESIDRLNIDYVDMMLIHWPCPKQDKFVETWHAFEEVLETGLVKGIGVSNFNQPHLEKLLQHSNITPAINQVELHPQLAQNGLRELNERHGIRTEAWAPLGRARFMQHPLLIEIAESLGKSVAQVIIRWHLQIGNLVIPKSSNPDRLAENFDVFDFELSHHNMSIIATLNTETRIATNPDDMN

SEQ ID NO: 68159 - protein, 322 aa, Staphylococcus aureus subsp. aureus MW2
MKHLLVIHTGGTISMSQDQSNKVVTNDTNPISMHQDVINQYAQIDELNPFNVPSPHMTIQHVKQLKDIILEAVTNKYYDGFVITHGTDTLEETAFLLDLILGIEQPVVITGAMRSSNEIGSDGLYNYISAIRVASDEKARHKGVMVVFNDEIHTARNVTKTHTSNTNTFQSPNHGPLGVLTKDRVQFHHMPYRQQALENVNDKLNVPLVKAYMGMPGDIFSFYSREGIDGMVIEALGQGNIPPSALEGIQQLVSLNIPIVLVSRSFNGIVSPTYAYDGGGYQLAQQGFIFSNGLNGPKARLKLLVALSNNLDKAEIKSYFEL

SEQ ID NO: 68160 - protein, 491 aa, Propionibacterium acnes KPA171202
MSARETQSVDTPRRSALARPVKKPPATLDLESPTEERELQRGLTNRHLQLIALGGAIGTGMFMGSSSTIHLAGPSSALVYALIGFFLYFMMRALGEMLLSNLNYKSFRDIAEDLLGPAGGFIAGWTYWFSWIVAAMGDMAAITAYFQYWWPNIPKWLPATALAAVLLALNIIAVQFFGEAEFWFALIKLIAVGALVIVAIALLASRFVSPDGDPATIANLWNDGGFFPNGLMGFLGGFQIAFFAFVGIELVGTAAAETKDPCTTLPKAINAIPVRLALFYVFALLAITAVIPWRKVVPGVSPFVSLFGLAGFGAAASVMNFVLLTAAASSDNSGLYSTSRMMYGLALDGQAPSRFRKLSSNNVPRNALVASCLLLLSGITFLYTSDSIMQAFALVTTVAALLFLFTWSLIVVCYIVYRRKRPQLHEESIYKMPGGVPMCWVVLAFFTISLVILTLDPTTRIAVLITPIWFAFIGSMYFVHHRHEQRKEALR

SEQ ID NO: 68161 - protein, 504 aa, Propionibacterium acnes KPA171202
MTGFNQIPDRERYPHALASNEHRGLTAQEPESSPSSPHPEAHLHRNLNNRHIQLIAIGGAIGTGLFLGSGKAIRAAGPSIIVSYLIIGTMLYFVVRAMGELLMYNLDYKSFQDFAADLIGPWAGFFLGWTYWLCWIVTGMAELIGITTYWDFWVKNRGTAALLAAATLFLLLCLNLLTVRMFGELEFWFALIKIIAIISLIVLAIVLAVMKFQFPSGSMASVANLWNRGGFMPNGWSGFFAGFQMAAFAFVGIELIGTTAAETRDPEKTLPRAISAVPARILIFYVGALLAIMTAVPWDEVRADSSPFVQVLGLVGFAGAASVMNFVVLTSAASSSNSGIYSISRMLFGLAHKRMAPKVFGGLSKNGVPRWGLVITVLVLSTALLLAASESFVEAFTLVTTISSVLFIFVWSMIVISYMKYRRVAPAAHAASKYPMPGGRGMCWAVLVFFVFVLVLLAQEADTARALALTPIWFVILGVGWFFDRHHATHDDVGTDEAHPKGDS

SEQ ID NO: 68162 - protein, 167 aa, Oryza sativa Japonica Group
MACAFSVSSAAAPLASPKGDLPLVGNKAPDFEAEAMFDQGFIKSKCMFVSSAEITAFSDRYEEFEKINTEVLGVSIDSVISKSFGVLIPDQGIALRGLFIIDKEGVIQHSTINNLAIGRSVDETLRTLQALQYVQENPDEVCPAGWKPGEKSMKPDPKDSKEYFASI

SEQ ID NO: 68163 - protein, 358 aa, Arthrobacter sp. BP2
MKRCSAMHAFAVLPDDATIHDLEFSTPRPEGRQVLLKVMRAGVCHTDTHLREGGYDLGSRGHMSMKDRGIQYPMVLGHEVVGVVEQVGADVASVSAGDVRLIYPWIGCGTCRQCREGHDNRCAAGQNLGVARHGGYAEYIIVPDEKYLVDIEGLDPSWAATLACSGLTAHSAVDKVLPLEPDEPVVIFGAGGLGLTAIAILRARGHRNICAVDVAERNLALARDMGATSTVLSGAGSGAADIQRAAGGPASAVVDFVNNGATATAAFDALAKAGTMVQVGLFGGEVTLPTAMLALRMIRIEGSFVGALSQLQDLVRIAKAGELPTIPVSERTLSAAEVSRALDDLTAGGIAGRIVLTA

SEQ ID NO: 68164 - protein, 98 aa, Zea mays
MPKRTTHTYSSEDALPEGPESDLFVYYCKHCASHVLITDTQLQKMPKRKTDRAHVLDKAKHLSRLNVKEAGKVMLKRYNNIPHTRTGVLHLTYIVTMF

SEQ ID NO: 68165 - protein, 311 aa, Thlaspi goesingense
MPPAGELRHQPPSEDTQSTDTPSAEAAAAAAILAAAADSEAAGLWTQIKAEARRDAEAEPALASYLYSTILSHSSLERSISFHLGNKLCSSTLLSTLLYDLFLNTFTSDPSLRNATVADLRAARVRDPACISFSHCLLNYKGFLAIQAHRVSHKLWTQSRKPLALALHSRISDVFAVDIHPAARIGKGILLDHATGVVIGETAVIGNNVSILHHVTLGGTGKACGDRHPKIGDGCLIGAGATILGNVKIGAGAKVGAGSVVLIDVPPRATAVGNPARLVGGKEKPTIHDEECPGESMDHTSFISEWSDYII

SEQ ID NO: 68166 - protein, 289 aa, Oryza sativa
MARHEAAAGVVDFHLPDEILAVIPTDPYEQLDVARKITSMAIASRVSRLEADAARLRRDLADRDRAEADLRARLADSDARLLAALDENAKLAKERDSLASTAKKMARNLAKLEAFKKQLMKSLSEDNLLQLSEIGDDRDFDANNNLTARVPSWKEHQFSVTPYTAPKLTPGSTPKFLSGPTSPTKSLSEVHSTFSSWHGSSSHQYSAPTSPPQHRSFAGRPRIDGKEFFRQARTRLSYEQFGAFLANIKEFNAQKQSREDTLSKAEEIFGTEHKDLYISFQNMLNRNHS

SEQ ID NO: 68167 - protein, 465 aa, Aspergillus nidulans FGSC A4
MVGTGIFSTPSSVFEGTGSIGLGLFYWVIGFAVAASMLSVYLEFASYFPSRSGSEAVYLEQAYPRPRYFFPTVFAVQTVVFSFSSSNAIAVSFNTKWSLQLSNALGWVKLITLIFIAIAGLVVLGGNVSSITDSTAHFRNAFEGTSNATVYGATNSLINVMFSYQGYENAFNLVNEVKNPVKTLKWSTPASLITVGILYMLANIAYVAAASKQEIVESEINVASLFFQKVFGGGGASRALNFLICVSAFGNLLVVLIGQSRMLRECGRQGVLPFTRFWTSTRPFGTPLGPYWLKWALTAIMILAPPAGDAFNFVVDLGIYPQSMFNFFLAVGLLFTRRHRKRLNIPRTEWHAWDIVVYFAILANLYLLVAPWYPPAGGANGGDVSFWYGTIGLCGVYYWVYMKVLPHFGGYQFRQTIITGPAGETSHKMVKVPNDELARWDEEHDAAGRLRRRANAHKTEQPLEA

SEQ ID NO: 68168 - protein, 281 aa, Vitis vinifera
MREEPSQKQQKQWSLDDFEIGKPLGRGKFGRVYLAREIKSKYVVALKVIFKAQIEKYRLHHQLKREMEIQTSLCHPNVLRLYGWFHDSERIFLILEYCYGGELYRELRKTGYLTEKQAATYIASLTQALAYCHEKHVIHRDIKPENLLLDHEGRLKIADFGWSVQSTNKRRTMCGTLDYLAPEMVENKAHDYAVDNWTLGILCYEFLYGVPPFEAESQSDTFKRIMKVDLSFPSNPHVSAEAKNLISRLLVKDSSKRLSLQKIMEHPWIIKNANPTGTCNK

SEQ ID NO: 68169 - protein, 59 aa, Potamogeton distinctus
TPGKGILAADESTGTIGKRLASISVENIESNRQALRELLFCTPGALECLSGVILFEGTL

SEQ ID NO: 68170 - protein, 365 aa, Yersinia pseudotuberculosis IP 32953
MNMTKTYHIAVLPGDGIGPEVMAQASKVLDAVRQRFGLKISTSVYDVGGAAIDRHGSPLPAATVAGCEQADAILFGSVGGPKWEHLPPAEQPERGALLPLRKHFKLFSNLRPARLYQGLEDFCPLRSDIAARGFDILCVRELTGGIYFGQPKGREGQGMHERAFDTEVYHRFEIERIARIAFESARKRRSKVTSIDKANVLQSSILWREVVNGIAADYPDVALSHMYIDNATMQLIKDPSQFDVLLCSNLFGDILSDECAMITGSMGMLPSASLNEQGFGLYEPAGGSAPDIAGKNIANPIAQILSLILLLRFSLGKDDAADAIERAINQALEQGYRTADLAGDGHAIGTHEMGDIIAKFVVEGV

SEQ ID NO: 68171 - protein, 353 aa, Candida albicans SC5314
MTVKSKFTHLTKEEPDPIIKTLTQYHQDQSPNKLDVSIGVYKSPDGLLYTFPSIIEAKEIYHNEKNYGHNYTTMSGIKEFINGSQQLLFGKDVITSDGEKKIASIQTIAGTGAIHMGLLFFMEAGYKNFYLGLPSWSNYIPMIETVGGKVNTYEYYNTANGEINFDTVKKTLIEAPKNSVFIFQTCCHNPTGADFNNDQWIEVVKLIKQYDHLVLMDTAYLGFSSGDLIKDSWILRYMYEEAEIEFVVAQSFSKNMGLYGERLGAVHVIVQDENYVDHAQSTLVANFRHECSFAPSFGARLAQIIFENDKLYQQWTKEVNQVTQRLQNLRQLVYQTLIKLETPGNWKTVINKK

SEQ ID NO: 68172 - protein, 445 aa, Bordetella bronchiseptica RB50
MRIAYISYSSLGPPMSISQQAFLRDAMRRLNLTRDVFAGRIGVKRRALDTWLLPEGSQEFRAMPEVVERFVSEIVQNRDLLEKYTQSGQVGPLRDRIAVEGRHQLLSVDQFTRESVEDLFRVADMMQPIARRQKVSRVLEGAVLGNLFFEASTRTRVSFGAAFCRLGGSVCDTTGFTFSSMAKGESIYDTSRVMSGYVDAMVIRHPEQGSVAEFAEATNIPVVNGGDGPGEHPSQALLDLYTILTEFSRLGKLLDGAHIAMVGDLKYGRTVHSLIKLLALYKGVKFTLISPQGLEMPGYIVEQASRNGNVIEQKSTLAEGLAGADVIYATRVQKERFANEEAGEGYTADFQVSRAIIDAYCGPDTIVMHPLPRDSRPGSNDLSTDLNHDPRLAIFRQTDNGIPIRMAIFAVLLGVEGLVQHSMRDVTWQHPSHIGPDDSVFHGLD

SEQ ID NO: 68173 - protein, 273 aa, uncultured bacterium
MASPLVTLNDGRLMPQLGLGVYKVNQDIAVQLVQTAIEIGYRRVDTAALYDNEAEVGAAIRKSGLEREEIFVTSKIWNDRHGYHEAKEAIQESVDRLNIGYVDMMLIHWPCPKQDKFVETWHAFEEVLETGLVKSIGVSNFHQHHLEKLLAAATVVPAINQVELHPQLAQNSLRHFNKQHNIKTEAWAPLGRAKFLENPLLVEIAESLGKSVAQVIIRWHLQLQNLVIPKSSNPDRLAENFDVFDFELSQHQMGIIATLNTETRIATNPDDMN

SEQ ID NO: 68174 - protein, 500 aa, Physcomitrella patens subsp. patens
MAEAVAAGVGVSRIGLAGLAVMGQNLALNIAEKGFPISVYNRTTSKVDETVERAKEEGDLPLTGYKDPKEFVMSIQKPRSIILLVKAGAPVDQTIQTLAQYMEPGDCIIDGGNEWYENTERRAKQIAEKGLLYLGMGVSGGEEGARNGPSMMPGGTEEAYHYIEDVVKKVAAQVDDGPCVTYVGQGGAGNYVKMIHNGIEYGDMQLISEAYDVLKSVGGLTNEELHETFAEWNEGELESFLVEITRDIFSVKDDKGDGFLVDKILDKTGMKGTGKWTVQQAAELSIAAPTIAASLDSRFLSGLKEERLEAARIFREAGVEDILAVKSLDKKQLVDDVRKALYASKICSYAQGMNLIRAKSIEQGWDLNLGELARIWKGGCIIRAKFLDRIKKAYDRNPELASLLIDPEFTKEMVERQSAWRRVVSLAIEVGVSTPGMTASLAYFDTYRRGRLPANLVQAQRDYFGAHTYERIDMPGSYHTEWFKIAKKVVNSKASVNPSA

SEQ ID NO: 68175 - protein, 152 aa, Anaplasma phagocytophilum HZ
MGSVMDAKLSALIVVGSFHTEVCGQLVKGAIERIKAYNAAAECEVIEVPGALEVPPAISFAVMSDRESYDGFVALGCVLKGYTDHNIHVSNSAFSALSDIAVQHAVPMGTGIITADTMSLAMERADVNGINIGGRAAAAMLRMLELYRRFLG

SEQ ID NO: 68176 - protein, 258 aa, Triticum aestivum
  misc_feature (59)..(59): Xaa can be any naturally occurring amino acid
  misc_feature (129)..(129): Xaa can be any naturally occurring amino acid
MDEWIRQAEAWAGQAEHWIRQQPPEQIYVAVAVIAVTILVLVAASCLKSSKPNTIVLSXGLSGSGKTVLFYQLRDGSSHQGTVTSMTHNNATFVLHSELERKGKVKPVHVIDVPGHARLKSKLDEVLPXQAAGIVFVVDALDFLSSMQAAAEYMYDILTKATVVKKRIPVLIFCNKTDKVTAHSKEFIKKQLEKEVNKLRESRNAISSADISDEVRLGLPGEAFNFSQCQNKVIVDEGAGLTGDVSAVEQFIREYVKP

SEQ ID NO: 68177 - protein, 1053 aa, Ustilago maydis 521
MSYHVIHYRRFTIGFADLTHRRSTHDVRQFALELATVTGKGGFDMHIQLAVPERSIILKTASASASPSTSASPSACASSFSSPSPHLTLSSRLDRAPKMSSSSPSSASASSRRPLVGVSFKMYFDIPKTKAYVDETISLLSSTLPSLGQPIDVFVIPDFITLTSVAAQICSSSSTLLLGAQDVHSHDFGAFTGEVSPNVLSQVGVKLVEIGHAERRRYFGETDQDVANKAAAIAKNGMVPLICIGEVSRPKNLDQLSIQDVDLVVNECWRQIQPALDAIESHVDVVLAYEPVWAIGQPQPASPDYVVKITKALRKRYNKEYVDSHKARSDASLRILYGGSAGPGSLINPRLLSIPSRKSPVQTSRLQNTPLVQVRALVPILMLLPQHLERSLSLLGHVFLLAHHHLCTRRLGITIEAIASLTIQTSTSSIGDLERIVKLVLRERKDDTDHREKSSYELLYCTPTELNASVRGGGGANSLSSKGSVWWARCVSIRGQRSRYRQRIPRYSTPSCSGCIIHPTAVNIRSQSKTCHLLATTPPSDKGIEVRLPVITTNMQPSSRNRSTCVETRSKCVSNQAAVAASYASCFPSRRRGWQNEARGSSALSIMFSQIQAPIATLPFGSELHRYPIGLAPSTKPRSGLCPQLGCNNFISIRFARCRFVIRDILRFILDSRKSRRLTAFHPGNLILTTSSKLGGAQEKEKQEQRAPTMMTSRFLVSGNPATDPKAAAQWLAEQRRRPIRAPHKTVQYGELVITRGGLSSVSKEDLWSILEQVAIAAIEVARFDLAELCISRLSSRFANSQRVTSLQGMLLEGQAKSRDAIRLYESVLETEQTSLILSRRRIGAIKSTGDIKQTLHALNSHLDIFYNDPEAWQELAEVYATQSMYAQSAFALEELLLQVPQNGFFQLKYAETLYTAAELTKSYKAYLRVLEMCQSDAATTQPVAPNTTAAHGAWLRALWGTKMVSTQLHYFRTLQTETDPNPDDLICIDLAKVTTALIATPPRASSTDDAIDQAKVLKIDELVTKLLLTNVYTPQAVACKHLRDVARAVLAA

SEQ ID NO: 68178 - protein, 99 aa, Talaromyces emersonii
GVIAPWSGRFYSLWDTGYAKIHIPIIASVSEHQPTAWPAFFFDLNFLVWLFPAGVYMCFRDLKDEHVFIVIYAVLASYFAGVMVRLMLTLTPVVCVAAA

SEQ ID NO: 68179 - protein, 478 aa, Arthrobacter sp. BP2
MVPAAGLDYYVIHHRGEPPMGVYTTIDPATGDATAQYPEISDAELDTLIKNSAAAYRSWRTTTLEQRRAVLTRTAEIHREQAEELAKLLTLEMGKPIAQARGEVELVASIYQHYADNLEEYLADESLTFRGSGTAVVRTEPIGPLVGVMPWNYPYYQVARFAAPNIALGNTIILKHARNCPQSALAIERVLTEAGLPAGVYANAFISSAQVAAAVADRRVQGVSLTGSEKAGAAVGEVAGRNLKKCVLELGGSDPFIVLDDADIDAAAAAAVIGRLSNGGQACTASKRFIVADSVYEEFLQKFLDAMASWQTGDPTDSGTKLGPLASAAGVEELDELVQDAVSHGAKLLLGGERPDGPGAYYPATVLAGVTPAMRAFTEELFGPVAVVYRVGSLQEAIDLANNSPFGLSSSVFTSDARNAERLAEELEVGMVWINSTSKSSPDLPFGGVKGSGFGRELAGYGFNEFANKKLVRNPGAR

SEQ ID NO: 68180 - protein, 132 aa, Helicobacter pylori
SNIKYELDKESGALMVDRVLYGAQNYPANYGFVPNTLGSDGDPVDALVLSDVAFQAGSVVKTRLVGVLNMEDESGMDEKLLALPIDKIDPTHSYVKDIDDLSKHTLDKIKHFFETYKDLEPNKWVKVKGFEN

SEQ ID NO: 68181 - protein, 268 aa, Arthrobacter sp. BP2
MGAGIAHAFLIKGADVVVIERDEASAQAGRERVASSAAKSIERDPHSGNLDEMVSRLKTSVDYADFGDRELVVEAVPEDWTLKVAALRRVEEQLTPGAVLASNTSSLSVSGLAEELERPQDFLGLHFFNPVPASTLIEVVIGKQTRPDLVEQTRSWVQGLGKTAVVVNDAPGFASSRLGVAIALEAMRMVEEGVASAKDIDNAMVLGYKHPTGPLRTTDIVGLDVRLGIAEYLHETLGERFAPPQILREKVARGELGRKTGKGFFDWS

SEQ ID NO: 68182 - protein, 415 aa, Arabidopsis thaliana
MASISETSDDGSNGGDPNQKPEEPHKNPQEGKEEENQNEKPKEDDHQEEEVENVPQIPPQMPLELIVSTIATLRRCHYPTLSLLSDSFRQVISSVDLFQTRSLIGSTEPVLYTLITFTSPNFEEPRWFILQRRNNTSLQLSLVTSLPPMFPGCTTVTIGHKIYVMGGLRSLNRRAKTVFVIDCRFHTWRYLQEMQVARSYAASAVIDGMIYVVGGSTKRSDDWVEVFNVETNTWENVPSVLSPYGRSKAPFNVHFVLDNKIYILDGNNRVAYDLRGRRWEDWGPAGNQLGYFWQVLYCVVDNLLYAVVPDHLHVTPIVVYDPREMGWRPVMGVDYLPNLVYSESRMTNFGGKLMILGCYQSQARFDYYGEVNVWCVEVALERREDGEIWGKVQSLSLVNKFRKSPVFVLSRTVTV

SEQ ID NO: 68183 - protein, 132 aa, Helicobacter pylori
SNIKYELDKESGALMVDRVLYGAQNYPANYGFVPNTLGSDGDPVDALVLSDVAFQVGSVVKARLVGVLNMEDESGMDEKLLALPIDKIDPTHSYVKDINDLSKHTLDKIKHFFETYKDLEPNKWVKVKGFEN

SEQ ID NO: 68184 - protein, 870 aa, Solibacter usitatus Ellin6076
MDGKLNPSVAETVAATSYMAATGAEISRVTSHSEDEGRFVPGTLLGGRYRIIGLLGRGGMGEVYRATDLTLGQSVALKFLPEEASRNQRLLERFHGEVRVARLVSHPNVCRVYDIGEVEGMPFISMEYVDGEDLSSLLLRIGRLPGDKAVETARKLCAGLAAAHDRGVIHRDLKPQNIMMNRRGEVVIMDFGLAAIADQLSGAEVRNGTPAYMSPEQLKGDGVTAKSDLYALGLVLYELFTGKRPFDAKNVQQLIDMQESAHLTSMTSVAADIDPAAEKVIRRCLDPDPAKRPATALSVMAALPGGDPLAAALAAGETPSPEMVLAAGTVEGMARKYSVPCLALVALALLAAIPIRQERTAMVHAQLDQSPDVLAHQAREFAASFGYSAKPADSTVWLEHRGTFLAYLHRLPNPRKWDEWLAAEAPIRAMYRESPRALKAEPYGYVENNNPPQDTPGMTRATLDGNGRLRDFTGLPPDDAGLSLAVPPETVFRAAALDLAAFTETAPTVLPASPFDRRQAWKGPHPLIPNTELTFDIAWWKGRIVRAAVTFPYQHARAGSTTVSATTSAIRIGSQVLLWVGCFFVLLLAVRNWKLQRADHQGAWRVAVASFLLHAIGWMGSVHAANFNDLVDMGLSETASALLAGVMLGLMYLALEPAVRARWPHSIVTWNRVLAGRWLDAQVGSDILLGAAAGASLWALFKFVFILLDHTPGPHNWDVSLPPLLGTRQWVGSLAGNLGEALRLGLIGFMAIFGLRRILRNDLLGAAFAALLFTLQEGEVTTSQEGILIGAVFVCVYAALIFLLLRFGLVATLVAVFFANGANLMVLGGDWQAWYTASSLATFAAFFGVAAFAFWRSLGSQSLISGDETA

SEQ ID NO: 68185 - protein, 344 aa, Solibacter usitatus Ellin6076
MPNHIVTFGEIMLRLAPPGMERFLQSPQFVATFGGGEANVAVAVANFGLPSRYVTVLPDANPIADAAIGELRRFGVDTAHIARGKGRVGIYYLEAGANQRASKVVYDRANSAIAIAKPGDIDWGRAFEGAGWFHITGITPAISASAAELSFESVKEAREKGLTVSCDLNYRKNLWKYGKSSAEVMSELTRFVDIAIANEEDVQMALGIQADVDVHSGELDRTVYEKLTAKVLDAYPSMKAIAITLRESKSASHNGWAACMNDRKQFMVSRRYDITHIVDRVGGGDSFAGGLIYGLLSLPSHQDALEFAVAASCLKHSFMGDFNRSTVDEVKSLLKGDGSGRVQR

SEQ ID NO: 68186 - protein, 462 aa, Solibacter usitatus Ellin6076
MQLGGSEGSARIRDCRHPAPPIISPCNHGRNMPSELPRRLGLLDSSAIVVGTIIGSGIFLVPNLVARSLPSAPWIIAVWIFTGALSFFGALAYAELGAMIPATGGQYVFLREAYGPLWGFLCGWTYFFVVISAAIGWLAITFATYLGYFIPLTPALSKLVAITLIAAITFVNYRGITLGATVQKLFTFTKVAALAILVAAAFVGPAHAVSENAAGPVTLSGFGVAMISCLLSYDGWVALSFVAGEVRDPKRTLPLALALGVGGAIAIYVLANIAYLRVLSVGEIAATARVGALAAERTMGPTGGAFVSFSILMSIVGAINGWVLAAPRIYFAQARDGLFFRSFAAIHPRFQTPYVSILTFGAWSALLAITGTYETLASYAMYAAWVFYALTALAVIALRRRQPDRPRPYRMTGYPVTLLIFAAVAFGFVINTFYATPGPAIVGTLLIGAGVPVYFIWRGTAG

SEQ ID NO: 68187 - protein, 213 aa, Triticum aestivum
  misc_feature (148)..(148): Xaa can be any naturally occurring amino acid
  misc_feature (160)..(160): Xaa can be any naturally occurring amino acid
MFLKGGEFPGYRRPTRPQAIYPHSTAMAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWKMWKLPMFXGCTDATQVINEXVEEVKKEYPGRLWSASLGFKQTCRKGEKAVSFNPPFKTTGAGTGSSGKGTKTG

SEQ ID NO: 68188 - protein, 505 aa, Vitis vinifera
MSLVFAISALTLVFLMKILVGKSTEKKRRYHPIGGTVFNQLFNFNRLHHYMTDLAGKHRTYRLLSPFRNEIYTADPANVEYILKTNFENYGKGSYNYNILRDLLGDGIFTVDDEKWRQQRKVSSYEFSTKVLRDFSSVVFRKNGAKLAIVVSEAASSNQTMDIQDLFMKATLDSIFKVAFGVELDSMCGSNEEGTKFGSAFDDASAMTLYRYVDIFWTIKKSLNIGSEATLKRSIKVVDDFVYKLIHSKTELMKNSQNDSSMKKDDILSRFLQLKDIEIDPKYLRDIILNFIIAGKDTTATALSWFIYMLCKHPTIQEKVAQEVREAINLKEATNYAEFAASVTEEALENMQHLHAAITETLRLYPAVPVDAKICFSDDTLPDGFSVRKGDIVSYQPYAMGRMRFVWGDDAEEFRPERWLNEKGLFCPESPFKFTAFQAGPRICLGKEFAYRQMKIFSAILSGCFVFKLSDNKKAVNYRTMINLHIDGGLHVRAFHRPDTKILEA

SEQ ID NO: 68189 - protein, 298 aa, Oryza sativa Japonica Group
MKVGRGSRGGGGRDGGGVVEEERSGGVEAAPPVKRRRVAVAPSAGAGGSRRVQAEASPLQRLFRACRAVFRGTGTVPAPGEVDLLCSMLDKMKPEDVGLRADQEFFTARDDDEGIPLIKNTTLYECDNFTMIIFFLPRNAIIPLHDHPGMTVFSKLLIGSLHIRSYDWVDPEPALSCSSSSGDQLRLAKRVVNGVFTAPCDTSVLYPTTGGNMHRFRAIAPCAILDILGPPYSTEDGRDCTYYRAIPYSRHSVKNGAADQLTGVDEEGHRLSWLTETIPRMLRMRQIRYGGPPISDDE

SEQ ID NO: 68190 - protein, 289 aa, Solibacter usitatus Ellin6076
MPLDPEVAAHLELQRHLPPRSSLDIAATREMMRRAAALSGPPPLLPRVEDIALPTGLRARQYWPALDPALPLTVYFHGGRFFSGDLESHDTICRLLALASASRVLAVDYRLAPEHPFPAAVEDARTALAWALLQDVPVAVAGDSAGANLAAVAALDHRHSLRLRCQLLIYPMIDAVCASHSYTEFAEGYGPGAADMRRGWSEYLPAGSDPRDPLASPLYTPDLTGAAPALVITAEYDTLRDEAESYARRLSAPVQRYPGAIHGFFLMQSPLALARQSLQDAAAFLRHHL

SEQ ID NO: 68191 - protein, 379 aa, Picrophilus torridus DSM 9790
MVSSRLSQISESATVSMSNRASELRKAGKKLYNFGIGEPDMTTPDNIIKMAFDDAMSGKTHYTPSAGIPELREKIALKMKSKNNIDVVAKNVLVTPTKFSINLALYTIIDPGDEVLIPSPYYVSYPDIVKINSGKPVFADCDDEYNIDIDNLRRAITPKTRAILINNPVNPTGKVLSEKNIRETVDFALENNLYIISDEIYEDIIYRGKMFSPASIPEAFDKTVTVSGFSKSYAMTGWRVGYMVAPEEIIKSADKIQQQTLTCAPSISQYAALHALDDDDSVKHIRETFEKRRDLVVSLLKETNLHFYEPEGAFYVFPGYESDVKSYDAAMNLLENKNVIVTPGAPFGSEYHFRISFATSEDDIKNGIPLIGEYFKSIS

SEQ ID NO: 68192 - protein, 585 aa, Gibberella zeae PH-1
MRFGWAVLFTPAVLAATVSYDFTIEWVRADPDGEFERPTIGINGKWPIPRIEANVGDTVLVNARNNLGNQSTSLHFHGLFMNGSNHMDGPSQVTQCAIRPGESFLYNFTITQPGTYWYHSHTESQYPDGLRGPLIIHDPESPFKDQYDEEIIMTISDWYHDQMQTLIPEFMRKGNPTGAEPVPQAALMNETQDLQVDVQPGKTYLLRLANIGAFAGHFFWIEGHNLTIVEVDGAYTKPAPANMVYLSAGQRCSVLITTKENTLDNFPIVSSMDTDLFDVLPEDLNWNVTGWLVYDQQKDLPEPLIVHEFDPYDDMDLVPYDDMARLPEPSKHIELDVVMDNLRDGANYAFFNNITYRAPKVPTLYTALTSGKEATNPQIYGTYTHSFVLEKDEIVQIVVNNRDDGRHPFHLHGHHFQVLHRSEDDVGDFTGSEEFAETPMRRDTVVVRGNGNAVLRFKADNPGVWLFHCHIEWHVTSGLIATFVEDPLALQASLKLPQNHLDACKAGGVPTVGNAAGNKNLLDLTGENVPPPRLPEGFTLKGIVAFTFSTLMGIFGIYTVASYGMKKEKKTPERAPLLAEELPEQ

SEQ ID NO: 68193 - protein, 193 aa, Zea mays
MGSSERNRKEGRLIRVKEAMEHKEAGCQAPEGPILCINNCGFFGSAATMNMCSKCHKEMITKQDQAKLAASSIDSIVNGSDAVMEPVVAGSNTVVAVAQVELQTMNVQQPADVAGPSEGVAAISKGGKVGPNRCSACRKRVGLTGFNCRCGNLYCALHRYSDKHDCKFDYRTAARDAIAKANPVVKADKLDKI

SEQ ID NO: 68194 - protein, 245 aa, Oryza sativa Japonica Group
MAASASAPPHSLLLAAVALAALASVAAARDENGVYDPCSDTRIQRGDGFSFGIAFATLGAFYSGGSVQLSPCDRRLSLASSGQLAVFRPKVDEISLLTINTTTGFNPATAGGYMVAFAGRKYAARSVPTFVSNSSYTVSSFTLVLEFNKGRLQNLHWKKDGCGACAKSSSLVCIGKQTCAFRTQSCKSQGPVDCSIGIQLAFSGTDKHESVLNSWYEVSNLRQYSLYGLYSNLKDTLSGQFNKFF

SEQ ID NO: 68195 - protein, 113 aa, Gossypium barbadense
IYGVIVAIILQTKLESVPSSQIYEPETLRAGYAIFASGIIVGFANLVCGLCVGIIGSSCALSDAQNSSLFVKILVIEIFGSALGLFGVIVGIIMSAQATWPAKSVQFHDLSRK

SEQ ID NO: 68196 - protein, 495 aa, Debaryomyces hansenii CBS767
MMMKPFSRISIKEQNNDQAEEKKNEIPAKEEAPAQVETTSGAIETKAEEPAYGTPVQQQAAVPVAAPAQPEQNAIPPPPPVSDQMSGQMPGQMQGQMPGQMPGQMPGQMPGQMPGQMPGQMPGQPPQMPDFQQMQQMQQQFQGGMPLPPQPPQPPQPQQLPPSNMGKDHGKMFIGGLNWDTTEQGLVEYFTKYGEVIDHTIMRDNNTGKSRGFGFLTFKDPKSVDEVIKTDHILDGKLIDPKRAIAREEQDKVGKIFVGGIDPMVNEKDFNDFFSQFGSIIDAQLMIDKDTGRSRGFGFITYDSPDAVDRVTVNKYLTLKGKSMEVKRAEPRGQHQQNQMQQQQQQQQPYNYGNYGNQYGQTQYQQPGMASYGQGMNGMSPEMMQEYWQRMQQWYMYQQQQQQAQGSTGDYNQQSEQPEQPLNPQQQAPTESQDNQEPENGSDSSGTPSGPSRRMNLPKGPRRAPPSGPSGNSRGRGGYQNRNRGYHPYTRGGRR

SEQ ID NO: 68197 - protein, 525 aa, Gibberella zeae PH-1
MSNDDLKGLEPEANKTNYVGSGTGSDTEEGRLQHAADAKRQIGVLSASMLIFNRVIGTGIFATPGSILALLGSPGLALIIWVVGSLIAAAGTAVYLEWGTGIPKNGGEKNYLEFIYRKPKFLVTGIYASYILLMGWASGNSVVFGEYILHAANKEVDRWNQRAIGLACITTAFLIHGCALKWGLRLQNALGFIKLAIVFIMIICGFVALGGHLKIDEKPDNLSRAFEGTTGSAYGVVTALYNVIWSFVGYSNANYALSETRNPVRTLKIAAPTAIISVSVIYILVNIAYFAAVPKAEIIASERLVAASLFRNVMGPAAERAMSVFVALSAFGNVLSVIFSQGRLVQELGREGILPFSRLWASNRPFNAPLAGLFEHWVICVIVILAPPPGDAYNFILNLISYPLAIVNTFVAGGLVHLYLHREKYNWNAPIKATLPVTVFFLLSNMYLVIAPFIAPDDPSQNQYKSMPYYIHCVVGIGILVAGAFYWLVWAVILPKIGGYKLVRETHVDEIDGWESNRFRRVPLN

SEQ ID NO: 68198 - protein, 105 aa, Gossypium barbadense
IYGVIVAIILQTKLESVPSSQIYEPESLRAGYAIFASGIIVGFANLVCGLCVGIIGSSCALSDAQNSSLFVKILVIEIFGSALGLFGVIVGIIMSAQATWPAKSV

SEQ ID NO: 68199 - protein, 278 aa, Bradyrhizobium sp. BTAi1
MPTLPFHQVDVFSTAPFKGNPLAVIAEADGLDDAAMQAIANWTNLSETTFLSRAQNPGADYRVRIFTPQRELPFAGHPTLGSCHVWLALGGRPQGEHVVQECGAGLVRIKRDGARLAFTAPPLRRSGAVDAELTTKIAAALGIKREAMRAVQWADNGPGWIGVLLDSRQDLLNIKFDVQALSQQPIGVVAPWDPTRDGGDAQFEVRAFMWSGAEDPVTGSLNASLAQWLIGAGIAPKQYIAAQGTVLGRAGRVHVIQEGETIWIGGDVAPVVKGTISL

SEQ ID NO: 68200 - protein, 506 aa, Ustilago maydis 521
MLGINVKSKPAKAAALLLLAGAPLVASQSITTAVTVNGTPTTTVISPSPTGRGYCEFFIDHWDCDPTRSEAASGPSGASASAPSIQPSPVGQSCTLHGDHYHCDGPTTATAAAAAAQASPTGQGECVFHINHWDCEGGDHSDHDHSGHDHSGHSHAGHSHAGHSHGPSELYGCGLAPLEDYNLPLHIGTVFILLVSSAIGAFLPILVYTAGGATSQNKRGRWADEVFFICRHFGTGVLISTAFVHLLSHAMMYYSNECIGELKYEATAPAIAMGAVWLVFIVDFFLLRALRKKSSQQMLQAHESHHDVHGVTKRESSSTLDRTHSPATEEDAATGMYGGLTYAQAKVAEWDVFAVEAGIIFHSILIGVTLGVATGSGFVALLIAILFHQLFEGLALGSRLSLLRWKSTAYKMLMASAFVLTTPIGVAIGIGVRKSFNGNSSGTLITLGTFHALSAGILLYTALVELLSGDFIHNRQMQKSSLIRAIAAVAALTVGIMAMSVLALWA

SEQ ID NO: 68201 - protein, 352 aa, Rhodococcus sp. Phi2
MRVFAVQPEDTTIHDLQVPTPSPEGREVLLRVVRAGVCHTDTHLRAGGYDLGSRGMMSMKERGIEYPMVLGHEVVGVVEKVGDGVESVQVGDIRLIYPWIGCGECRQCRAGHDNRCAAGKNLGVARHGGYAENILVPDEKYLVDIDGLDPSWAATLACSGLTAYSAVDKALPLEPDEPVVVFGAGGLGLTAIAILRSRGHRNICAVDVAERNLALARDMGASSTVLSGTGSGADDIRGAAGGPAGAVIDFVNNGATATTAFEVLAKAGIMIQVGLFGGEVTLPTALLALRMIRIEGSFVGTLVQMQDLVRLAQRGELPHIPVVERSLSAAAVSQALDDLTAGGVAGRIVLTA

SEQ ID NO: 68202 - protein, 261 aa, Oryza sativa Indica Group
MILNVRVVGSGERVVVLSHGFGTDQSAWSRVLPYLTRDHRVVLYDLVCAGSVNPDHFDFRRYDNLDAYVDDLLAILDALRIPRCAFVGHSVSAMIGILASIRRPDLFAKLVLIGASPRFLNDSDYHGGFELEEIQQVFDAMGANYSAWATGYAPLAVGADVPAAVQEFSRTLFNMRPDISLHVCQTVFKTDLRGVLGMVRAPCVVVQTTRDVSVPASVAAYLKAHLGGRTTVEFLQTEGHLPHLSAPSLLAQVLRRALARY

SEQ ID NO: 68203 - protein, 139 aa, Pinus taeda
MAGRGKAVGGAGGSKKSTSRSSKAGLQFPVGRIARFLKAGKYAERVGGGAPVYLAAVLEYLAAEVLELAGNAARDNKKTRIVPRHIQLAVRNDEELSKLLGAVTIANGGVMPNIHNILLPKKTASSGAPTKSGKDDEEN

SEQ ID NO: 68204 - protein, 459 aa, Rhodococcus sp. Phi2
MGVYTTTDPATGEEVAQYPEISDAQLDELIGRSAAAYRSWRTTPLEQRRAVLSRAAEIHREQADELAALLTLEMGKPITQAKGEVALVASIYQYYADHAEEFMADEPLDIAGSGTAVVRTEAIGPLVGVMPWNYPYYQVARFAAPNIALGNTIILKHARNCPQSALAIERVLTEAGLPDGVYLNAFISSAQVAAAIADPRVQGVSLTGSEKAGSAVGEVAGRHMKKCVLELGGSDPFIVLGDADVDAAAAAAVVGRLGNGGQACTASKRFLVEEPVYDEFVRKFLDGMISWQPSDPTSPETKLGPLSSRSAVDELDELVQDAVSRGAQVLTGGDPRDEKGAYYPPTVLVGVTPDMRAYYEELFGPVAVVHRVGSLDEAIEAANDSPFGLSSSVFTSDPQKADRVAEELETGMVWINSTSKSSPDLPFGGVKRSGVGRELARFGFDEFANKKLVRKPGKK

SEQ ID NO: 68205 - protein, 405 aa, Desulfitobacterium hafniense Y51
MINMEFRFNTIEEAIEDIRQGKMIVVVDDEERENEGDLLMAAEKSTPEAINFMATYGRGLICVPMTAERIQALNLEPMVTHNTDPHGTAFTVSVDGCDCTTGISAFERANTVKVLLDPHSRPENLRRPGHIFPLKAREGGVLVRAGHTEGAVDLARLAGFQPAGVICEILKDDGTMARVPDLMEFVKKHDLKIVTIKDLIHFRRQKEKLVERVVGIELPTDFGDFKAVGYRSLLDGQEHIALVKGDVDDGEPVLVRVHSECLTGDVFHSRRCDCGEQLSAALESIQKEGRGVLLYMRQEGRGIGLLNKLKAYKLQEEGKDTVEANLALGFPADLRDYGVGAQILVDLGIRKVRLMTNNPRKIVGLEGYGLEIQERVSMEMPVKPENEHYLHTKKIKLGHYLPGVR

SEQ ID NO: 68206 - protein, 154 aa, Desulfitobacterium hafniense Y51
MMTYEGKLIAEGLKFGIVAARFNEFITNKLVGGALDALLRHGVAESDIEIAWVPGAFEIPLVAQKMAETKKYDAIICLGAVIRGATPHFDFVSAEVSKGVAHVGLETKLPVVFGVLTTDTIEQAIERAGTKAGNKGFDSAITAIETVNLLKMIQ

SEQ ID NO: 68207 - protein, 255 aa, Zea mays
  misc_feature (228)..(228): Xaa can be any naturally occurring amino acid
  misc_feature (247)..(247): Xaa can be any naturally occurring amino acid
MAMVTAKLSSPAAARLAPSAEPARRASRVRVRASGGSYADELVSTAKTVASPGRGILAIDESSATCGKRLASIGLDNTEVNRQAYRLLLLTTAGLGEYISGAILFEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIAQDNGLVPIVEPEILLDGDHGIERTLXVAEKVWSEVVFYLGRNMFXEGILLKPA

SEQ ID NO: 68208 - protein, 492 aa, Vitis vinifera
MDYITVLLLLSFVWTCIHLLKLSPIGRKPSTASLPPGPRPFPIIGNILKLGDKPHQSLTNLSKTYGPVMSLKLGSISTIVVSSPETAKEVLHRNDQAFSGREVLGAVKAHNHHESSVIWSPTSAYWRKIRKICTREMFSVQRLNASQGLRKKIVQELLDHVEECCGRGCAVDIGAATFTASLNLLSNTIFSTNLAHHDSTFSQEFKDIVWGVMEEAGKPNFADYFPAFRLIDPQCIQRNMKVHFGKLIDIFDGLITQRVQSKASSASNDVLDAFLNLTKENNQEWSCNDIIHLLMDLFVAGTDTTSDTIEWAMAELLHNPETMVKAQRELQEVLGKDGIVQESDISKLPYLQGIVKETFRLHPPAPLLVPHKAETDVEICGFTVPKNSQVLINAWAIGRDPSIWSNPNAFVPERFLGCDIDVKGRDFELIPFGAGRRICLGLPLAHRMVHLILASLLHSYAWKLDDEDMDMNEKLGFTLQKAQPLRAIPIKV

SEQ ID NO: 68209 - protein, 496 aa, Vitis vinifera
MDYITVLLLLSFVWTCIHLLKLSPTGRKPSTASLPPGPRPFPIIGNILKLGDKPHQSLTNLSKTYGPVMSLKLGSVSTIVISSSETAKEVLHRNNQAFSGRVVLDAVKAHNHHESSVVWSPASAYWRKIRKICTREMFSVQRLEASQGLRRKIVQELLDHAEECCGRGCAVDIGAATFTASLNLLSNTIFSINLVHHASTFSQEFKDIVWRVMEDAGRPNFADYFPAFKLIDPQGIQQNMKIHLDKLIHIFEGIINQRLQSKASSASNDVLDAFLNLTEENNQEWSCRDIIHLLMDLFLAGTDTTSGTIEWAMAELLHNPEKMAKAQRELQEVLGKDGIVQESDISKLPYFQAIVKETFRLHPPGPLLAPHKAESDVEIRGFTVPKNSQVLVNVWAIGRDPSTWSNPNAFVPERFLGCDIDVKGRDFELIPFGAGRRICLGLPLAHRMVHLILASLLHSYAWKLDDGMKPADMDMNEKLGLTLHKVQPLRAIPIKV

SEQ ID NO: 68210 - protein, 1123 aa, Arabidopsis thaliana
MAASVQPACLDLHFSGKHPPLLKHNAIIVRCVSSPNVIPEADSISGPPDIINTNRDQRKVVRIAWEKLVRWSRSLRAKAKTDVLERTRKVVVLGGGSFGTAMAAHVARRKEGLEVNMLVRDSFVCQSINENHHNCDKVDSVASKYFPEHKLPENVIATTDAKAALLDADYCLHAVPVQFSSSFLEGIADYVDPGLPFISLSKGLELNTLRMMSQIIPIALKNPRQPFVALSGPSFALELMNNLPTAMVVASKDKKLANAVQQLLASSYLRINTSSDVTGVEIAGALKNVLAIAAGIVDGMNLGNNSMAALVSQGCSEIRWLATKVMGAKPTTITGLSGTGDIMLTCFVNLSRNRTVGVRLGSGETLDDILTSMNQVAEGVATAGAVIALAQKYNVKLPVLTAVAKIIDNELTPTKAVLELMNLPQVDYRFHRFPFRLGYSSVEDGGKETENLFVSSKNKMMKRAQQSARETKQEAKDASKAKSGLFASCSFSSLGLDTKLSDQLKERMGFEAPTLVQAQAIPVILSGRDVLVNAPTGTGKTIAYLAPLIHHLQGHSPKVDRSHGTFALVIVPTRELCLQVYETLEKLLHRFHWIVPGYVMGGEKKAKEKARLRKGISILIATPGRLLDHLKNTASFVHKNLRWVIFDEADSILELGYGKEIEQIIKLLGSGQNEQGEEDDIVPKGIQKQNLLLSATLNDKVNDLAKLSLDDPVMIGLDNTKLQQNLSIESPAAPDSDAEDMVIHVNKSANPLSEDYGIPSQLVQRYLRVPCGARLVALLSVLKNLFEREASQKVVVFFSTRDAVDFHYSLLSEFQWPPNSETEEEGTKELFLKCKTFRLHGSMEQEDRRSAFGTFKTEKQAVLLSTDVAARGLDFPKVRCIIQYDCPGEATEYVHRVGRTARIGEKGEALLFLQPIEIDYLKELKKHGASLTEYPLMKVLDKFPIPGNMPRIKKVLSLESHPWVISLQRALESLTYAEPKMKSLAKNAFVSWVRGYAAHKGELKSIFVVKKLHLGHVAKSFALREQPSLVGKSHHKETMKRKRDERQKGQQEKKTKTNKTRDGFLRTSLSTLMDHSKCIPTRPVRGNLQEEDQLGLCPFHKEAYMRLTLDYDTLNAASKTGII

SEQ ID NO: 68211 - protein, 438 aa, Vitis vinifera
MDYITFLLLLSFVWTCIHLLKLSPIGRKPGTASLPPGPRPLPIIGNILKLGDKPHRSLANLSKTYGPVMSLKLGSIATIVISSSETAKEVLHRNDQAFSSRTVPDAVRAHNHHESSVVWVPASVHWRKIRKICTREIFSVQQLDASQGLRRKIVQELLDHVEECCSRGCAVDINGAVFTASLNLLSNTIFSINLAHHGSNFSQEFKNIARGVMEGVGRPNFVDYFPAFRLIDPQGIRWNMKIYFNKLFHIFDGIINQRLQSKTSSASKDVLDALLNLTKENDNEWSCSDIKHLLLDLFVAGTDTTSSTVEWAMAELLCNPEKIAKAQKEIRGNSQVLVNAWAIGRDPSTWPNPNAFMPERFLECDIDVKGRDFELIPFGAGRRICPGMPLAHRMVHLMLASLLYSHAWKLEDENMDMSEKFGLTLQKAQPLRAIPIKV

SEQ ID NO: 68212 - protein, 496 aa, Vitis vinifera
MDYTTLLLLFSFVWSCVKVLTIGFTNRKSGVARLPPGPRPFPIIGNLLKLGEKPHQSLTILSKTYGPLMSLKLGSTTTIVVSSSEAAQEVLNKNDQAFSSRTVLNAIQVADHHHFSIVFLPASAHWRNLRKICSKQMFSSHRVEAGQAMRENIVQQLLGHAQESCSSGRAVDIGRATFTTTLNLLSNTIFSVNLAHYNSNFSQEFKDLIWSIMEEAGKPNLADFFPVLRLVDPQGILRRMTVCFNKLVEVFDGFIEQRLPLKASSANNDVLDGLLNLDKQHDHELSSNDVRHLLVDLFSAGTDTTSSTVEWAMAELLNNPNLMAKARSELGKVVGKEKMVEESDISKLPYLQAVVKETFRLHPPVPFLVPRKTEMKSEILGYAVPKNAHVLVNVWAIGRDSTIWSNPNSFVPERFLECEIDVKGRDFQLIPFGAGRRICPGLLLGHRMVHLMLASLLHSFDWKLEDGLKPEDMDMTEKFGFTLRKAQPLQAVPIKP

SEQ ID NO: 68213 - protein, 360 aa, Vitis vinifera
MLSLPRIDACRALRRRIVQQLLDHAHESCTSSRAVDIGRAASTTALNLLSNTIFSVDLAHYDSNFSQEFKDLVWSIMEEAGKPNLADFFPGLSFIDPQGIQKKMTANFYKLVKVFDGIIDQRLQLKASSANNDVLDSLLNLNKQHDHELSSNDIKHLLVDLFSAGTDTTSSTVEWAMAELLNNPKAMAKARSELDEVLGKGMIVEESDISKLPYLQAVVKETFRLHPPVPFLVPRKTEMESEILGYAVPKNAQVLVNVWAIGRDPMLWTNPNSFVPERFLECEIDVKGRDFQLIPFGAGRRICPGLLLGHRMVHLMLASLLHSFDWKLEDGMKPEDMDMTEKFGFTLRKAQPLQAVPIKP

SEQ ID NO: 68214 - protein, 514 aa, Vitis vinifera
MIICHRHQIVSYFDLGAMDYITFLLLLPLLWAFAHVLNFSPFPQKYSAKARLPPGPRPLPIVGNLFKLRDQPHKSLADLSKIYGPIMFLKLGSIPTIIISSSKTAQQVLQKNDQPLSNRVVPDAVRALDHHQNSMVWLPASARWRNIRKTMIMHFFSLQRLDATQALRRTKVQELLDHAHQSCSRGEAVNIVDKVTLCCSDTLCLYANTVFSTDLVHHDSKFSQEIKDIVWGVMEEIGRLNVADYFPVFRLLDPQGIRRAMKIYFSKLSDIFYGIIDQRLKSEASSVASNDVLDALLNLTKEDNHEWSFSDTIHLLLDTFLAGTDTTSSTVEWAMAELISNPKTMAKAQRELQEVLGKDGIVQESDISKLPYLQSVVKETLRLHPPGPLLLPHKAQADVEICGFTVPKNSQVLVNAWAIGRDPNTWTNPNAFVPERFQGSEIDVKGRDFEVIPFGSGRRMCPGMPLAHRMVHLMLASLLHSFDWKLEDEDMDMSEKFGITLQKAKPLRAIPIRI

SEQ ID NO: 68215 - protein, 309 aa, Cicer arietinum
MKLTLVSRSGREIVKGGIQLSDSATVADLQEAIYKRIKKHPSRQRLTLPVQPGSKERPVVLNYKKSLNDYTSGNSETLTLVFKDLGPQVSYRTLFFFEYLGPLLLYPVFYYLPVYQYFGYKGERVIQPVQTYALYYWCFHYAKRILETFFVHRFSHATSPLSNVFRNCAYYWCFGSYIAYYVNHPIIYPVSDLQMKIGFGFGILCQVSNFYCHIILRNLRGPAGEGGYQIPRGFLFNIVTCANYTTEIYQWLGFNIATQTIAGYLFLAVATFIMTNWALAKHRRLKKLFDGKEGRPRYPRRWVILPPFL

SEQ ID NO: 68216 - protein, 465 aa, Candida albicans SC5314
MFPNSPDAFHQVRMMQSSIKASNFKLQSMEFRCHSNNVCEYQMEMLHHLLSVEAKTLPNLSLIEQQPEIKLGMRPLLLDFLMEVITILSLSRSTFPLTVNLIDRYCSTRIVKKQHYQLLGLTSLWISCKNLDSKFKVPTLNDLRKICVDSYYKELFVEMEKHILKSLEWVVNAPTFDAFIDLYSNLLISNSSNFEVANIIKKSSHKIKLFSNYIGELFQFYPNIYYDYTSSQIALIAILITVLTLKIPVDLISLLNFYNGLVKTEMFKSNVEQGAEDQFEEILSVDSFKSLFNKSFFKNLIKIIDNPPSSLKIKYFAENGKYSVLMKQLVTTASNTLKCILDPVPTTPKANSFVKHQQQQHHYHPRPPMSINTSMIPLTPVSNSTSPNRFSPDQIFSENESTPGIAFGTMTPDSQSTSPGEKRSYECIDELEIGTSTIAGYTLKNHDTLKRSKSANYGTLFYLQQ

SEQ ID NO: 68217 - protein, 1122 aa, Vitis vinifera
  misc_feature (821)..(821): Xaa can be any naturally occurring amino acid
  misc_feature (833)..(833): Xaa can be any naturally occurring amino acid
MSSAAQHLLKTFPFKMFRATQCLLKPLPVANGYLISLPANFTTKTPLPYLSTPFKLHLSWSLSSLSPPPLFLKNKTLSSSGVTSDGQTSDSARPGEDNTVVIKEEELTWQNQEISGSYPHVSDWKSNGNSDGGGAKMTITAKPSITDSGLMVGGRVVCNRVAENLVVSPESSGSAFLGATSPAPRSRHVFNVGVLEGYRFICLFRAKFWWMIPRVGKSASEIPMETQMLLLEVREESALDDENSSDMTSESTFYVLFLPVLDGPFRTSLQGTSENVLQFCVESGDPSVQASQVLEAVLINSGDNPFELLKNSIKILEKRKGTFAHIEHKKAPPHLDWFGWCTWDAFYTEVNPQGIREGLQSFLEGGCPPKFLIIDDGWQETINEFHKGSKLHIDGTQFATRLVDIRENSKFKSSGSESSCIDLHDFIQTIKERYRLKFVYMWHAIIGYWGGVLPSSKMMEKYNPKLAYPIQSPGNIGNLRDIAVDSLEKYGVGMIDPEKIFHFYNDLHGYLASSGVDGVKVDVQNILETIGKGYGGRVLLTRQYQFALDESIARNFKDNSLICCMSHNSDSIYSSRKSAVARASEDFMPKEPTFQTVHIASVAFNSLLLGEIVVPDWDTFHSNHSTAEFHGAARALGGCAVYVSDRPGTHDFRILKRLVLPDGSVLRAKYPGRPTRDCLFKDPVMDGESLLKIWNLNKLSGVVGVFNCQGAGNWPMKDAEAVPVLASTPTFLSGHVSPLDVEYLDQVAGDNWRGDSAVYAFYSGSLSRLSKKANLEVSLAVLKCEIFTICPVRVLGQNLQFAPIGLLDMYNSGGAVEALEXTNHPAGCRVKIXVRGCGRFGAYSSKKPLSCIVDMQEEEFQYNAEVTFVAQTSDWAQQEEDNTVIIEEEQEEKVTWENEEVEGPDAQASDWESEGEGAVTEAISDDGVVDDGEDSYSEPPEEAKVFVGNLPYDVDSERLARLFEQAGVVEIAEVIYNRETDRSRGFGFVSMSTVEEAEKAVDMFHRYELDGRLLTVNKAAPRGSQPERPPRVFEPAFRMYVGNLPWDVDSARLEQVFSEHGKVVEARVVFDRETGRSRGFGFVTMSSQTELEDAIAATDGQTLDGRTIRVNVAEERPRRSAF

SEQ ID NO: 68218 - protein, 328 aa, Blastopirellula marina DSM 3645
MHSASKMREIKIFSGRANPRLAGDICKFLNIPLGRITLGEFPDGENACKIEEDVRGRDVFLIQPTCPPVNNNIMELLIMIDSCRRASAERITAVIPYFGYARQDRKDEGRVPITAKLVSDVITAAGADRVLTMDLHAAQIQGFFNVPVDHLYAAPVLNHFFQALNIPEDELVIVSPDAGSIKRAVSHHRRLGGRLAICDKRRHSASDTTQENIIGGPVEGRTAIIFDDMISTAGSICGAAKTTFEAGAKEIYIAATHGVLCGDAIARLQAAPIKEIILTDTIPHQSGHLLPNTKILTVAPLLGEAIKRIHNDESISAIFREDFGAFQG

SEQ ID NO: 68219 - protein, 271 aa, Haloarcula marismortui ATCC 43049
MRPDLDPEQLDRYSRHIIMNDVGPEGQATLLDTDVLVIGAGGLGAPVLQYLAAAGIGRLGIVDDDVVERSNLQRQVIHKDDDVGRSKVDSAAEFVTGLNPDVTVDRHELRLARENATDLVADYDIVVDASDNFATRFLVNDACTLSGTPFSHGAIFQFEGQVTTFSGDSPCYRCLFPEAPPEGTVPDCATAGVLGVLPGTIGCMQATEVVKLAMDYGETLEGRLVAYDAAEMSFEEVPIAPKPDCPVCGDDPAIASVADASYEGRCSLAED

SEQ ID NO: 68220 - protein, 292 aa, Vibrio vulnificus CMCP6
MSIKIKTTQQIERMRIAGKLAAEILEMIEPYIKEGVTTDELNQICHDYALEKGAYSAPLDYHGFPKSICTSINHIVCHGIPASKDEIGSNGQMKPAILKNGDIVNVDITVIVPDDEKADLSVRPQGFHGDTSKMFLVGDVSPANKRLCMVAQEALYIGMRQVKPGATVGDIGTAIEKYIKDNNKNNPRNKFSIVKDFCGHGIGDEFHEEPQVVHYRNSDRRVLKEGMCFTIEPMINAGKFGCTVDAEDDWTVYTGDGKNSAQWEHTILVTKEGCEVLTLRSEESIPRLMKNI

SEQ ID NO: 68221 - protein, 104 aa, Physcomitrella patens subsp. patens
MEAVTPDELSTHSEEYSFHRVKLLCSYGGKILPRPTDNQLRYVGGETRLITVSRDISYHELVLKMGELFSHFHTIKYKLPEEDLDALVSVSSNEDLANMMEEYD

SEQ ID NO: 68222 - protein, 260 aa, Saccharomyces cerevisiae
TKFIGCIDLHNGEVKQIVGGTLTSKKEDVPKTNFVSQHPSSYYAKLYKDRDVQGCHVIKLGPNNDDAAREALQESPQFLQVGGGINDTNCLEWLKWASKVIVTSWLFTKEGHFQLKRLERLTELCGKDRIVVDLSCRKTQDGRWIVAMNKWQTLTDLELNADTFRELRKYTNEFLIHAADVEGLCGGIDELLVSKLFEWTKDYDDLKIVYAGGAKSVDDLKLVDELSHGKVDLTFGSSLDIFGGNLVKFEDCCRWNEKQG

SEQ ID NO: 68223 - protein, 310 aa, Mannheimia succiniciproducens MBEL55E
MDKIMKKLTVLGSINADHVISVPHFVKPGETLTGSNYHIAYGGKGANQAVAAARLGADVDFIACIGDDDIGKAMKAAFERDGIHTHTISTIPHQTTGIAMIQVAESGENSIVISAGANAHLTEELLAQHQESIAHADCLLMQLETPISAVEKAAVFAKRNGTKVVLNPAPAQPLSDHLLAHIDMITPNETEAEILTGVQVTDEQSAAEAAQVFHHKGIETVLITLGSKGVFFSSRGVQRIIPGFRVKAVDTTAAGDTFNGALITALLEDKSMEEAIRFAHGAAAISVTRKGAQPSIPSREETLAFLNEQH

SEQ ID NO: 68224 - protein, 699 aa, Aspergillus nidulans FGSC A4
MAIALAEADKYEVLEKIGCGSFGIIRKVKRKSDGFILCRKEINYIKMSTKEREQLTAEFNILSSLRHPNIVAYYHREHLKASQDLYLYMEYCGGGDLSMVIKNLKRTNKYAEEDFVWRILSQLVTALYRCHYGTDPAEVGSNLLGPAPKPSGLKGKQAQMTILHRDLKPENIFLGSDNTVKLGDFGLSKLMHSHDFASTYVGTPFYMSPEICAAEKYTLRSDIWAVGCIMYELCQREPPFNARTHIQLVQKIREGKFAPLPDFYSSELKNVIASCLRVNPDHRPDTATLINTPVIRLMRREVELNNLSRAARKREEATMQKAKDVEQAFAKLEKEKQQIRSELENSIRREWEVKARLEIDRQVQNELDKLRKRFECEVQDRVAQEVEKQRRNANYREDASLRSSGHSSQMSSSNSEDSDFPSSTDISQLSLESPTNKAAKLPKKESRTPFTRSKTVVDSPMDIQMAEPSPISIASLSLSPRRTSATYSGKNIFAEGERKRPKFEPTLAYSDDEDDTPELPSPTRPKVKPDPFKAPSRPLLRQNTTALMQKLSTQPPIFPANPSRLPQMSAPDVRESKSRSPHRRLSKIPSSANLAADAGSPTRKNGVKSSPSKMNGGDEMFKAVMQRNMGGRTLVELAQARAGGRPIDEVKRCASDSRSGCSVPMKSADRDPPAVWDPERDEMPSPFLARGRKVIRNLR

SEQ ID NO: 68225 - protein, 519 aa, Oryza sativa Japonica Group
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCLLRECTIGHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 68226 - protein, 256 aa, Xanthomonas axonopodis pv. citri str. 306
MIKSPDEIALMAVSGQLLAQVFNALDRLPLEGRSTLELNEFVERMIVDELDARPASKGQYGFEFVLNASIDDVVCHGVPSADDVLRSGQIVNVDITLEKNGYIADSSTTYLVGEVAYPARRLVQATYQAMWKGIAAVRPGARLGDIGHAIARHAHAHGYSVVKEYCGHGIGREMHEDPQILHYGHAGTGLALQEGMVFTIEPMINQGRAAIRSQPDQWPVHTRDGKLSAQFEHTVAVTRTGVRVLTLRPGEVPPVR

SEQ ID NO: 68227 - protein, 395 aa, Glycine max
MSRRLFGVVTNRAGGSRGCIRLSHQRAARWPGPVCCGLDATIFASGGRVESFRGASVPCRCTDPGLLLPRANLTFWRNGSLVRERNAMLPTISSKDWLDIDFGISEGVDFIAISFVKSAEVITHLKSYIAARSRDSDISVIAKIESIDSLKNLEEIVLAADGAMVARGDLGAQIPLEQVPSAQQRIVQVCRQLNKPVIVASQLLESMIEYPTPTRAEVADVSEAVRQRADALMLSGESAMGQYPDKALTVLRSVSLRIERWWREEKRYEAMLLPSVGSYFSEKISEEICNSAAKMANNLEVDALFVYTKTGHMASLLSRCRPDCPIFAFTTTSSVRRRLNLQWGLIPFRLSFTDDMESNLNRTFSLLKARNLIKSGDLVIAVSDMLQSIQVMNVP

SEQ ID NO: 68228 - protein, 393 aa, Zea mays
MKVLVLAVLALVAAASAAGQGEEGGGPPLPFALGAAPAGCDVAQGEWVRDDDARPWYQEWECPYIQPQLTCQAHGRPDKAYQSWRWQPRGCSLPSFNATLMLEMLRGKRMLFVGDSLNRGQYVSLLCLLHRAIPDGAKSFETVDSLSVFRAKNYDATIEFYWAPMLAESNSDDAVVHSADDRLIRGAPMDRHYSFWKGADVLVFNSYLWWVAGDKIQILRGADNDPSKDIVEMKSEEAYRLVLHQVVRWLERNVDPGKSRVFFVTASPTHTDGRAWGDDDAEGSSNCYNQTSPISAASSYRGGTSREMLRATEEVLATSRVPVGLVNITRLSEYRRDAHTQTYKKQWVEPTAEQRADPRSYADCTHWCLPGVPDTWNELLYWKLFFPSNDQVL

SEQ ID NO: 68229 - protein, 499 aa, Vitis vinifera
MDYTPLVLLLLLPCFVWLCFHFLILGSTHRKSFQARLPPGPRPLPIIGNLLELGDKPHQSFTTLSKTYGPLMSLKLGSTTTIVISSPKTAQEVLNKKDQAFASRTVLNAIQIQDHHKFSMVFLPASAHWRNLRKICSMQIFSPQRVEASQDLRRKVVQQLLEHARESCNSGRAVDVGRAAFTTTLNLLSNTFFSVDLAHYDSNLSQEFKDLIWSIMVEAGKPNLADFFPGLRLVDPQGIQKRMTVYFNKLLDVFDGFINQRLPLKASSPDNDVLDALLNLNKQHDHELSSNDIRHLLTDLFSAGTDTISSTIEWAMAELLNNPKAMAKAQDELSQVVGKDRIVEESDVTKLPYLQAVVKETFRLHPPAPFLVPRKAEMDSEILGYAVPKNAQVLVNVWAIGRDSRTWSNPNSFVPERFLECQIDVKGRDFQLIPFGAGRRICPGLLLGHRMVHLMLASLLHSFDWKLEDSMRPEDMDMSEKFGFTLRKAQPLRAVPTKP

SEQ ID NO: 68230 - protein, 499 aa, Vitis vinifera
MDYTPLVLLLLLPSFVWLCFHFLILGSTHRKSFQARLPPGPRPLPIIGNLLELGDKPHHSFTTLSKKYGPLMSLKLGSITTIVISSPETAQQVLNKKDQTFSGRTVPNAIQVASHHHFSIGFLPASAHWRNLRKICSMQIFSLQRVDAFHGLRQKVVQQLLDHAHESCSSGRAVDIGRAAFTIALNLLSNTVFSVDLAHYDSNLSQEFKELIWSILVEVGKPNLADFFPGLRLVDPQGIHKRMSVYFNKLFDVFDSFINQRLQLRASSTDNDVLDALLNLNKQHDHELSCNDIRHLLVDLFSAGTDTTSSTIEWAMAELLNNPKAMAKARDELSQVVGKDRIVEESDISKLPYLHAVVKETFRLHPPAPFLLPRKAEMDSEILGYAVPKNAQVIINVWAIGRDSKTWSDPHSFGPERFLECDIDVKGRDFQLIPFGAGRRICPGLLLGRRMVHLVLASLLHSFDWKLEGGMKPEDMDMSETFGFSVRKAQPLRVVPIKP

SEQ ID NO: 68231 - protein, 373 aa, Vitis vinifera
MGFLPASAHWDNLRKICRMQIFSPQRVDAFHGLRRKVVQQLLDHAHESCSSGQAVDLGRAAFTTALNMLSNTFFSVDLAHYDSNLSQGFKDLIQSLIVESEKPNLADFFPDLRLVDPQGIQRRLTVSFNKLVDIFDGFFNQRLMLKASSTDNDVLDGLLNLNKQYDHELSCNGIKHLLLDLFPAGTDTTASTIEWAMAELLKNPEAMAKAREELSEVTRYIEESDISKLPYLQAVVKETFRLHPTIPLLVPRKVETDLEILGYAVPKNAQVLVNAWAIGKDSRTWSNPNSFEPERFLESEIDVKGRDFQLLPFSGGRRICPGLLFGHRMVHLMLASLLHSFDWKLEDEDMDMDEKFGFALRKVQPLRVVPTKP

SEQ ID NO: 68232 - protein, 322 aa, Oceanobacter sp. RED65
MQTVQTILEKHRVSDSLAQAIHCVLDCSKEISVLLQKGAMAGVLGSAENENVQGETQKKLDVISNDLLKERLAECPVVAGIASEEEDLPVAANEDGQYLVIYDPLDGSSNIDINVTVGTIFSILPSRGEDPSKEATYLQNGRQQVAAGYVLYGPATMLVMSTGKGVDIFTLDPTSNEFVLTQEQVQITPSTKEFAINMSNQRFWAEPVQTYVSDLLAGEEGPLAKRYNMRWIAAMVAEVHRILNRGGIFMYPWDNREPNKPGKLRLMYEGNPMSMLVEQAGGLSVNGEINIMDIEPEKIHQRVPVFLGSKEEVEKALSYHKA

SEQ ID NO: 68233 - protein, 249 aa, Vibrio sp. Ex25
MDILSDQEMLRYNRQIILRQFDFEGQEALKQSSVLILGAGGLGCASSQYLATAGVGNITFIDDDIVELSNLQRQVLHHDADIGRKKVDSAADALRELNPHIEVNTVAKRLDDIQLQALIEQHTVVVDASDNVDTRNQLNRLCFATKTPLISGAAIRMEGQVSVFTYDDPTQPCYQCLSALFGSSALSCVEAGVMAPVVGIVGAVQAMETIKVIANYGQPKKGKILILDAFSMSWREMNLMKMPTCPVCG

SEQ ID NO: 68234 - protein, 575 aa, Candida albicans SC5314
MENKVSEISEMTTDLNSNSETKFDHFTTTTKTTTDQIQKKSTETTTTTQSISINSKDEKKAGSKLSRVVKVSRRALTTYASFIGPGLLVSVAYMDPGNYATGITAGASNKYSLLFIVLLADIIAIFLQVLCIKLGCVTGYDLARCCREYLPKKLNWILWILAECAIISTDVAEVIGSATALNILLKIPLPAGVVITIVDVIFVLIAYRTDTSSLKFVKIFEYAVGCLVMIVVICFAVELSQITANVGQVFRGFVPSKEMFDGNGMTVATSVIGSTVMIHSLFLGSGLVQPRMRDYDVKHGYVNLYEIAKEEKVQEEEEEDQTEISPVASNPIQNNIAPTYEQEAKFFRIKYKPSYKSICYCLKYSKIELIVTLATIALFVNAAIVIIAGATLYGTSEAMNADLYTIHSLLSKSLSPAVGTIFMVALLSSGQSAGVVCTIAGQMVGEGHINWTLKPWMRRILTRAISIIPCLTISVFIGKNGLGVALNISQIIISILLPPLTAPLIYFTCCKKIMKVELGEEDEVEGIEDEGSGKRYKYMTNSWLTTIIVVIIWLLVAILNVYAIYQMAVSGVTGS

SEQ ID NO: 68235 - protein, 594 aa, Synechococcus elongatus PCC 6301
MQPNDFQRRTKIVATIGPATSKPEVLRALIEAGASTLRLNFSHGTHDDHQRSIRLIRQISFELNRPVGILQDLQGPKIRLGRFADGPITVQKGDSFILTSRSVPGSQTISSVTYEPLADEVPEGATILLDDGRVEMTVVKVDRQTRELHCEVVVGGILSNNKGVNFPGVYLSVKALTDKDREDLIFGLDQGVDWVALSFVRNPQDVLEIKELISRAGKSVPVIAKIEKHEAIEQMEAVLSLCDGVMVARGDLGVELPAEEVPILQKRLIRTANRLGIPVITATQMLDSMVSNPRPTRAEISDVANAILDGTDAVMLSNETAVGKFPIEAVSTMATIAHRIEAEQQYITLNPTPTSSIPNAISQAVGHIAEQLDAAAIMTLTQSGATARNVSKFRPTTPILAVTPNIDVARQLQLVWGVQPLLVVDLPSTSQTFRAALNVAQERTLLKEGDLVVMTAGTLPGVSGSTDLVKVEIVTAVIARGIGVGQGSVSGKARVIHNAAEAATLAQGEILIATQTSADYIEAIRKASGIVTEEEGLTSHAAVIGLRLGIPVIVGVKNATSVVRDGSILTLDVKRGLLYSGAVGAVAAEQPISV

SEQ ID NO: 68236 - protein, 218 aa, Zea mays
  misc_feature (92)..(92): Xaa can be any naturally occurring amino acid
  misc_feature (112)..(112): Xaa can be any naturally occurring amino acid
MQARVVDFVADKMNRAWVGFGSAPEGSMKSRIHSFGLKLLSRVRPSEVLLKSVTKDVSALEIVHPASINSRLVRRRLRHIAVRGASVHKKFXLYGSVCLLPVTSVFMVLPLXNIPFFWVLFRAYSHWRALQGSERLELLVSDCSDKWKVLEEKINSVKDGKPSENARNSPWKLRPSEKLDRFLEGRNLDEGLDCDTILSICQEYDLDKIDVLKYRDLP

SEQ ID NO: 68237 - protein, 203 aa, Anaplasma phagocytophilum HZ
MRRLMNLVTKPAIDFTARAVMSDGKMCDLTLSKHVAGKYAVLFFYPRDFTFVCPTEILSLHSRIPQFSEQNAEVIAISTDSEFAHSHWRNTPLEKGGIGMVSFPLVADDSHSISESYGMLFAGKVSLRGTIIIDENFVVRHQSINDLPIGRNVDEFLRIIDAIEHHKKHGEVCPAGWSKGKVAMEATQQGVEHYLQSHIDSLS

SEQ ID NO: 68238 - protein, 156 aa, Zea mays
MAADPSRRRPEYHPAVNDVLLTLTNARGTLADVQRRLDLEFRAAYPDHANPAKLVARVKRLEEEAAALKEMCRDLLTQKQELIDQIRVSLMAQRGMTQRLLAASGLPPLSDADETVHNSLNEVIQDWTAQVSPITREIEDLDKKKNANQMLFSAII

SEQ ID NO: 68239 - protein, 271 aa, Candida albicans SC5314
MSRPEELAPPEVFYNDSESFKYTSSTRVQHIQAKMTLRALELLNLEQDSPQFLLDIGCGSGLSGEILTEEGYNWIGMDISPSMLATGLDRDVEGDLFLGDVGNGIPFRAGTFDAAISISVIQWLCNADISGADPKKRLLNFFNTLYASLKRGGKFVAQFYPKNDVQTENIMGAAKVAGFGGGLVIDDPESKRHKKYYLVLTAGMADRQINLSGAEMDAPAEQQTKGLSRKRKKAMESKKDFINRKKEIMRKRGRKVAEDSKFTGRKRRPRF

SEQ ID NO: 68240 - protein, 152 aa, Prochlorococcus marinus subsp. pastoris str. CCMP1986
MIKERTFLAIKPDGVQRGYVSDIIGRFEKKGFKLVGLKQLIPTKQLAQDHYGVHRERPFFKDLVEFISSGPVVAMIWEGEGVILSARKLIGATKPLEAEPGTIRGDLAIDIGRNIIHGSDGEETAKFEINLWFNQDEICDWETSDSEWRAEN

SEQ ID NO: 68241 - protein, 268 aa, Anaplasma phagocytophilum HZ
MVERLTCNQDVVGSSPAVGSLCVIIMDDMSFLVVANWKANGNARLAESFLDVLSSQNSLSGGSTCSVVLCPPYTAMPSLRGRSCVVRLGGQDCFAGVSRGCTGEITAKMLRECGCEYVILGHSDRRTLLNESDSLIKLKAESAIGECLIPIICVGENREERESGATGRVLLEQCRSCLPEEGEFFVAYEPIWAIGGSVIPDIAMIEEAFSIIKSHNPGLRIIYGGSVNESNIRSLKTGVSGIAGVLVGSASLDADGFARMLDNVMECL

SEQ ID NO: 68242 - protein, 373 aa, Blastopirellula marina DSM 3645
METDDSFDHHVDPKRPSPLSAPIRKMVTGAVLFVLICVVAVIGYVSAGWELADSIYMVIITIFGVGYGEVQPVESIPLRALTIVVIIAGYGAVIYTVGGFMQMVVDGELQKALRSRRMTKDIEKLSGHTILCGVGRMGSILARELHAEGKPFVVIDADDARLQAADAMGYLIVKGDATEEFVLEQAGIRKASVLATVLSADATNVFVAVTAREMNPDLMIIARAENPRTEKKLIGCGANKVVLPTAIGAKKLAQMIIRPSAENMLEQLTHRSDMNEELGRIGLQFDELQVAEGSTLVNKQLGDIELRSNHGFLIVGIRRLDGSTMLNPPANTVLAAGDIVIVLGHDDDIPQLAERFSATKGKIMYRGAMIDAD

SEQ ID NO: 68243 - protein, 217 aa, Solanum tuberosum
MVPPIETQVKSPVSQKFSIPPLNERILSSMTRRSVAAHPWHDLEIEPDAPQIFNVVIEISKGSKVKYELDKKTGLIKVDRVLYSSVVYPHNYGFIPRTLCEDSDPLDVLVIMQEPITSGLDFLRAKAIGVMPMIDQGEKDEKIIAVCADDPEYKDYADINELPPHRLAEIRRFFEDYKKNENKEVAVNDFLPSDKAFEAVQHSQDLYADYIVESLRR

SEQ ID NO: 68244 - protein, 377 aa, Xylella fastidiosa Ann-1
MNSFAAVPVLIEEVRAGRMVVIVDDEDRENEGDLIMAAELVAPKDINFMVTHARGLVCLSLTRERCAQIGLSPMVQRNTTRFQTNFTVSIEAAEGLTTGISAYDRAHTIRTAVRPNAKPSDLHQPGHIFPLIAQPGGVLTRAGHTEAASDLPMLAGLEPAGVLVEIMNADGTMARRPQLEVFAQQHGLKIGSIADLIAYRLANEHTVERVDERVIETEYGSFLLVTYRDRIAHDLHFALVRGTLDASIPTLVRVQVENPLADMLHWRREDFGMAASDALRMIAAAERGVMVMLAAPRDSDVLLARLRSEPEVVSNVKDVGQWRRNGAGGQILADLGLAKLRVLGTPRRQIALAGFGLEVLEYLECRGGVPFASQGVD

SEQ ID NO: 68245 - protein, 380 aa, Moritella sp. PE36
MEMNMTDKFIKSKAAIAWGPNQPLSIEEVDVMLPRKGEVLVKVIASGVCHTDAFTLSGDDPEGIFPVILGHEGGGIVEQIGEGVTSVQVGDHVIPLYTPECGECKFCKSGKTNLCQQIRETQGKGLMPDGTTRFYKDGQPIFHYMGCSTFSEYTVLPEISLAKVNKEAPLEEVCLLGCGVTTGMGAVMNTAKVEEGATVAIFGLGGIGLSAVIGATMAKASRIIAIDINESKFELAKKLGATDFINPKDYDKPIQDVIVELTDGGVDYSFECIGNVDLMRSALECCHKGWGESVIIGVAGAGKEISTRPFQLVTGRVWRGSAFGGVKGRTELPDYVERYLQGEFKLSDFITHTMGLEDINEAFDLMHRGESIRSVIHFDK

SEQ ID NO: 68246 - protein, 273 aa, Clostridium perfringens str. 13
MDKIIIKDFEVFGNHGVFEEEKRLGQKFVLSIELFLDTREAGVTGDLSKSVHYGELAHKVEEEFKKQSYDLIETAAEKLCEFILLEYPLVKKVKVSLKKPWAPILRSLDTVSIEIERGWNEAYLSYGSNIGDKKYYIEEALKEINKAYHTEIIKKSNLIETEPWGYTEQDEFLNGACKIKTLLNPKELIKFLLSIEQKLKRERKIKWGPRTIDLDVIFFNDLISEDEEIILPHPRMHERSFVLEPLNEIAPYKIHPLYRKRVFELLEELNKNK

SEQ ID NO: 68247 - protein, 451 aa, Prochlorococcus marinus str. MIT 9303
MSDAISHEIDHFMKGLMKRNPGEPEFHQAVHEVVETLIPFILSNRVYKDAQILERMTEPDRVVIFRVCWEDDAGNIRTNRAWRVQFNNSIGPYKGGIRFHPNVTLSVLKFLGFEQTFKNSLTGLPMGGGKGGSNFNPKGKSDREIMRFCQSLMIELHRHIGEDTDVPAGDIGVGSREISYMFGQYKRLENRFSGILTGKGLSFGGSLVRTEATGYGCAYFCENMLNHIEDSLVDKICSISGSGNVALYAVEKAIELGAKVVTLSDSDGFVHVPNGINLEMLAFVKELKTVRRGRIHEFANHYKGVDFYAGKRPWNVPCDIAFPCATQNEINRADSQELINNGVKAVVEGANMPTNLDGIHEFRHAKVILAPAKAANAGGVAVSGLEQSQNALRLSWSREEVDQRLKSIMLEIHSKCVQHSHKYEDYTDYITGANIAGFKKVADAMLAYGIV

SEQ ID NO: 68248 - protein, 494 aa, Oryza sativa Japonica Group
MAEEEVAAVVGELRGSFRSGRTRAAEWRAAQLRGIVRMVEEREGDISDALHSDLAKPRMESYLHEISLAKAACTFALKGLKNWMKPEKMLIMLTLINDDQVPAALTTFPSTAQIVSEPLGVVLVISAWNYPFLLSIDPVIGAIAAGNAVVLKPSEIAPATSALFAKLLPEYVDSSCIKVVEGGVPETTALLEQKWDKIFYTGSGNVGRIVMAAAAKHLTPVALELGGKCPAIVDSNTDLHVTMKRLAVGKWGCNNGQACIAPDYVITTKSFAPELVDSLKRVLKRFYGEDPLQSEDLSRIVNSNHFRRLTNLIEDKKVAQKIVYGGQTDEKQLKIAPTVLLDVPLDTTLMAEEIFGPLLPIVTVDKIEDSIQFINSRTKPLAAYLFTKDKKLQEEFVSNVPAGGMLVNDVALHLANPHLPFGGVGDSGIGSYHGKFSFDCFTHKKAVLIRGFGGEATARYPPYTIEKQKILRGLINGSFFALILALLGFPKERR

SEQ ID NO: 68249 - protein, 278 aa, Vitis vinifera
MAAAALTTDTSLCARIPASLNSEPLSGRYPVRSLSYSDPHILVSDPFMWNCQDGDAFRPTRPFSLDTSTHFSLSPQNDYLFFNCSEDDVIVEPKPIFCERFPDRCDSSCDSASYLCRHLPECASALGGSSCCSYYPKATESLRLMLKYCASYTSVYWRSSGGNPPDDQIPEYGVRVDFDIPVTTRCLQCQDTTKGGGTCGFDTQTQDFLCLCEQGNTTTYCKDLVVRHNKRIGVIAGTATAVSFAGVVGIAAGIWYLIKLRKKAPVACGVQSNENRLF

SEQ ID NO: 68250 - protein, 545 aa, Thellungiella halophila
MAMLASYFDSFISKMPSLSTSDHASVVSLNLFVALLCACIVLGHLLEENRWMNESITALLIGLATGVVILLISKGKSSHLLVFSEDLFFIYLLPPIIFNAGFQVKKKQFFRNFVTIMLFGAIGTVISCTVITLGVTQFFKKLDIGTFDLGDYLAIGAIFAATDSVCTLQVLNQDETPLLYSLVFGEGVVNDATSVVVFNAIQSFDLTHLNHEAAFHLLGNFLYLFLLSTLLGVATGLISAYVIKKLYFGRHSTDREVALMMLMAYLSYMLAELFDLSGILTVFFCGIVMSHYTWHNVTESSRITTKHTFATLSFLAETFIFLYVGMDALDIDKWRSVSDSPGTSVAVSSILIGLLMLGRAAFVFPLSFLSNLAKKNESEKINFKMQVVIWWAGLMRGAVSMALAYNKFTRAGHTDLRGNAIMITSTITVCLFSTVVFGMLTKPLIRHLLPHQKATTSMLSDDNNTPKSIQIPLLDQDSFIEFAGNHNVPRPDSIRGFLTRPTRTVHYYWRQFDDSFMRPVFGGRGFVPFVPGSPTERDPPDLSKA

SEQ ID NO: 68251 - protein, 498 aa, Dunaliella salina
MARLALLGAALLCALAVSTQGSPEGHGTKTEMMGAGRLLQQGPHTNSDPPYNYNCHGFDWAASSSSAEITELCDSPASSFPVADCDGDMQSPINIVTSELADPTDRSGVSGINLRGMGSSDFVLRSNVKVNIEQDMKISWDAPTSGNLPTIMIDGTEQRFQPIQLHFHHFASEHTINGQLYPLEAHLVMASLDDPNQLAVIGTMYKYGNGDDFLARLFGKVEDALEERDDVSYGSKEVPIDMEISPKDHVLPQSSLEYAGYDGSLTTPPCSEVVKWHVFTSPRTISIDQLKTFERVSLNAHPNEAIPTNNRVIQPLGTRAAYRYEATAMDDSGDGTGNADELSSPTTVTATYDIMVSGTASSLADMFNNGARLDNGGFGPDDQAEADLLRQIQRRARANSGAEGAEVVRMMKFTAALGRRRLNQQGAAAEMDIRYYFEGSTDQEEATSAVNGMNPSSLGSSSSGLTDVQQTEVTSSASSLRAGLGLVVAAFFGAALAL

SEQ ID NO: 68252 - protein, 377 aa, Xanthomonas axonopodis pv. citri str. 306
MSSPLPSPSTQAFGDPAAIRCERAASELRAGRPVLLTAANGQARAVLALDSSTAQSYAAFARAARGRHYLFVTPTRAQVLGLSAPQGARVGLIDHSYDQLAALAYLRDTPVPAQWTAGDALDAGGVEIARLGLLLPALLAVELRDVHDHAAFAGCQSLALDDLLRGCATSAAAGYELVTRTPVPLRGLGMSEFVVFRGGVAQRDQVAIVVGQPDLGTAVPVRVHSSCLTGDLFGSLKCDCGDQLRHGLAKLKELGGGVLLYLDQEGRGTGIAAKMRAYGYQHAGLDTIDADAQLGFGPDERRYGSAVAMLRGLGIGRIRLLTNNPAKAERLRAAGIVVEDRIAITGDITAENEQYLRTKAARAGHALDVDALILAAQ

SEQ ID NO: 68253 - protein, 128 aa, Photorhabdus luminescens subsp. laumondii TTO1
MAYSEKVIDHYENPRNVGSFDSEDPMVGSGMVGAPACGDVMKLQIKVNNEGIIEDARFKTYGCGSAIASSSLVTEWMKGKSLEQAEAIKNTEIADELELPPVKIHCSILAEDAIKAAIADYKSKRQGR

SEQ ID NO: 68254 - protein, 364 aa, Clostridium perfringens str. 13
MGEVMDIIGSINTRFLSKSEQSKKEIFNKIDNIVKGGGNIIRMNLSHGKHRDVECCIDYIRSNHKNVKILLDLQGNKIRVANNIYGTFKVNSGDLVYFCSEETYDAYLKNIDRNKLIPLNIKNKFIYNNTFKKIYMKDATMEFIVISNNNGLIKTKVKLGGVVRKEKGCNLPNLDRKNWGVSEKDLEDIKFAIDNKVDIIDYSYCSYMEECREFKNIVFKNLKSNQFIPKLWGKIETNEGINNIKEVAKELDGIVIARGDLTAEIGILNVPIVQEKILYALKNENKSIIVATNVLSSIRNKQNKPTINELSDIYHFIRCGATGFMLTGETSTGENEEYVVTTLKNSIKYYEKLLSKIKKRSKRV

SEQ ID NO: 68255 - protein, 154 aa, uncultured gamma proteobacterium eBACHOT4E07
MIIKIISIGNKLNTWEQDSINFYLKQLPKNLKIEFVNLKSHQNPNYSESEVVKKESQLIMSKLSKDDFIIAFDMNGDQICSKKFSDLIFNNQESDKTITFVIGGSFGLSSEIKDNSNKVLSASLFTFPHRLFRLILVEQIYRAHTIVNNMPYHK

SEQ ID NO: 68256 - protein, 440 aa, Micromonospora olivasterospora
MEATVVQVVLAVAVITALSYLLGLVARRLGQPAVIGQMFAGIALGPSVLGQLPGDLGKALFPMAIRPYLTVVAQLALVLFLFYVGYELNRGLLRQRVQAVPLVAAAAFVVPMLLGAGSTVAFADWYAATGTPEVPHGAFVLYVAVALSITAVPVLAGIINERGLAGAMTGVVALTSAGVIDALGWLALTAAMLHGKVGGQRPWSVTLLLLLAYLLVMVVVARPALGWLRRQALASGRSAASLLPVAATFAMASAWATGAMGLHVILGAFIAGLIMPRGETGHPDPALLTAVEKAGSVLLPVFFVVSGLSTDLGALHAADLGLLVVICVAATAGKLGGGSLAARVSGLSWRESTNIGVMLNTRGLTELVVLNVGLQAGFVNGRLYTVFVLMALLTTAATGPLLTLLARRDPAPKAPELVARRRVGRSGDVHGPKVTERTVE

SEQ ID NO: 68257 - protein, 466 aa, Corynebacterium glutamicum ATCC 13032
MKNKRVAIIGAGPSGIAQLRAFESAEKQGHEIPELVCFEKQDTWGGQWNYSWRTGTDSYGEPVHSSMYRNLWSNGPKEVLEFAEYSFDEHFGKPISSYPPREVLWDYIAGRAKKSNVEKYIKFAHVVRWVSFDEATKLFTVTVENLRTGETSSDTYDNVIVGAGHFSFPNVPHFDGVETFPGQIMHAHEFRGAEAVADKDILLIGASYSAEDIGTQAYKMGARSVTFSYRSNPMGYEWPEEMTELPLVERFDGSEVHFVNGEKRKVDIVVFCTGYLHHYPFMPSELTLSSPNNLYPDTLYRGVVSEANNQLFWLGAQDQWLTFNMFDAQAWYVRDVILGRVALPSKEAQRNHMDKWLSRFEGLKSENDQIDFQCDYVEDLIDQTDYPSFDLKEVANILKGWVKSKEEDILNYRDYTYTSVMTGTTSVEHHTPWMIELDDSLERYLSEPQEDEARQVYRGKKVRDKA

SEQ ID NO: 68258 - protein, 267 aa, Photorhabdus luminescens subsp. laumondii TTO1
MHPMLTIAIRAARKAGNLIAKNYETPDAVEASQKGSNDFVTNVDKAAEALIIDVIRKSYPKHSIITEESGELLGEEADIQWVIDPLDGTTNFIKRLPHFAVSIAVRIKGRTEVAVVYDPMRNELFTTTRGQGAQLNGYRLRGTNARDLDGTILATGFPFKAKHHSTVFINTLGKLFVRCADFRRTGSAALDLAYVAAGRVDGYFEIGLKPWDFMGGELLVRESGGIVTDFVGGHNYIHSGNIVAGNPRVVKDILAEMRDELSEALKR

SEQ ID NO: 68259 - protein, 138 aa, Zea mays
MAEKEGAKVGAEEMEEREQEGEAEEVEVKFRLFDGSDIGPVRCNAAATTVAALKDRVVADWPKDKSIIPKTASDVKLISGGKILENDKNVAQCRAPFGDLPSSAITMHVVVQPSSAKSKPDKKANKLPKTTRCSCTIL

SEQ ID NO: 68260 - protein, 275 aa, Clostridium acetobutylicum ATCC 824
MKKAAVLGPKGTFSEFAVKEYKNKIDNNIEMIFCSTISKVVKAAEEECDIAIIPIENTLDGFVQVTLDLLSKTNLNIIYELVLPIQFAFAANSKMEEVQRVYAQFKTQGQCCEFLEKHDEFKIITTESNGQSLKKLKEGVLGEGAIVPAYAVKGTNKFKCNINNVTDSEGNETRFIVLSKEKVQYEGKGYYKTGIIISDANADKPGTLWRVLNEFSVRDINLTSIISRPTKKGLGQYYFFIEVDGCYFKDNRLNEAVEAIKHHSVVKVVGTYYKI

SEQ ID NO: 68261 - protein, 377 aa, Clostridium acetobutylicum ATCC 824
MKVPIIMTPGPTSVRENVRLSRAEKTTNPDLDMDFYDFYKKTTEKIGKFLKTKNEVRILSGEGILGLEAACASLTEKGDRVLVIENGIFGEGFADFVKMYGGEPFFFRGNKKCSINIEELERFLDSDSEFKYATVVHCDTPSGMLNNVGAICKLLKKKGIMTVVDSVSAMGGEELKVDEWDIDIVIGGSQKCISAPPGLTIVSISDDAFSAMKNRKTPIASFYCNLLVWEDYYNKKWFPYTPPISDIVALRKAVENILEEKDIIARHDKIASATRAAVVLGGLEIYIEDGFSNTVTVIKVPHGMNDDKILSYMKENYNVMIAGAFDYLKGKVLRIGHMGENAYVDKVSYTLFALQRTLEHYGFEFKRDMVKVFLEKV

SEQ ID NO: 68262 - protein, 710 aa, Oceanobacter sp. RED65
MQHTFFIAPTEMKTGLTSITLGLMRALDQLGVKVAACKPISREQYDNTHRSIELIAAASGKQPPTPISLPEAQKMMSDKKHDRLMEEVVAMHHKIAKDVDVVIVEGVEPDRNEPYALRLNVEMAKTLDAEVILVAAPNDRDQKALASHVDMAKNLYGGDKNQKLLGIILNKINAPANRSIPIKTQEGPEPTPLSLDELKASYKSLETDHFKLLGLIPWDSDLVAPRTKDIANYLQADVISAANMEDARVKRISLCARTVPNMITALQPGALIVTPGDREDILLAAAMAAQNGMPLAGLLFTSDLDPDERVMGLIAPALAHMPVLKVSTDTFTTATQLASMDDGVKASDPQRMNAIMTHMAEHLDSEYLAARLEVDHHVRLSPAAFRYQLVQLASQANKRIVLPEGDEPRTIQAAAMCQQRGIARCVLLGNPERIQQVAASLGVTLPEDLEILDPEAIRERYIDPMVELRKHKNLTAPMAEAQLEDNVVLGTMMLALDEVDGLVSGAVHTTANTIRPALQIVKTAPDAKLVSSVFFMLLPEQVMVYGDCAVNPDPNASELADIALQSAQSAEAFGIAPKVAMISYSTGSSGSGSDVEKVREATSIAQKNRPDLLIDGPLQYDAATTASVAASKAPDSKVAGQASVVIFPDLNTGNTTYKAVQRSANVVSIGPMLQGLAKPVNDLSRGALVEDIIYTIALTAIQAANQAKAK

SEQ ID NO: 68263 - protein, 247 aa, Oryza sativa Japonica Group
MKLRPKRPGWKSLMPLQLSRKSALRFFLFPKVQAAGQSPDDTPVYLNVYDLTPMNGYVYWAGLGIFHSGIEVHGVEYAFGAHDYPSSGVFEVEPRQCPGFRFRKSIFLGTTCLDPIQVRQFMELQSVNYNGDTYHLITKNCNHFCKDMCYKLTGNKIPKWVNRLARIGAICNCLLPESLKISPVGHDPNSRPEDCEKRRLRNPLSCFSSISSQRQLPPSSPFPTSPVKEPLAYSSSRKSSAPSLRNR

SEQ ID NO: 68264 - protein, 104 aa, Physcomitrella patens subsp. patens
DEDYKSETQDMIGQVRSTLAMEKTDPNKAAAVAKLRQSGNEWVAKYRKAKKVAGKPSFSNMYSVINAISGHYVSFGATYPIPAKRKDRILDEVKDAEKALNRGR

SEQ ID NO: 68265 - protein, 344 aa, Bacillus clausii KSM-K16
MNVKMAINGFGRIGRMVFRKAFLEGKVDITAINASYPADTLAHLIKYDSIHGPFMADVYAKDGQLFVNGKKIELLAERDPRRLPWEALGIDIVIEATGKFKTKEAAGAHLQAGAKKVIITAPAKGEDATIVVGVNESDYNPQEDHILSNASCTTNCLAPVAKVLDEKFGIESGMMTTVHSYTNDQKNIDNPHKDLRRARACGQSIIPTSTGAAKALSKVLPNLDGKLTGMALRVPTPNVSLVDLVVNLKTETTAEAINNAFWEASQGTLKGILGITDEPLVSIDFNGEEQSAVVDGQSTAVLNNRQAKVLAWYDNEWGYSCRVVDLMNHVAAQMSTKEEIHSAS

SEQ ID NO: 68266 - protein, 495 aa, Gibberella zeae PH-1
MTSTTQISLPNGKKYDQPTGLFINNEFIAATGDEFVVTNPHTEEEVIKLKGASKEDVDKAVQAARKAFEGEWSELAAVDRGAFLYKIADLIDRDRELIAAIDAFDNGKPFSACLAGDLDESYNVFRYYAGAADKISGKTIETSPAKLAYVLQEPLGVCGQIIPWNFPFMMLAWKVAPALACGNTVILKPAEQTPLSALYFGNLVKEAGLPAGVVNVLPGLGPSTGKAIAGHMDIDKVAFTGSTNTGRAIMKDAANNLKNITLECGGKSPSIVFADAELEQAVKWCHFGIMDNKGEVCTSTSRIYVHEDIYDKFLEKFVEVTKENDKLGAPFDESTVQGPQVSKTQYDRVLSYIEEGRKSGAKLLYGGSKHGGKGYFLQPTVFADTTEDMKIMKEEIFGPVVSIAKFSTDEEAIKKANDTSYGLAAALFTEKIARAHKVARKLQAGMVWINSSGDSHFGIPFGGYKSSGIGRELGQYALDAYTQPKAVHVNLGFEL

SEQ ID NO: 68267 - protein, 423 aa, Anaplasma phagocytophilum HZ
MYEHAHWFQEEKVLFPYSSAVPAVAPMRVVSGQGSYLELEDGKRLLDGISSWWSVCHGYSHPYIVGKMQEQLAKLSHVMFCRDLIHEGAYVLASRIAKLMPPGLDRVFFADSGSMAVEVALKLAVQYWYSMGKREKHSFIYFKNSYHGDSMGCISISDPAAIHGDSFTRYCPKQYLLDIPASEEDVVLLQQKIESIADKVAAIIVEPLLQAAGGMVIYPPHVLSTLRKIAKENEILFIADEVATGFYRLGTSFACEQASIQPDIMVIGKALSGGTCPLSAAVVSSNISELFISGGETFMHGNTFMAHPLSCAAANASLDLFAGESYTQKVSGIERILKAELEELHALDYVCNVRIKGAMAAFNIKNECVEKLKNGMTQKLLDLGIWIRPIKTVMYVMPPLTIAEDELLALLSALKTLVYECRR

SEQ ID NO: 68268 - protein, 180 aa, Oryza sativa
  misc_feature (28)..(28): Xaa can be any naturally occurring amino acid
  misc_feature (57)..(58): Xaa can be any naturally occurring amino acid
  misc_feature (60)..(60): Xaa can be any naturally occurring amino acid
  misc_feature (76)..(76): Xaa can be any naturally occurring amino acid
  misc_feature (126)..(126): Xaa can be any naturally occurring amino acid
EGTLQPTKTPSKLPERGGGDRGGDRGGXGRGPPGRGRGGDRGRGRRRGPRREEEEKXXPXTKLGRQVKEGRIRSLXEQIYLHSRPIKEHQISDTLAGPTLKDEATKNTPGQKQTRAGQRTRFKAFXRVGDNNGHVGQGVKCSKEVATAIRGAIIPAKPSVIPVRRGHWGNKIGKPHHRPC

SEQ ID NO: 68269 - protein, 338 aa, Prochlorococcus marinus subsp. pastoris str. CCMP1986
MSNTSTNNNGRNSVPSERLWLRSELMGTQVITTDTGRRLGVVGEVVVDIDRREVVALGLRDNPLTRFLPGLPKWMPLESIKQVGDVILVDSLDSLSDGFSPERYGKVINCQVITESGQLLGRVLGFSFDIETGDLISLVMGAVGVPLLGEGVLSTWEIPVDEIVSSGTDRIIVYEGAEEKLNQLSSGLLEKLGVGGSSWEEREANRYTANLVPVENQLLSGSESEEQNNFMEEIKEEEFIEEEEYEEELEYVEIETTKEKINNKKQLYLDNDSSEQLDNQTDEENTTEFAVQRPSISNRASKRPIQRSQEPLDIEPVEEKKTIIENPQSESVEIDDPW

SEQ ID NO: 68270 - protein, 750 aa, Methanococcus maripaludis
DLRNDDVDIAGGKGASLGEMWNAKLPVPPAFVVTSEAYRYFIKETKLQDEIERILSNIDVNNNEELNKASKEVRYAIENVKIPDDLKLSIIESYHKMCELSGDDETFVAVRSSATAEDLPDASFAGQQETFLNMKGNEQVLQAVQECFSSLFTPRAIFYREEKGFDHFEVALAAVVQKMVNADQAGVMFTVNPINQDYNQMVIEGAWGLGEGVVSGTVSPDTYIVAKDTQEILSVNVARKDTMFIKDADGVTKEIKTSEDLIEKQVLSEEMIKKLENVGQTIENHYKRPMDIEWSIENGEIYMLQARPITTLTDKKDSKSSNEIEGKIILKGIGASPGVESGKVKIISEIEEIGRILDGDILVTKMTTPDMVPAMKKAAAIITDDGGLTCHAAIISRELGTPCVVGTKGATKNLKDEECVTVDGEKGIVYEGKIGKPEEKAPAQVVYAGAPVITATEIKANVSMPEVAERAAATGADGVGLLRAEHMILGTGVHPGKILNEQGEGALTEVFAEGIRKVADAFYPRPVTYRTLDAPTDEFVGLKGGEDEPHEHNPMMGWRGIRRGLDQSEILKCELKAIKKLREDGYRNINVMIPLVTNVDEIRKVKEIANEVGLKLRQDVEFGVMVETPAAALIIDDIIEEGIDFISLGTNDLTQYTIAIDRNNENVSKYYLENHPAVLKLIELVITSCKSAGVKTSICGQAGSRPQIVEKLVEWGITSISANIDAVETIRNVVARTEQKIILESIRKQK

SEQ ID NO: 68271 - protein, 452 aa, Pseudomonas putida KT2440
MSEQNSQTLAWQTMSRDHHLAPFSDVRQLAEKGPRIITSAKGVYLWDSEGNKILDGMAGLWCVAVGYGREELAEVASQQMKQLPYYNLFFQTAHPPALELAKAIAEVAPQGMNHVFFTGSGSEGNDTVLRMVRHYWALKGQKNKKVIIGRINGYHGSTVAGAALGGMSGMHQQGGVIPDVVHIPQPYWFGEGGDMTEADFGVWAAEQLEKKILEVGVDNVAAFIAEPIQGAGGVIIPPQTYWPKIKEILARYDILFVADEVICGFGRTGEWFGTDYYDLKPDLMTIAKGLTSGYIPMGGVIVRDEVAKVISEGGDFNHGFTYSGHPVAAAVGLENLRILRDEQIIQQVHDKTAPYLQQRLRELADHPLVGEVRGLGMLGAIELVKDKATRARHEGKGVGMICRQHCFDNGLIMRAVGDTMIIAPPLVISIEEIDELVEKARKCLDLTYEAVR

SEQ ID NO: 68272 - protein, 259 aa, Moritella sp. PE36
MEDKLSMSWLKIRGEAKLLVEQEPMLASFFHSTILNHDSLKCSLSFQLANKLGSATMPAILLREVIEEALKAEPDILHAVAADLCAVQERDPAVEYFSTPLLYLKGFLALQSYRIAHWLWNQKREALAIYLQNQISVVFAVDIHPAARIGKGIMLDHATGIVIGETAIIEDDVSILQSVTLGGTGKESGDRHPKIRAGVMIGAGAKVLGNIEVGRGAKVGAGSVVLESVPEHTTVAGVPAKVVGKPDSDMPSLAMNQTI

SEQ ID NO: 68273 - protein, 421 aa, Bacillus clausii KSM-K16
MAAEKIQTQNGVLNVPNEPIVPFIEGDGTGPDIWAAASRVLDAAVEKAYNGERKIHWKEILAGEKAYNETGEWLPAETLDAVREYLIAIKGPLTTPIGGGIRSLNVALRQELDLFTCLRPVRYFTGVPSPVKRPEDTDMVIFRENTEDIYAGIEFKEGSDEVKKLIAFLQDELGATNIRFPETSGIGVKPVSKEGTERLVRSAIQYALDEGRKSVTLVHKGNIMKFTEGAFKNWGYELAEREFGDKVFTWAEYDKIVEESGREAADKAQSEAEAAGKIIVKDAIADIFLQQILTRPKEFDVVATMNLNGDYISDALAAQVGGIGIAPGANINYDTGHAIFEATHGTAPKYAGLDKVNPSSVLLSGELLLRHLGWTEAADLIMASMDKTIASKVVTYDFARLMDGATEVSCSGFADELIKNL

SEQ ID NO: 68274 - protein, 161 aa, Methanococcus maripaludis
MEHKHIISVLVLHKPGVLQRISGLFTRRWFNISSMTVGSTENPDVARMTIVVQGDDTVLEQVVKQLNKLVEVVKVTDLNSKKSVQRELCLVKVYAPTEDSKSQVIQYANIFRGKIIDLSTETLTVEITGDEQKVNAFLDLVRPMGIKEIARTGLTALMRGS

SEQ ID NO: 68275 - protein, 159 aa, Escherichia coli O157:H7 EDL933
MRIGHGFDVHAFGGEGPIIIGGVRIPYEKGLLAHSDGDVALHALTDALLGAAALGDIGKLFPDTDPAFKGADSRELLREAWRRIQAKGYTLGNVDVTIIAQAPKMLPHIPQMRVFIAEDLGCHMDDVNVKATTTEKLGFTGRGEGIACEAVALLIKATK

SEQ ID NO: 68276 - protein, 132 aa, Helicobacter pylori
SNIKYELDKESGALMVDRVLYGAQNYPANYGFVPNTLGSDGDPVDALVLSDVAFQAGSVVKTRLVGVLNMEDESGVDEKLLALPIDKIDPTHSYVKDIDDLSKHTLDKIKHFFETYKDLEPNKWVKVKGFEN

SEQ ID NO: 68277 - protein, 826 aa, Oryza sativa Japonica Group
MAAARGGRRRRPWSSSSSCGSPFLMMLISCLLWLHREAAPSLAADTVTVGRPLSGRQVLVSRGGKFALGFFQPDNSSQRWYMGIWYNKIPDHTKVWVANRRAPLSDPDTSRLAISADGNMVLLDRARPPVWSTNVTTGVAANSTVGVILDTGNLVLADASNTSVVLWQSFDHFGDTWLPGGRLGRNKLTGEVTRLVGWKGYDDPTPGMFSLELDPGGASQYVMSWNGSSRLYWSSGNWTGGMFSSVPEMMASNADPLSLYTFNYVDGENESYFFYDVKGEVVLTRFVVDVTGQIKFMTWVDSAAQWVLFWSEPKAQCDVYSICGAFGVCAEDALPACSCLRGFHARQPRRWLQGDHTAGCARSTALQCGGGGGAQPAAQKTKSDRFFVMPNVNLPTDGVTAASASARDCELACLGNCSCTAYSYNGSCSLWHGDLISLRDTTGAGNGGGRSISIRLAASEFSGNGNTKKLIIGLVVAGVAAAVILAVVVTVLVRRSRRLKALRRVEGSLTAFTYRDLQVATKSFSEKLGGGAFGSVFKGSLPADGTPVAVKKLEGVRQGEKQFRAEVSTIGTIQHVNLIRLLGFCTERTRRLLVYEHMPNGSLDRHLFGHGGGVLSWEARYQIALGVARGLDYLHEKCRDCIIHCDIKPENILLDDAFAAKVADFGLAKLMGRDFSRVLTTMRGTVGYLAPEWITGTAITTKADVFSYGMMLFEIISGRRNVEQGQDGAVDFFPATAARLLFDGDLKGAVDGRLAGNADMGEVERACKVACWCVQDSEATRPSMGMVVQVLEGPVDVNAPPMPRSFKVLGDPSNYVKFFSAFPSIP

SEQ ID NO: 68278 - protein, 174 aa, Pseudomonas putida KT2440
MAIYQYDNLAPNLHPETFIAEDASVIGDVTLEQGVSVWPQAVLRGDNEAIRIGQHSNVQEGAVLHADPGFALTVGQGVTIGHQAMLHGCTIGDGALIGIQAVVLNGAVIGNNCLVGAGAIVTEGKVFPDNSLILGAPAKVVRELTAEAIAGMQRNATEYVAKGQSFKEKLIRIR

SEQ ID NO: 68279 - protein, 739 aa, Oryza sativa Japonica Group
MAPRLSACLVFLLILVLSLQESPLHAADTLTAEQPLSADQKLISQDGKFALGFFQPAVNHSESPVWSTNIVNNTIASSPVAVLLDSGNLVVRHESNTSEVLWQSFDDFTDTWLPGNKLSRNKKTGVIKRMISWKDRADPAPGMFSIQLDPSGATQYILLWNSSSVYWASGNWTGNTYTGVPELSPTNSDPNSAYTFQFVDNDQETYFNYTVKNDAQLTRGVIDVSGHFQAWVWADAAQAWQLFFAQPKAKCSVYGMCGTYSKCSENAELSCSCLKGFSESYPNSWRLGDQTAGCRRNLPLQCGNNGSVKAKQDRFFMISSVKLPDMAHTRDVTNVHNCELTCLKNCSCSAYSYNGTCLVWYNGLINLQDNMGELSNSIFIRLSASELPQSGKMKWWIVGIIIGGLVLSSGVSILYFLGRRRTIGINRDDGKLITFKYNELQFLTRNFSERLGVGSFGSVYKGILPDATTLAVKKLEGLRQGEKQFRAEVSTIGNIQHINLIRLLGFCSEGAKRLLVYEYMPNGSLDHHLFQNNSAISSWKRRYQIAIGIAKGLAYLHDGCRDCIIHCDIKPQNILLDMSFTPKVADFGMAKLLGRDFSRVLTSIRGTIGYLAPEWISGESITTKADVFSYGMMLFEIISRKRNLTQTETRTEIFFPVLVARKLVQGEVLTLLDSELVDDVNLEELERACKVACWCIQDDESSRPTMAEVLQMLEGLVDIEVPPAPRYLQVLAEGAASKT

SEQ ID NO: 68280 - protein, 348 aa, Glycine max
MRKKKQGFRRPVVIKKPKQPQEQPSVDPITGKKIPKSFVFSRGKLPAPLKQLQMDLRKLMLPYTALSLREKKRNNLRDFLNVAGPMGVTHFFILSKTATSSYLRVATTPQGPTLTFKIHEYSLAADIARSQLHPRCPKDLFKNSALIVLSGFVSGDPPLQLTTNMFQNIFPTIDVKTVKLSTCQRIVLLNYNKDTKLIDFRHYSIRLQPVGVSRRIRKLVQSHQVPDLRNLQDVSDFVTKAGYGSESEADEEAATVTLSSDIGRVNRASTKSAVKLQEVGPRMTLQLVKIEKGLCSGEVLFSEYGKAGGKGKSDDEMQGEEDSDGDEDEEDQDGDHPEDSEDKDQDLD

SEQ ID NO: 68281 - protein, 650 aa, Oryza sativa Japonica Group
MSLSFFFFQPILPCLTGCLPVWLTCLRISWRIYWQVKNLGDPAPGMFSVEIDPDGSNQYIISWNKSVVYWGTGNWTGSSFPNMPELSPANTYPNTPYTYKFVNNDKETYFTYNVTDDRVLSRHAIGVSGQTQSLVWVESAQAWVLYFSQPKANCGVYGLCGVNSKCSGSALSSCSCLKGFSIRDPNSWNLGDQTAGCRRNVMLQCGSKSSAGGQQDRFYTIGSVKLPDKSQSIEATSIHSCKLACLSNCSCTAYSYNGTCSLWHSELMNLQDSTDGTMDSIYIRLAASELPNSRTKKWWIIGIIAGGFATLGLVVIVFYSLHGRRRISSMNHTDGSLITFKYSDLQILTKNFSERLGVGSFGSVFKGALPDTTAMAVKKLEGVRQGEKQFRAEVSTIGTIHHINLIQLLGFCSEGAKRLLVYEYMPNGSLDHHLFGSTGVSLSWSTRYQIAAGIAKGLAYLHEKCRDCIIHCDIKPQNILLDSSFTPKVADFGMAKLLGRDFSRVLTSMRGTIGYLAPEWISGEAITTKADVFSYGMMLFEIISGKRNGMHGGSFFPVLVARELVEGELHKLFGSESSDDMNLGELDRACKVACWCVQDSESSRPTMGEIVQILEGLVDVEMPPVPRYLQVLGQGVKSYEISSEMNQASN

SEQ ID NO: 68282 - protein, 207 aa, Zea mays
MGQQSLIYAFVARGTVVLAEYTEFTGNFTTIAAQCLQKLPASNNKFTYNCDGHTFNYLVEDGFTYCVVAVESVGRQIPIAFLDRVKEDFTKKYGGGKAATAAANSLKREFGPKLKEHMQYCVDHPEEVSKLAKVKAQVSEVKGVMMENIEKVLDRGEKIELLVDKTENLRSQKPECLMHVLLNPPKVPVTLFVEMSLSRSRIASFVK

SEQ ID NO: 68283 - protein, 268 aa, Oryza sativa Indica Group
MGGGGGDDALYARCLVTLYLISPITVFLLRFVSAPYGKLSRPGWGPAVPAALAWFLMESPTMCLPPLVLSAAASSSALRAAALLPAALYALHYVNRTLVHPLRLLRLRRAPAPVPILVAAFAFGFNLLNAYVQARSWALDAAAPHSTATATATPAAVARCLVGLALFAWGMRTNIAADKALLRLKEAGKGYQIPRGGLFDVVTCPNYFGEAVEWLGYALVAWTPAAWAFFLYTCSNLGPRARDHRRWYVGKFGDKYPASRKAFVPYIY

SEQ ID NO: 68284 - protein, 790 aa, Gibberella zeae PH-1
MSQQGKHSAKTVLEKFIGADHTEPEERAPSITNADLYIEEEPTVGEFLREITPSIQQVGEYFYNLFPFLSWVGKYNLIWFLGDMVAAPRTGITVGAVVVPQSMAYAQLAQLPVEYGLYSSFMGVLIYWFFATSKDITIGPVAVMSQVTGNIVLQAADSLPDVPGHVIASALAVIVGSIVTFLGLARLGWLVEFIPLPSICAFMTGSGVNIIAGQVPKLMGIKGVNTRQPTYMVIIDTLKNLGGSKLDAAIGLSALVLLYAIRIFCGTMAKKQPHRAKLYFFISTLRTAFVILLYVGISAGINIKHREKPRISIVGDVPSGFTHAAVPQINSSIIKSFVSELPAAVIVVLIEHISISKSFGRVNNYVIDPSQELVAIGVSNLLGPFLGAYPATGSFSRTAIKSKAGVRTPFAGVITAIVVLLALYALTAVFFYIPNAGLAGVIIHAVGDVITPPKVVYQFWRVSPIEVIIFFAGVIVTIFSSIENGIYTTIAMSAAVVVFRLFKTRGRFMGVVRVRTMKANVSDGTASPGSVDEGEGSLRAGFLPLDHGNGSNPKVIVRTPYPGVFIYRFAEGFNYPNASHYLNHLTETIFAECRRTNPALLGKLGDRPWNDREPRHIKTVENDERPILKSVILDFSSVNNVDVTSIQALIDVRNQLDKFAAPEVVDWHFANIENRWTKRALAAAGFGFRTPRTGNEAAGHWKAIFSIADLGGDDSAATAAALDEKVKNAPMRQDIEAIEGSVNSASMEKLPRDPTSTRLVSVGGLNRPYFHLDLQEAVDAAVAAAELKQH

SEQ ID NO: 68285 - protein, 685 aa, Oryza sativa Japonica Group
MAKSLLVSSLLAVVAAVVVGAGPNPQYCPPSSCGHLGNISYPFRLQGDSRDCVATPRPWYNLSCSSGRAAIQINTGTYYVSSINYTGEVFSVVDATLQDDDTNSSCPLPRSDHLPFPDWYRDYRPADSYGFFDLATASGTWACFVNCSRAITDIMPWYKPVTCLLPNNSFVFVSFVNCAVGELQPSCRYLAMIPFESRHISDNSSQLQNASYTDIIGFIRKGFSVRFPYRPDQYQSPRMSARECLKDSNRYFKERISHPSILNLTRAIFWSETNSEVDCGYEVAPQKDRIFLGTIVSAIDIIKFHFVLFRLVLGSLVVFIFLAHKYWKTRITIDAVEKFLRMQQMIGPTRFAYTDIIAITSHFRDKLGQGGYGSVYKGVLLPGNVHIAVKMLTGSSSCNGDEFISEVSTIGRIHHVNVVRLVGFCSEEMRRALVYEYMPRGSLDKYIFSSEKSFSWDKLNEIALGIARGINYLHQGCEMQILHFDIKPHNILLDDNFVPKVADFGLAKLYPRDKSFVPVSAARGTVGYIAPEMISRSFGVISSKSDVYSFGMLLLEMAGGRRNADPNAANSSQAYYPSRVYRELTRRETSEISDIADMHELEKKLCIVGLWCIQMRSCDRPTMSEVIEMLEGGTDELQVPPRPFFCDDEQLPGVESYNMPSDLTAISEEHEDDDDDSICLFESYQ

SEQ ID NO: 68286 - protein, 431 aa, Staphylococcus hyicus
MARIRARGSSRVDVPKENTTAQNKFTSQASDKKPTVKAAPEAVQNPENPKNKDPFVFVHGFTGFVGEVAAKGENYWGGTKANLRNHLRKAGYETYEASVSALASNHERAVELYYYLKGGRVDYGAAHSEKYGHERYGKTYEGVLKDWKPGHPVHFIGHSMGGQTIRLLEHYLRFGDKAEIAYQQQHGGIISELFKGGQDNMVTSITTIATPHNGTHASDDIGNTPTIRNILYSFAQMSSHLGTIDFGMDHWGFKRKDGESLTDYNKRIAESKIWDSEDTGLYDLTREGAEKINQKTELNPNIYYKTYTGVATHETQLGKHIADLGMEFTKILTGNYIGSVDDILWRPNDGLVSEISSQHPSDEKNISVDENSELHKGTWQVMPTMKGWDHSDFIGNDALDTKHSAIELTNFYHSISDYLMRIEKAESTKNA

SEQ ID NO: 68287 - protein, 584 aa, Bacillus clausii KSM-K16
MRKTKIVCTIGPASESLEKLTALIEAGMNVARLNFSHGDFEEHGARIKNIREAAKRTGKTVAILLDTKGPEIRTQTVEGGAIELEKGQELILSMNEVQGTKEKISITYPGLCEDVEVGSTILLDDGLIGLEVKEIRDTELVTIVRNSGVLKNKKGVNVPNVSVNLPGMTEKDAADIVFGIEQKVDFIAASFVRRASDVLEIRELLEKHGAADTAIIPKIENQEGVDNIDEILEVSDGLMVARGDLGVEIPAEEVPLVQKQLIKKCNELAKPVITATQMLDSMQRNPRPTRAEASDVANAIFDGTDAIMLSGETAAGDYPVESVQTMHNIAERTEQALNYENMLRRKSKEVKTSITSAIGQSVAYTASNLNAAAILTATESGYTARMTSRFRPKSPILAVTSNERAYRRMALVWGVTPILGKQANTTDEMLDRTVEAAVATGVVKQGDLVIITAGVPVGESGTTNLMKVHMLGEVAAKGQGIGRRSASGKVVVARDAKEAIAKVTEGSVLVTKSTDKDMIEAFEKAAAVVTVEGGLTSHAAVVGLNLSTPVIVGVANALERFQDGDEVTVDCISGNIYSGQARVL

SEQ ID NO: 68288 - protein, 456 aa, Oryza sativa Indica Group
MASRDLAESLLPVGGGAATATATAHDEYDERAYDSDDKVSIAVSDSDSEDGGGGGGDAMRPAFSWRKLWRFTGPGFLMCIAFLDPGNLEGDLQAGAAAGYQLLWLLLWATVMGALVQLLSARLGVATGKHLAELCREEYPPWATRALWAMTELALVGADIQEVIGSAIAIKILSAGTVPLWGGVVITAFDCFIFLFLENYGVRKLEAFFGVLIAVMAVSFAIMFGETKPSGKDLLIGLVVPKLSSRTIKQAVGIVGCIIMPHNVFLHSALVQSRKIDTNKKSRVQEAVFYYNIESILALIVSFFINICVTTVFAKGFYGSEQADGIGLENAGQYLQQKYGTAFFPILYIWAIGLLASGQSSTITGTYAGQFVMGGFLNLRLKKWLRAMITRSFAIIPTMIVALFFDTEDPTMDILNEALNVLQSIQIPFALIPLITLVSKEQVMGSFVVGPITKVM

SEQ ID NO: 68289 - protein, 410 aa, Bacillus clausii KSM-K16
MPTTREEALHMHRINQGKLESKAKVPVKDARDLSLAYSPGVAEPCKEIFEDVETVYEYTMKGNMVAVVSNGTAVLGLGNIGPEASLPVMEGKAVLFKSFAGVDAFPICLRSNDVDEIVNTVKLLEPTFGGVNLEDIAAPDCFVIEERLKKETNIPIFHDDQHGTAIVTLAGLINALKISGKKLSEIKVVANGAGAAGIAIIKLMLRMGVRNIIMCDTKGAIYEGRPYGMNAVKEAVAKRTNMNKEEGKLEDVIKGADVFIGVSVEGAVTKEMVESMNDNPIIFAMANPVPEIMPEDAKAAGASVIGTGRSDFPNQVNNVLAFPGIFRGALDARATHINEEMKVAAVYAIANLVSEEELSVDYVIPAPFDSRVAPAVAAAVAKKAMETGVARVKVDPEEVAEKTRKLAIID

SEQ ID NO: 68290 - protein, 419 aa, Zea mays
MSKKKKKKKKRSRRRPARLLPVVSPSPIASPSPIASRSQPISQTESIQSYPRVPPSRPDPGSSMGKEGVAAGPAAEGSKSRSECINSSNPYHECSDYCLRKIAEARQRLDDELPDSWKRPPEQRTVHPDCINASNPYHECSDYCFKRIADAKSPACGLEPEERQPPADVFAAAGLSDAVEQHRPVDNDPDEQEGAGPDDGYPQMTEKQKKLFELRLKMNEARKANQQAMVAEKKRMEPRGESRGVSKQKWLDDRKKKIGKLLDSNGLDMKMAYMLDTQETAEAKYKKWEKEPAPYGWDVFNQKTLYDAYKKRTKDIEVDMEAYNKAKEADPEFYRDASSLQYGKVSNVPEENIDKMVKELKEREEKRKSFSRRRKFNEDKDIDSINDRNEHFNKKVERAFGKYTLEIKNNLERGTALPD

SEQ ID NO: 68291 - protein, 385 aa, Oryza sativa Indica Group
MARPRTRSVARMEATAAAAAAAEEEEAGNPDGAEGAAVVAVAPEAAAEGPNEPNAGEASREPDAGQASREPDVAGPSRQPGAAGPSREPGAAGGPRQPGAAGGPWQLVPNAAGPAVAPYVEDIDRYLRSLEAEESRRPIVNYDQEIQGGHINMRGKLVNWMAELFHMLIYLAVSYVDRFLSRNVVNRERLQLLGTSALFVASKYEDRCHPSARFFSSITADTYTTQQVVAMEANILSFLNFQMGSPTVITFLRRFLFSCRGSNRPINIRLELMCIYLAELSLLDDYNIRFLPSIVAAACLFVGKFTLNPNTRPWNLSVQRITGYKVSDIEDCIRSIHDLQAGRKWSNLRAIRSKYEDDAFERVSTIPSPNTIKPSFLRDLKYVNG

SEQ ID NO: 68292 - protein, 132 aa, Helicobacter pylori
SNIKYELDKESGALMVDRVLYGAQNYPANYGFVPNTLGSDGDPVDALVLSDVAFQAGSVVKTRLIGVLNMEDESGVDEKLLALPIDKIDPTHSYVKDIDDLSKHTLDKIKHFFETYKDLEPNKWVKVKGFEN

SEQ ID NO: 68293 - protein, 509 aa, Yarrowia lipolytica CLIB122
MSRRKAPVSYSGLDTSDVSDEDFEVEDEVSTPKRRKTTSPRKQTPRRTASPRKAPGTPSPVKRSLHDKSARKKANRTLLDQSLGLVSEDEDEIELAERIIGESRAPILDSSNDFHTDERSLANVGALIAAEDRVLFLDSSEGYFDQHKTRGRGNANTMAKAPAIDHSVFFKYTNQANELFHADQKKMLRHAYRGMFSQWIFELSEGFSLLFYGLGSKRELLTDFVCEKVDSEIPILVINGYNASVQFKSVLNSVVDVLYENHEDIFAKKGFVVRNKLPKDVDLLVKLVVDTMRDIEAGSKPSLVVLCHNVDGESLRIDKASTHLSQLMSISQIWFVASVDHIMAPLMWDSAKLASYNFVWHDVTTFAPYTVETSFDDPLLLGKKAEAQGAKGVKYVLESVTPNHRSLYKNLIYCQLEEFHNVADKRKLPEAEVGALTGSTSISVDYDKVLTECLNELTVSNKKDFQEKLKEFMDHKMVVAFDDKMGMKKLYIPFSKDVVQQILEGYLDA

SEQ ID NO: 68294 - protein, 132 aa, Helicobacter pylori
SNIKYELDKESGALMVDRVLYGAQNYPANYGFVPNTLGSDGDPVDALVLSDMAFQAGSVVKARLVGVLNMEDESGMDEKLLALPIDKIDPTHSYVKDIDDLSKHTLDKIKHFFETYKDLEPNKWVKVKGFEN

SEQ ID NO: 68295 - protein, 322 aa, Moritella sp. PE36
MTTKIILDTDPGIDDAMAIIFAEAHPEIELKAITCVYGNATIENATHNALFLKQKYNLQADVAKGAAKPIVRPPVGATVVVHGESGLGDVQTPAELSVVADPRPAYQYIIDALRAEPGEITLVAVGPLTNLALALEAAPEIVSLVKEVVVMGGAFGVNDHRGNVTPYAEANIHDDPHAADMVFGASWPVVIIGLDVTEQSFFTKDYLDRLRDDAGEVGQFIWDISRYYLKFYSEKVGLEGCHVHDPSAIAYVIDPSLFTLREGPVRVVTDGPAEGMTIQKFDKREYMHDEWDSNKPQRVGIAVEDERLLSLYRQTIINFGQK

SEQ ID NO: 68296 - protein, 416 aa, Escherichia coli K12
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 68297 - protein, 258 aa, Xanthomonas axonopodis pv. citri str. 306
MTTHRWRLDGQTALITGASAGIGLAIARELLGFGADLLMVARDADALAQARDELADEFPERELHGLAADVSDDEERRAILDWVEDHADGLHLLINNAGGNITRAAIDYTEDQWRGIFETNVFSAFELSRYAHPLLTQHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRYGF

SEQ ID NO: 68298 - protein, 713 aa, Oryza sativa Japonica Group
QCSLSLSRESKGSLLHTPTAYSPTLLPTPLVCAPLPPAMAPMPAPAVALAVLVLLSAVPGYFSDDLNTDAQALQALRSAVGKSALPSWNSSTPTCNWQGVTCESGRVTELRLPGAGLMGTLPSNVLGNLSALRTLSLRYNALTGPIPDDLSRLPELRAIYFQHNSFSGEVPASVFTLKNLVRLDLAGNKFSGEISPDFNKLNRLGTLFLDGNSFTGEIPKLDLPTLSQFNVSYNKLNGSIPRSLRKMPKDSFLGTGLCGGPLGLCPGETALTPAGSPEVQPAGGGAADAGGASSGTKKKLSGGAIAGIAIGCVFGVLLLLALIFLLCRKKSSSSTPATAVEKGRDLQMAPMDMEPKGQNGSAAGNGAHVGAAAAAPAAATSAAVAAAAAAAKTGGATGGSKKLIFFGPMAAAPPFDLEDLLRASAEVLGKGAFGTAYKAVMESGSAVAVKRLKDVDLPEPEFRERIAAIGAVQHELVVPLRAYYFSKDEKLLVYDYMSMGSLSALLHGNRASGRTPLDWETRSAIALAAARGVAHIHSTGPTASHGNIKSSNVLLTKNYEARVSDHGLPTLVGPSFSPTRVSGYRAPEVTDIRRVSQKADVYSFGVLLLELLTGKAPTHAVVNEEGLDLPRWVQSVVREEWTAEVFDQELLRYQNVEEEMVQLLQLAIDCSAQHPDRRPSMSEVAARIDEIRRSSLGDRPATDSAGEGEEPSL

SEQ ID NO: 68299 - protein, 871 aa, Arabidopsis thaliana
  misc_feature (24)..(24): Xaa can be any naturally occurring amino acid
MERHCLFFVIFSLILHLVQAQDPXRFINLDCGLSIQGSPYKESSTGLTYTSDDGFVQSGKIGKITKELESLYKKPERTLRYFPDGVRNCFSLNVTRGTKYLIKPTFLYGNYDGRNVIPDFDLYIGPNMWITVNTDNTIKEILHVSKSNTLQVCLVKTGTSIPYINTLELRPLADDIYTNESGSLNYLFRVYYSNLKGYIEYPDDVHDRIWKQILPYQDWQILTTNLQINVSNDYDLPQRVMKTAVTPIKASTTTMEFPWNLEPPTSQFYLFLHFAELQSLQANETREFNVVLNGNVTFKSYSPKFLEMQTVYSTAPKQCDGGKCLLQLVKTSRSTLPPLINAMEAYTVLDFPQIETNVDEVIAIKNIQSTYGLSKTTWQGDPCVPKKFLWDGLNCNNSDDSTPPIITSLNLSSSGLTGIIVLTIQNLANLQELDLSNNNLSGGVPEFLADMKSLLVINLSGNNLSGVVPQKLIEKKMLKLNIEGNPKLNCTVESCVNKDEEGGRQIKSMTIPIVASIGSVVAFTVALMIFCVVRKNNPSNDEAPTSCMLPADSRSSEPTIVTKNKKFTYAEVLTMTNNFQKILGKGGFGIVYYGSVNGTEQVAVKMLSHSSAQGYKQFKAEVELLLRVHHKNLVGLVGYCEEGDKLALIYEYMANGDLDEHMSGKRGGSILNWGTRLKIALEAAQGLEYLHNGCKPLMVHRDVKTTNILLNEHFDTKLADFGLSRSFPIEGETHVSTVVAGTIGYLDPEYYRTNWLTEKSDVYSFGVVLLVMITNQPVIDQNREKRHIAEWVGGMLTKGDIKSITDPNLLGDYNSGSVWKAVELAMSCMNPSSMTRPTMSQVVFELKECLASESSREVSMTFGTEVAPMAR

SEQ ID NO: 68300 - protein, 394 aa, Desulfitobacterium hafniense Y51
MFSKSEYERRLKGFQAILAQQEIEGALLVQRADTLYFTGTAQNLHLYIPRTGKPLLLVYRNMERVLAESPWEAFPLTGMSKLPELIMEHGHPLPKVMGLEYDVLPVANYLRYEKLFSQTKLMDISYPLRLFRAVKSAEEIARLEENGRVYAQLLEYASTVLRPGMTEIELEGLLEAKARTLGHETMLRTRAFGFEFHFGGVVAGPQGAISGYFDGPVTGLGASYAHPLGPSHSPIQAGDMVMMDLVIAQEGYQADATRMLVIGEPSQKMAEAYQLSCEIQERARLALIPGRKTGDVYAELVDWVERETPYAGNFMGYGQNRVRFIGHGVGLELDELPTISKGAQEILAPGMTIAVEPKFIFPGEGAVGVEDTLVIEGEKGARFLTHAPKSILRV

SEQ ID NO: 68301 - protein, 248 aa, Nostoc punctiforme PCC 73102
MTKLPVRKIVIAGNWKMFKTQAETQEFLQGFLPHLEETPQGREVILCPPFTDLSVLSKTLHGSLIQLGAQNIHWEEFGAYTGEISGPMLTESGVRFVIVGHSERRQYFGETDATVNLRLRTAQRFGLTPILCVGETKQQRDAGETESLIALQLDKGLVDIDQNNLVIAYEPIWAIGTGETCEAVEANRIIGLIRSQLSNPNVSIQYGGSVKPNNIDEIMAQPEIDGVLVGGASLEPESFARIVNFHLV

SEQ ID NO: 68302 - protein, 281 aa, Micromonospora olivasterospora
MTTEQILPLRESRALPLDGFLRAAVRAARAAGRVVRTAFHEGRTVVEDKGPRDYVTEVDRAAEDLIHDYLHRHAPEQVPFVGEESGGVLGTLCWVVDPLDGTTNFLRGYPSVGVSIALVHEGRPVVGVVHAPMWGETFTAVAGGGALRNGRPIAVGTRPAARAVCSTGLPVKRPEAMGAYLDLLGRLLPAVEDVRRPAGASLDLAWVACGVFDAFFELDLGPWDVAAGALLVREAGGVVTDWEGDPGRWLDTGHIVAGSPSVHATVVRHTSTTALPVLRRP

SEQ ID NO: 68303 - protein, 276 aa, Glycine max
  misc_feature (212)..(212): Xaa can be any naturally occurring amino acid
MKLSAKPISSPGRTDKFPPPLMRFLRSNAGSRSRRSRSSPMFVRKKNTTFETHTQEPSSPKVTCMGQVRVKRASKQPTTQPDLAPTRCRRRRRRCCCFWIRRPNNPCRCNPLWPNWPFFRRKPTKLKQDSQSEPNFYAHEESELPFQERVNVDKDSDFASNSSTPPRNALLLTRCRSAPYRSSSLASRFWSSPVKDQETELQHTSEGPQTEXRIRVSNRKNCFTHRTRKVEEVETETESVLRPTVLTRCKSEPARTGHRLDPLVNNLLKKRRLEFD

SEQ ID NO: 68304 - protein, 95 aa, Arabidopsis thaliana
MGSYVEQARENHVKKKVEEALRSKMKAKALMECDQYVSKYAQCATGRTFSVVWTCRKQARELNTCLHQFTNDNVLEEMKRAYMVQEEGKVSASAI

SEQ ID NO: 68305 - protein, 189 aa, Triticum aestivum
WASSATSVVLFQGLKSTAGLPVSRRSTGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKASTAHSRQAIYKVPLQFCQL

SEQ ID NO: 68306 - protein, 466 aa, Arabidopsis thaliana
  misc_feature (59)..(59): Xaa can be any naturally occurring amino acid
  misc_feature (220)..(220): Xaa can be any naturally occurring amino acid
  misc_feature (459)..(459): Xaa can be any naturally occurring amino acid
MDVPRPAFKCFDDDGRLKRSGTVWTASAHIITAVIGSGVLSLAWAIGQLGWIAGPTVMXLFSFVTYYSSTLLSDCYRTGDPVSGKRNYTYMDAVRSILGGFRFKICGLIQYLNLFGITVGYTIAASISMMAIKRSNCFHESGGKNPCHMSSNPYMIMFGVTEILLSQIKDFDQIWWLSIVAAIMSFTYSAIGLALGIIQVAANGVVKGSLTGISIGAVTXTQKIWRTFQALGDIAFAYSYSVVLIEIQDTVRSPPAESKTMKIATRISIAVTTTFYMLCGCMGYAAFGDKAPGNLLTGFGFYNPFWLLDVANAAIVIHLVGAYQVFAQPIFAFIEKQAAARFPDSDLVTKEYEIRIPGFRSPYKVNVFRAVYRSGFVVLTTVISMLMPFFNDVVGILGALGFWPLTVYFPVEMYIRQRKVERWSMKWVCLQMLSCGCLMITLVAGVGSIAGVMLDLKVXKPFKTTY

SEQ ID NO: 68307 - protein, 544 aa, Oryza sativa Japonica Group
MGSASASSLPASAGFGENLVLILDFGSQYTHLITRRVRQLGVLSLCVSGTAPLASLAGLRPRAVVLSGGPHSVHASGAPTFPEGFLEFAAGAGAHVLGVCYGMQLLVQSLGGAVEAGEKQEYGKMEVEVTARSSALYGEGEVGKRQTVWMSHGDEVVRLPEGFEVVARSVQGAVAAVENREKRFYGLQYHPEVTHSPQGMETLRRFLFDVCGIKADWKMQDVLDEEIRTIQSMVGPDEHVICALSGGVDSTVAATLVHKAIGDRLHCVFVDNGLLRYNERERVMLTFESDLHLPVTCVDASEQFLSKLKGVKDPEMKRKIIGREFIAVFDDFAHKLEQKIGKRPGYLVQGTLYPDVIESCPPPGSGRTHSHTIKSHHNVGGLPKDMKLKLIEPLKLLFKDEVRKLGSILNVPESFLKRHPFPGPGLAVRVLGDVTEGNALEVLRQVDEIFVQAIKDAGLYDIIWQAFAVFLPVQTVGVQGDQRTHSNAVALRAITSEDGMTADWYYFEREFLVDVVNKICNNVRGVNRVVQDITQKPPATVEWE

SEQ ID NO: 68308 - protein, 162 aa, Coix lacryma-jobi
EGCGYEFQMQYGSIGWSVGATLGYAQAAKDKRVIACIGDGSFQVTAQDVSTMLRCGQKSIIFLINNGGYTIEVEIHDGPYNVIKNWDYTGLINAIHNSDGNCWTMKVRTEEQLKEAIATATGAKKDCLCFIEVIVHKDDTSKELLEWGSRVSAANSRPPNPQ

SEQ ID NO: 68309 - protein, 425 aa, Prochlorococcus marinus subsp. pastoris str. CCMP1986
METIKNFPKICKKNFPLIDKKDFPLLENNFKNKNTIIYLDHAATTQKPIQVLEKIDEYYKNFNANVHRGAHQLSAKATEEFENSRSLIAKYVNAYSTKEIIFTRNATEAINLVARSWGEFTLKENDEILLSIMEHHSNIVPWQMVAAKNKCKLKFVGIDQDGRLDINDFKSKLTTKTKLVSLLHISNTLGCCNPIKEITKLARDKGSLVLLDACQSLAHQKLDINELGIDFLAGSGHKLCGPTGIGFLWSRKEILEKIPPFFGGGEMIQDVFEEKSTWAELPHKFEAGTPAIAEAIGLAAAINYINNIGLDRISEYEKEITKYLFKKLKQIEDLEIIGPSPKIDPNRAALATFYVKEIHSNDIAEILDSKGICIRSGHHCCQPLHRHIGINSTARISMNFTTTKEDINTFIEKLKETISFLKLNS

SEQ ID NO: 68310 - protein, 539 aa, Oryza sativa Japonica Group
MAATAAYLPLRAQAQVGLAPLRPSGSAAAGARLPGRTARRRLAARGGPEAAGIRAEAVPGGGGVARRAAMVPPYNVLITGSTKGIGYALAKEFLKAGDNVVICSRSAERVESAVTDLKKEFGEQHVWGIVCDVREGKDVKALVDFARDKMKYIDIWINNAGSNAYSYKPLVETSDEALMEVITTNTLGLMICCREAINMMRNQPRGGHIFNIDGAGSDGRPTPRFAAYGATKRSVVHLTKSLQAELQMNEVNNVMVHNLSPGMVTTDLLMSGATTKQAKFFINILAEPANVVADYLVPNIRAIPTNQSMKPTYIRFLTGLKAYSRIFSRIAFGARRNKIMSNSQPAQEDDCMSSILVSRLIRAMQPTRSYLRWSDDLHKMFVEAVAYHGGPYEAKPTAVKETMQAMGVTSLTTHNIKSHLQKYRESFSSGVGSLHDHDLLRTTSPSKEALDLASEMVRDNDAAMAEIEMLNDLLLDHDIEMVETSFSVDDLQMMERELMSEIKLIEHNFEISESALDEYMDDLANYAFDLTGPANSSSP

SEQ ID NO: 68311 - protein, 121 aa, Picea sitchensis
MGKAIFFFAGLLLLSVLSADLIGSAAGSEMDAWGVLWDSKPRPRCEGLIGECFEEDEMQMDSEINRRFLAGRTYISYAALRANSVPCSKRGSSYYNCRSTSQANPYQRSCTTITRCARSTS

SEQ ID NO: 68312 - protein, 364 aa, Zea mays
MGSTAGDVAAVVDEEACMYAMQLASSSILPMTLKNAIELGLLEVLQKEAGGGKAALAPEEVVARMPAAPSDPAAAAAMVDRMLRLLASYDVVRCQMEDRDGRYERRYSAAPVCKWLTPNEDGVSMAALALMNQDKVLMESWYYLKDAVLDGGIPFNKAYGMTAFEYHGTDPRFNRVFNEGMKNHSVIITKKLLDFYTGFEGVSTLVDVGGGVGATLHAITSRHPHISGVNFDLPHVISEAPPFPGVRHVGGDMFASVPAGDAILMKWILHDWSDAHCATLLKNCYDALPENGKVIVVECVLPVNTEATPKAQGVFHVDMIMLAHNPGGKERYEREFRELAKGAGFSGFKATYIYANAWAIEFIK

SEQ ID NO: 68313 - protein, 327 aa, Oryza sativa Indica Group
MASPSPSSSPLQPQHQHQHPLPPHPQPQYQSPPPPMPPPPPAAPLKAIDLEVTVVSGKHLKNVNWRRGDLRAYVVAYLDPSRRAATRPDDVGGCKPAWNERVVLPLPPHLSPHDPSLLLSLDVFHSKPSDSPKPLVGSARSPLRDLLFSTNPNPSPDSPASALITLPLLRPSGRPQGKLRIRLALRERSPPPPEPQYPPPSSSPYYFPPPPPPAYSAPPPPQYGSEQYYRSGGYYSAPPPPPQYEYTAGPSAPVEYNRQYDPRAGSGSGNGRYGVGTGIAVGTVTGALGGLAIDEGVKYKEEKSADRVEDKVVPAGRDDDSRGYREY

SEQ ID NO: 68314 - protein, 475 aa, Gibberella zeae PH-1
MRLLTRPSSCAIARGLCRNSTFPCSISRASVSTLHAKINSPPPRIVRSEGCWLETHQGHRILDASSGASVVSIGHNDSRVKEAIIAQLDQVAYCYNPFFTTEAAEKISRFLTDSTDGHMSKVFVVSSGTEAVEAALKIARQYFTELPTPQPNRTKFIARKQSYHGNTLGSLSVGGHKARRGVYEPVLATNVSHVSPCYPYREMKEGETEEQYVERLAKELDDEFKRVGPDTVCAFIAETVSGTSLGCAPAVPGYFKAMREVCDRHGALLIMDEVMSGMGRTGTLHAWEQEGVVPDLQTVAKGLGAGYMPVGALLVGNKVANTLEQGSGAFSHSQTYQGHPVACAAAFSVQMAMKEDKMLQNTQEVGKVLGKKLKERLAGHKNVGDVRGRGLFWGLEFVRDKDTKEPFPLDDQIAGKLHKAGLTSDHGISLIPATGNVDGMQGDMVIVSPPLTVTKEEVDMVVDRIEKVVTSVLGS

SEQ ID NO: 68315 - protein, 461 aa, Triticum aestivum
  misc_feature (10)..(10): Xaa can be any naturally occurring amino acid
SADRCMKEKXIISVMRLSRHTAPVDMREKLAVAEELWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRNGQNSGGLGKNIDRMFKDAITAGKRVRCETNISAGAVSVSSAAVELAMMKLPKSECLSARMLLIGAGKMGKLVVKHLIAKGCKKVVVVNRSVERVDAIREEMKDIEIVYRPLTEMYEAAADADVVFTSTASESLLFTKEHAEALPPISLAVGGVRLFVDISVPRNVGACVSEVEHARVYNVDDLKEVVEANKEDRVRKAMEAQTIITQELKRFEAWRDSLETVPTIKKLRSYADRIRASELEKCLQKIGEDNLNKKMRRSIEELSTGIVNKLLHGPLQHLRCDGSDSRTLDETLENMHALNRMFNLDTEKAVLEQKIKAKVEKTQS

SEQ ID NO: 68316 - protein, 299 aa, Geobacillus kaustophilus HTA426
MKLAKEIAEVMGIELGKCSVSRFSDGEIQINIEESIRGDDVFVIQSTSVPVNEHLMELLIMIDALKRASARTINIVMPYYGYARQDRKARSREPITAKLVANLLETAGASRVITLDLHAPQIQGFFDIPIDHLMGVPILADYFKSKQLEDIVVVSPDHGGVTRARKLADRLKAPIAIIDKRRPKPNVAEVMNIVGQVAGKTAILIDDIIDTAGTITLAANALAENGAKEVYACCTHPVLSGPAIERIQNSRIKELVVTNSIALPEEKKIDKIVELSVAPLIAEAISRVYEMKSVSVLFD

SEQ ID NO: 68317 - protein, 396 aa, Arabidopsis thaliana
MASVTFSVPKGFTEFSGLRSSSASLPFGKKLSSDEFVSIVSFQTSAMGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHIEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 68318 - protein, 331 aa, Staphylococcus aureus
HMLEMIKSGKARAHTNIALIKYWGKKDEALIIPMNNSISVTLEKFYTETKVTFNDQLTQDQFWLNGEKVSGKELEKISKYMDIVRNRAGIDWYAEIESDNFVPTAAGLASSASAYAALAAACNQALDMQLSDKDLSRLARIGSGSASRSIYGGFAEWEKGYSDETSYAVPLESNHFEDDLAMIFVVINQHSKKVPSRYGMSLTRNTSRFYQYWLDHIDEDLAEAKAAIQDKDFKRLGEVIEENGLRMHATNLGSTPPFTYLVQESYDVMALVHECREAGYPCYFTMDAGPNVKILVEKKNKQQIIDKLLTQFDNNQIIDSDIIATGIEIIE

SEQ ID NO: 68319 - protein, 132 aa, Helicobacter pylori
SNIKYELDKESGALMVDRVLYGAQNYPANYGFVPNTLGSDGDPVDALVLSDVAFQAGSIVKARLVGVLNMEDESGMDEKLLALPIDKIDPTHSYVKDIDDLSKHTLDKIKHFFETYKDLEPNKWVKVKGFEN

SEQ ID NO: 68320 - protein, 318 aa, Blastopirellula marina DSM 3645
MEGKVMPRGKSYDDACSAIGDTPMIKINRLVPEGHATVFAKCEFFNPLNSVKDRIGYAMIADAEKSGKINQYTHIIEPTSGNTGIALAFVCAAKGYKLTLTMPESMSLERRALLRVMGANLVLTPAAEGMKGAINTAHEMVEKESGAWLAGQFDNPANPAIHEATTGPEIWEDSGENIDAIVAGVGTGGTITGVARYIKSKNPDFKAVAVEPTSSPVISGGAPGKHRIQGIGAGFVPKNLDTSVLDEVIKVDDEDAFEWGRQLAKQEGIVAGISSGATMWAAAQLAARPEMKGKRIAVIMASLGERYISTPLFGGLDG

SEQ ID NO: 68321 - protein, 473 aa, Prochlorococcus marinus str. MIT 9303
MGKSPQDVLRQIKDEGIELIDLKFTDLHGKWQHLTVCSDLIDEEAFTNGLAFDGSSIRGWKAINESDMDMVPDASTAWIDPFYRHKTLSLICSIREPRSGEPYARCPRALAQKALGYLAGTGLADTAYFGPEPEFFIFDDVRYNSGEGGCFYSVDTIEAPWNSGRIEEGGNLAYKIQLKEGYFPVPPNDTAQDIRSEMLLLMGQLGIPMEKHHHEVAGAGQHELGMKYAELIEAADNVMIYKYIVRNVARKYGKTATFMPKPVFNDNGTGMHVHQSLFKGGQPLFFGEGTYANLSQTARWYIGGILKHAPSFLAFTNPTTNSYKRLVPGFEAPVNLVYSQGNRSAAVRIPLTGPNPKAKRLEFRPGDALANPYLAFSAMMMAGVDGIKNQIDPGDGFDEDLFELPAERLASIPTVPASLNGSLEALNADKNYLMEGGVFTEDFINNWIDIKYEEVQQLRQRPHPHEFTMYYDA

SEQ ID NO: 68322 - protein, 570 aa, Escherichia coli O157:H7 EDL933
MSEKHPGPLVVEGKLTDAERMKLESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPGRPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 68323 - protein, 411 aa, Pseudomonas aeruginosa PAO1
MAESRPARRFARIDRLPPYVFNITAELKMAARRRGEDIIDLSMGNPDGPTPPHIVEKLCTVAQREDTHGYSTSRGIPRLRRAISHWYRDRYDVQIDPESEAIVTIGSKEGLAHLMLATLDHGDTILVPNPSYPIHIYGAVIAGAQVRSVPLVPGIDFFNELERAIRESIPKPRMMILGFPSNPTAQCVELDFFERVVALAKQYDVMVVHDLAYADIVYDGWKAPSIMQVPGAKDIAVEFFTLSKSYNMAGWRIGFMVGNPELVSALARIKSYHDYGTFTPLQVAAIAALEGDQQCVRDIARQYQQRRDVLVKGLREAGWMVENPKASMYVWAKIPEPYAHLGSLEFAKKLLQDAKVSVSPGIGFGDYGDDHVRFALIENRDRLRQAVRGIKAMFRADGLLSPQRKVDSLAE

SEQ ID NO: 68324 - protein, 80 aa, Zea mays
MELINEVPPIKVDGRIAVCEGASEGVGLGHPIEYICLDLEAPNMSSVIPNPTGQQQQPFNSALGYYSRLQANTEFVLAHT

SEQ ID NO: 68325 - protein, 394 aa, Prochlorococcus marinus str. MIT 9303
MATTQTLPQVDQSHKTVLEPIATPTRLLFGPGPSNADPKVLQALARSPIGHLDPLYLELMGEVQELLRYTWQTDNRFTLPMSGTGSAAMEATLTNTVEPGDTVLVAVNGYFGNRLADMAGRYRANVQLIEKPWGEAFSLAELEAALIEHRPAILALVHAETSTGVCQPMDGVGDLCHKHDCLLLLDTVTSLGAVPVFLDQWKVDLSYSCSQKGLSCPPGLGPFTMGPRAEEKLSARSGKVPNWYLDVSLLNQYWGSDRVYHHTAPVNMNFGMREALRLLADEGLENAWDRHRCNAEALWAGLESLGLELHVPEALRLPTLTTVCIPNGVDGNAFRLHLLNEHGIEIGGGLGSLAGKIWRIGLMGYNSTPKNVELLLNLFESELPRFRENVAVAA

SEQ ID NO: 68326 - protein, 479 aa, Cryptococcus neoformans var. neoformans B-3501A
MPPINKAQAEQVGEYDYFVIGGGSGGLASARRAGSYGAKVGLVEVSPRLGGTCVNVGCVPKKIMWYTADVAENLRKSAQYGFGKEGEGYKLAADFNWTELKHKRDAYIHRLNGIYESNLEKDHVDHHQGWASFVDANTVAIEPPNGDKYTVKAKNIVIAVGGRPTVPSEKDIPGASYGITSDEFFELETQPKRVAVIGAGYIAVELAGVFNTLGSETHLVIRHNQLLRTFDPMMSEVLVPCMEKAGMKIHKKTHVKKVEKTSSGSLLVHLDSSSESIEVDCLLWAIGRHADTAKLGLDKAGVKYDKKGDVIVDDYQNTNVPGIYAVGDVGGRMLLTPVAIAAGRRLSNRLFGPEKYKNDKLSYDNIPSVVFSHPTIGSIGLSEPEAREKFGDDNIKIYKTSFRAMSFAMLDEDHKQPTAYKLICTGPDEKVVGLHIIGEGSDEMLQGFGVAIKMGATKEDFDACVAIHPTSSEELVTLR

SEQ ID NO: 68327 - protein, 510 aa, Antithamnion sp.
MNNKSISPIILMILDGWGHSTNAKGNAIHEANTPIIDKLWDNYPKTLLSASGEHVGLPHKQMGNSEVGHTTIGAGRIINQDLVKISKSIKNKEFFNNYQLHNIYKYSCEKNSKVHIVGLCSNGGVHSHINHLKALIQISKQYKVMTCLHLITDGRDTLPKQAKLFVKEIIDIIDENYNTEICTISGRYYSMDRDCRWSRTEKAYKAMVENSCNQNSSSDILSIIDKYYEQNISDEFLPPTKISMHNIVHNDSLIFFNFRPDRIRQLLHSFAKPNFKGFQRKTIKNLMLTTFTEYDSTLSIPTVFPNEPKKNFLGQIISNSGLKQLRLAETEKYAHVTYFFNGGIEEPFPGENRELIASPKVETYDLPPEMSAYQLTNSLIEAINKQLYQFIVINYANPDMIGHTGNMNATIEAIEIVDQCIEKVLHTIEDTNNILIITSDHGNADYMLTDENKPCTSHSINPVPFILINNRQKKQTNLHSHGSLADIAPTILDILNINIPNEMNGKSLIT

SEQ ID NO: 68328 - protein, 496 aa, Physaria fendleri
MTSLNIKLLYHYILTNLFNLCLFPLTAFLAGKASHLTKSDLLMFLSHLQDNLITVIVLFTFTIFCLVLYIVTKPKQIYLVDYSCYLPPDHLKVSISSVMDIFYELRKVDPLCEVGCDDSSLEFMRKVLERSGLGDETYVPLGLHQVPPQKTFAAIKDETEQVIKGALENLFENTKVNPREIGILVINSSMFNPTPSLSAMVINTFKLRSNIKSFNLGGMGCSAGVIAIDLAKDLLHVHKNTYALVISTENITITAYAGENRSMNVSNCLFRIGGAAILLSNKPRDKRRSKYKLAHTVRTHTGADDMSYRCVQQEEDEMGKVGVRLSKDITTVAGTAVKKNISTLGPLILPLSEKLLYFVSFIAKKLLKEKIKNYYVPDLKLAINHFCIHAGGRGVLDVLEKNLRLSPIDVEASRSTLHRFGNTSSSSIWYELAYIEAKGRMKKGDKAWQIALGSGFKCNSAVWVALRNVKASANSPWEHCIDRYPVPDTCVENGKS

SEQ ID NO: 68329 - protein, 188 aa, Oceanobacter sp. RED65
MTTLVNTEIKPFNATAFKQGEFVEISDADVKGKWAVFFFYPADFTFVCPTELGDVADKYEELQKLGVEVFSVSTDTHFTHKAWHDSSETIGKINYYMVGDQTGTITNNFGVMREGQGLADRATFLVDPDGVIQAMEITAEGIGRDADDLLRKVKAAQYVRNNPGEVCPAKWKEGDETLAPSLDLVGKI

SEQ ID NO: 68330 - protein, 502 aa, Salmonella typhimurium LT2
METKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGVRFGADSVLKPEIVRGFEYSDCWVDDARLVLANAQMVVRKGGEVLTRTRATAARRENGLWIVEAEDIDTGKKYVWQARGLVNATGPWVKQFFDEGMHLPSPYGIRLIKGSHIVVPRVHNQKQAYILQNEDKRIVFVIPWMEEFSIIGTTDVEYKGDPKAVKIEESEINYLLKVYNAHFQKQLGRDDIVWTYSGVRPLCDDESDSPQAITRDYTLDIHDENGKAPLLSVFGGKLTTYRKLAEHAMEKLASYYPGIGPAWTKTCVLPGGDIDGSREDYAAKLRRRYPFLTESLARHYSRTYGSNTEWILGEATSLLDLGEDFGHEFYEAELKYLVDHEWVRRTEDAIWRRTKEGMWLTAEQQSRITQWLAAYVEKHQLSMAS

SEQ ID NO: 68331 - protein, 473 aa, Oryza sativa Japonica Group
MGNWHNKQHMGISKIIRRQFIGVRMGKNNVYFFRGCGSPCARSPTLESPGDIYAMWALRPERSWGPRGLTQRVLGGGFAAAWVAVGGPRGGECWGPLVLVVLLKHVIVFSKKYSLRTKIYGGVLNSEIDLRSTIFAYRKRQGGCCWWGCNGGEERAGGELRGDADRLRADGGGGVAGGGAGVRQGARGGAGERGHRGGAARRRGRVRRQAGGRRVRAGCSRPSSATTASTTAGSCSTPGARTALAFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 68332 - protein, 438 aa, Triticum aestivum
  misc_feature (76)..(76): Xaa can be any naturally occurring amino acid
MATMSRALGSAFVGFTRTPAVPATTPLPLPSSRASSALLLRWQRSRGVVGGGGGARRYSSGRNAKISMSLRAGIVXGLPNVGKSTLFNAIVENGKAQAANFPFCTINPNTGVVAIPDPRLDVLSKLSKSKQTVPTSIELVDIAGLVKGASKGEGLGNQFLSNIREVDSILQVVRCFEDDDIVHVNGKVDPKSDIDVINLELIFCDLEQIEKRLDKLKKSKTKDPQVKVKEGAERSGLEKILDALMDGKPARSVDLPDHEKEAIQHLYLLTMKPVIYVANVTESDLADPDKNPHVQEVAKLASELKSGMVTISAQVEAELSELPLEERVEYLNSLDVAESGLGNLVKATYNLLGLRTYFTTGEQETKAWTIIAGMTAPQAAGVIHSDFQKGFIRAETVSYDDFVAAGTLGAAREKGVMRLEGKEYIVQEGDVMLFRFNV

SEQ ID NO: 68333 - protein, 405 aa, Myxococcus xanthus DK 1622
MVTLEDIQAARERLRSAIRPTPCPQSDYYTERTECAAVFFKLENLQRTGAFKERGALNKLLTLTEDERRRGVIAASAGNHAQGVAYHARRLGVSATIVMPERTPLIKVSRTRDDYGARVVLKGTNYDEAYAEALRIQKAEDRVFIHPFNDAHVIAGQGTIGLELLEQCPDLEVVLVPIGGGGLISGIACALKETRPDIRVVGVQAETIASMKASVEAGERVLLAAAGTTIADGIAVKRVGDLTFPMVQKYVDEVVAVDEEEIAAAILTLLEQEKSVVEGAGAVGLAALLSGDVPAARGRRTAIILSGGNIDMNVISRIIERGLVKAGRLVQLEVRLPDRPGMLAKLTTQVADLRANVVEIHHERAFSKAGLGEAMVEVTLETTGPAQIEELERALHRLGWQVARK

SEQ ID NO: 68334 - protein, 744 aa, Zea mays
MAGQERRTIDLEEGWAFMQKGITKLKNILEGKPEPQFSSEDYMMLYTTIYNMCTQKPPQDYSQQLYDKYRESFEEYIASMVLPSLREKHDEFMLRELVQRWSNHKVMVRWLSRFFYYLDRYFISRRSLTPLKEVGLTCFRELIYQEIKGQVKDAVIALIDKEREGEQIDRALLKNVLDIFVEIGLGQMECYENDFEDFLLKDTTEYYSVKAQSWILEDSCPDYMIKAEECLKREKERVGHYLHISSEQKLLEKVQNELLAQYATPLLEKEHSGCSALLRDDKVEDLSRMYRLFSKISRGLEPISNMFKTHVTSEGTALVKQAEDSASNKKPEKKDMVGMQEQVFVWKIIELHDKYVAYVTECFQGHTLFHKALKEAFEVFCNKGVSGSSNAELLATFCDNILKKGCSEKLSDEAIEDALEKVVRLLAYISDKDLFAEFYRKKLARRLLFDKSANDEHERSILTKLKQQCGGQFTSKMEGMVTDLTVARDHQTKFEEFVAGHPELNPGIDLAVTVLTTGFWPSYKTFDINLPAEMVKCVEVFKEFYQTRTKHRKLTWIYSLGTCNINAKFDAKPIELIVTTYQAALLLLFNGSERLSYSEIATQLNLSDDDVVRLLHSLSCAKYKILNKEPANRSISPNDVFEFNSKFTDRMRRIKIPLPPVDEKKKVVEDVDKDRRYAIDASIVRIMKSRKVMGHQQLVAECVEQLSRMFKPDFKAIKKRIEDLITRDYLERDKDNANTYKYLA

SEQ ID NO: 68335 - protein, 235 aa, Picea sitchensis
MCNLEKRGRVYILTLLGDGDHRFNPSTIDAISAALKEVQDSPDAGALVTTNQGRYFSNGLDLQWISQNPDAHLSTIRIKFENLLASFIRLRVPTIAAICGHAAAGGFIVALAHDYRFMRGDRSVLYMSELDIGMKLPRSLMAVIRSKLLPGTLRDVVLGARKFSAQMALEGGIVDSVYADSPQTLEAAVSEAQKLAGRGWKKEIYSELRLGAFPGVLEELDAHRDPYLFPVSSKL

SEQ ID NO: 68336 - protein, 308 aa, Moorella thermoacetica ATCC 39073
MGRIYQNITQLIGGTPIVKLHRMNPSEAEVLVKLELFNPGGSIKDRIALAMIEDAEERGLLDKDTVIIEPTSGNTGIGLAMVAAARGYKLILTMPETMSQERRQLLKGFGAELVLTPGAEGMKGAIRRAEELAATYPRAFIPQQFENPANPAAHRHTTAAEIYDATDGQLDILVCGVGTGGTITGTGEVLKERIPGLQVVAVEPASSPVLSGGMAGPHKIQGIGAGFVPEILNIDVIDEIIQVTDEEAIDTARRLAREEGIMVGISSGAACWAALRLAARPENAGKRILAVLPDTGERYLSTSLFQEI

SEQ ID NO: 68337 - protein, 390 aa, Pseudomonas aeruginosa PAO1
MATSYSARSRAIEPFHVMALLARANELQAAGHDVIHLEIGEPDFTTAEPIVEAGRAALAAGHTRYTAARGLPALREAIAKFYGERYGVDLDPQRVLVTPGGSGALLLASSLLVDPGRHWLLADPGYPCNRHFLRLVEGAAQLVPVGPDSRYQLTPDLIERHWDSDSVGALVATPANPTGTLLDRDELAGLSGALKARGGHLVVDEIYHGLTYGVDAASVLEVDDDAFVLNSFSKYFGMTGWRLGWLVAPTAAVPELEKLAQNLYISAPSMAQQAALACFEPTTIAILEERREEFARRRDFLLPALRELGFGIAVEPEGAFYLYADISAFGGDAYAFCKHFIETEHVAFTPGLDFGRHQAGHHVRFAYTQNLPRLQEAVERIARGLKNWRP

SEQ ID NO: 68338 - protein, 540 aa, Prochlorococcus marinus subsp. pastoris str. CCMP1986
MIRFDNVSKIYSTDVVLKNINWEIRKGEKIGLVGSNGAGKSTQFKILIGEEDQTSGLVLKEGSPKISHLKQELDCNLNRTVREELESSFKDIQVVSNKLLEIENEMKFLETSKDSEKLDHLVNQLAKFQEKFEVLGGYQMQAEVEKILPKLGFSQNDADKLVGNFSGGWQMKVALGKIILQKPDLLLLDEPTNHLDLETIFWLEEYLISLKISIILISHDRYFLDKLCKKIIFIERGISETYNGNYSFFIEQKSLNEATQSKAFELQQKEIETQKKYIERFRASATRSTQAKSREKQLKKIVKIDAPISRLKSPSFNFPECPRSGKLVLQIKNLSHSFEEKILLFDVNLRVSAGEKIAILGPNGCGKSTLLKLIMKKIEPEIGEVNLGKHNIITSYYEQNQAAALAVEKQVIDLIYSKAPDWSQQKVRTFLGSFGFHNDSVFKHVQQLSGGEKARLALALMIMNPSNFLLLDEPTNHLDLQSKENLELAINNYKGTVFIISHDRYFISKVANRIIEIKDSKLLSFNGNYEYFLEKKRSIK

SEQ ID NO: 68339 - protein, 1240 aa, Gibberella zeae PH-1
MTGNKVSEATRERETFKYDSVLVANSVRNDVTNLIPPASLRPCSDPAMTALAQVALLRLGATRAMISLFDCQNQHVIAEATPAMPISAHCTLPVSGPGSLWLCGTSIPRGYGICDVVLGPPELDDMIQITTSSESPIRVVSDLATSGEFRHTWYYKTRPEHRFYAGVPITTPRGINIGVFCILDNKPRDSFDKASIQIMRDISASILGQMELTRSGDGRRPGERMVRGLGSYVEGKATMSGWRSSFTHAFDTDVGTEEGALNQTQQQLQNRREHASSVGSSEQMATPDTFILESPMEKRSASPPRPTERQTHPDTSGEESRQKQLKHIFSKAANILRESIEVEGVLFLDASVGTFAGRVRSGSVRRESQTHERSSSSSSSSSTSRGHVSVSSPRSSGDPQAKGASCPILGFSTSMSSSINGEAPTGRSQIVPERQLQRLLRRYPKGKIFNFDSQGVMASSDPTSEDSAMATFQEYKARDLEEEPTGENRKPRGARDPFSRRNEGMAIRDLFPGARSVAFVPLWDSNRQRWFSGCFVYTMTPTRIFTVQGELSYLTAFNTVIMADVIMMESAFVSLATTSLLSSLSHELRSPLHGIVLCAELLRDTSLDVFQGDVLRSLEVCGRTLLDTINHLLDWTRINNFARIPNEQPLSLGISPRRGTQANKKSSPADGMMRISSNLDVDMLVEEVVECIHAGHTYQQQSVSLLGDRSSEEELSRGPYARLDGMDLAEGSKAGNQKPNNGVNLNKVLVILEIDPNVDWAFHVESGALRRIILNLCGNALKYTTQGFVKVKAYQDSPGQGRPRDRVVHIEIMDTGSGIGQDYLNHRIFSPFSQENVHSSGAGLGLSLVRKFVRALGGSIHIQSKVGTGTRVAVKLPLQIASPESTETASDRDEFKSQIIELSRLRVSINGFSPSRGGSESQRWGSAEFDEYSSLEKVCRDWLQMDVVGPLGNESFYPDLILCDEAQLESIANQPRGELSSPVVVVCRSAAVARQLDQFHRSRRRSNWGLFSFISRPVGPRKLAKAFVLCFRRWTKLQSTAADRASVFTTLDEPPTVPTVDPSTSEDGLDNKNAGYFDLAPKFSPQKKRARTDEDESWTPLPSTPAIRPAPSLPEPRFLLVEDNIINMKILQTYMKKLGVVYDCASNGKQAVESYKAKGGTYKCVLMDISMPVMDGFEATRLIRLFEKESSLPRRQIVAISGLASKDAQDDAYANGLDLFLAKPVQLKELSQILKSRELI

SEQ ID NO: 68340 - protein, 138 aa, Magnetospirillum magnetotacticum MS-1
MTKWVYSFGDGKAEGEASMRNLLGGKGANLAEMSNLGLPVPPGFTITTEVCTYYYEHGETYPAELKDAVNAALDTVGKLTGRRFGDAEKPLLVSVRSGARASMPGMMDTVLNLGLNDTTVEALAKDADDERFAYDSYR

SEQ ID NO: 68341 - protein, 132 aa, Helicobacter pylori
SNIKYELDKESGALMVDRVLYGAQNYPANYGFVPNTLGSDGDPVDALVLSDVAFQAGSVVKVRLVGVLNMEDESGMDEKLIALPIDKIDPTHSYVKDIDDLSKHTLDKIKHFFETYKDLEPNKWVKVKGFEN

SEQ ID NO: 68342 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPTDKIDPTHSYVKDINDLSKHTLDKIKHFFETYKDLEPNKWVKVKGFEN

SEQ ID NO: 68343 - protein, 696 aa, Gibberella zeae PH-1
MDDFAAYRNQSRQAEPPQRDARAGDSDFDSLFEDDNPGQIYTSAPKEAFKLGYFDVMCLVLNRMIGTGIFNSPQRVMQGTRSTGATLLLWLAGVVYCLSGVHVYIEYGLNVPRYTINGIEQSVPRSGGDLNYLQYVYRKPAYRKGTVLLSTCMFGFCFIALGNMAGNCINFATMVLSASGNDDPSSGAVRGIAIGIAILTCFIHTFSRRGGIFLNNMLAIIKVMMLLLIIVTAIIVGAGGLKNADGKPVTKEIENNTRPSSAFAESGDANGYAHAFLAIIFSFSGFEQPNYVMGEISRPRRKHPVAMLLGVGTAILLYMAVNISYMVVVPSDDQIYDNVAQRFFELTLGSLNNSGTGKRIFHAFLAISSMGNIIVMTYTAARVKQEIAKEGIIPYAKFFAQDGDISLGRLLNWFKKRGMFSSLLSTRWLSPEDHMERTPVGAFVLHLASCFVLIFATWSMDPKSSYTLLTSLSAYVINAFFGTFLGLGILILRFKGPPKTDKDEIQSPAAPPQTWRQMTGKHINPTLSVICAVIYIIGGLWPIVTIWIKPNEPDQRPGKPDEQRLTWWLVPTITWSVIGGSVFWFLGFIAFAMRRKHKRNEIFVVEKKPEFESADGPDDSDGRTGGYVLVHETVYLSWIAGEIHESKGSGTTGFQERPDAMSAAPVNRYAGTDFEAFYQEERVAAPTKAYYSDYRP

SEQ ID NO: 68344 - protein, 181 aa, Synechococcus sp. RS9917
MIPGLEPVSLRDLQALGASKRWPIEGSLDDLPSLTPVRGELQAEHLGNLLALQGRFETIVTLCCDRCLGQYNHRLQADVEELIWLGDAENETAMAEAGLGVDGAQGLVECLDPRGSFDPERWVFEQLNLQLPVVNRCGLDCPGMPLERPRSPAAEHQNDSLKAEPSDPRWAALRKLRGEGC

SEQ ID NO: 68345 - protein, 265 aa, Arundo donax
AESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNANRFEEAKKFGCTEFLNPKDHSKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHTVPFSEINKAFDLMAKGEGIR

SEQ ID NO: 68346 - protein, 310 aa, Coprinopsis cinerea okayama7#130
MLPDRKEEKVKEKQMEALKRLGHLDLELDEYENIGGLDHIVSSLRESVIYPLLYPNLFTASSSLLGAPKGVLLFGPPGCGKTMMAKALAKESGATFINIAASVLTNKWYGESNKLVAGLFSLARKVQPSIIFIDEIDSFLRERTKGDHEVTGMMKAEFMTLWDGLTSSTDRILVLGATNRPNDIDSAILRRMPKRFAVGLPNYDQRLKILQLMLKDTKTEPDFSVEQLAQHTTGFSGSDLRELCRNAAMVPVREYMRSAEGNEELLAKGQLEGFDLRPLRLADFFVQDGTSPLPPRDIDDESLARFDDPE

SEQ ID NO: 68347 - protein, 212 aa, Eragrostis japonica
KSRFSINGKPIYHFVGTSTFSEYTVMHVGCLAKINPEAPLDKVCVLSCGISTGLGASINVAKPPKGSTVAVFGLGAVGLAACEGARIAGASRIIGVDLNPNRFEEARKFGCTEFVNPKDHNKPVQEVLAEMTNGGVDRSVECTGNINAMIQAFECVHDGWGVAVLVGVPHKDAEFKTRPMNFLNERTLKGTFFGNFKPRTDLPNVVELYMKK

SEQ ID NO: 68348 - protein, 431 aa, Salmonella typhimurium LT2
MVSLEKNDRVMLARQLPLKSVALILAGGRGTRLKDLTNKRAKPAVHFGGKFRIIDFALSNCLNSGIRRIGVITQYQSHTLVQHIQRGWSLFSEEMNEFVDLLPAQQRMKGENWYRGTADAVTQNLDIIRRYKAEYVVILAGDHIYKQDYSRMLIDHVEKGARCTVACMPVPIKEATAFGVMAVDESDKIIDFVEKPANPPAMPGDASKSLASMGIYVFDADYLYELLAADDKDDASSHDFGKDIIPKITREGMAYAHPFPLSCVQSDPQAEPYWRDVGTLEAYWKANLDLASVTPELDMYDQNWPIRTHMESLPPAKFVQDRSGSHGMTLNSLVSGGCIISGSVVVQSVLFPRVRINSFCNIDSAVLLPEVWVGRSCRLRRCVIDRACIIPEGMVIGENAEEDARRFYRSEEGIVLVTREMLRKLQVKQER

SEQ ID NO: 68349 - protein, 605 aa, Zea mays
MGGEAPEPRRLTRALSIGGGDGGWVPEEMLQLVMGFVEDPRDREAASLVCHRWHRVDALSRKHVTVPFCYAVSPARLLARFPRLESLAVKGKPRAAMYGLIPDDWGAYARPWITELAAPLECLKALHLRRMVVTDDDLAELVRARGHMLQELKLDKCTGFSTHGLRLVARSCRSLRTLFLEECQIDDKGSEWIHDLAVCCPVLTTLNFHMTELEVMPADLKLLAKSCKSLISLKISDCDLSDLIEFFQFATALEEFAGGTFNEQGELSKYVNVKFPSRLCSLGLTYMGTNEMPIMFPFSAILKKLDLQYTFLTTEDHCQLIAKCPNLLVLAVSSPAHVRNVIGDRGLGVVADTCKKLQRLRIERGDDEGGVQEEQGGVSQVGLTAIAVGCRELEYIAAYVSDITNGALESIGTFCKKLYDFRLVLLDREERITDLPLDNGVRALLRGCTKLRRFALYLRPGGLSDAGLGYIGQCSGNIQYMLLGNVGETDDGLISFALGCVNLRKLELRSCCFSERALALAILHMPSLRYVWVQGYKASQTGRDLMLMARPFWNIEFTPPNPKNGGWLMEDGEPCVDSHAQILAYHSLAGKRLDCPQSVVPLYPA

SEQ ID NO: 68350 - protein, 403 aa, Candida glabrata CBS 138
MSNRAVPQGYLANLQFRIRSDNLPLLSTVQPSRGHKRGGRAVNYAEFDNELLEDFSNFPTFDIDSDSNDEEQSSASAGNDDPQANANGGEAAGVNGQGSGDGGSANTGAGRHGKSQLTAEMEKNYKTGVPDLNEQKDSLNVLRYQKIRESFQHGKIAVPYRLYVPPELSTGQQEAILIPITLNVEHGNNTISDAFVWNVNDTSISVEDFVTTYCNDLGLYGNVSLHSQIVSSINEQIQELENVASLVIPDLEVVVNLTCTIQGKFFEDYFQWNLSDKSLSPEKFALIIVADLGLAREFAPGIAHSLHEYLLHVKKEWAEGSLHQDTVPNEAAFGYLAGVRLNIDDLGAKWAPKVEYLTQEEIQKREIEKERNMRRLKRESDRMGGGARRGRRRLDDLELTMKM

SEQ ID NO: 68351 - protein, 125 aa, Synechococcus elongatus PCC 6301
MDVLVVRGIRAYGYTGFFDAEQELGQWFEVDLRVWVDLQPAGDSDQLGDTLDYSQAVQVVQTGIRQSRFRTIERLAADLCDRLFQQFPALPELELTLRKLAPPIPDFSGDVSLVLRRSRKLTGAD

SEQ ID NO: 68352 - protein, 649 aa, Aspergillus oryzae
MSRSMKAPMRALLELRTKCMGRLNVTDSTYTSLSTIRGRRNQSFYSSTEVDSFLEVKNGVKRRPSFLTSSIKMQPEHRSAEVIVIGAGIGGLAAAKTYLELSPLTNLILLEKRPTIGGVWSEENCYEGLKTNNLGGTYEFTDFPMGEKYGIKEDGHIPGSVLHSYLNDFATHFDILRRIDFNTQVLDIEKLGQGWRLNTETTDSSSTVVYTCDKIIVCSGLASTPNPVNIRGIDEFERPVLNHSQLREEGARIAHDPNVETVTVVGASKTGYDVVHMMASNHKRVDWVIRESGGGGVWMSSPWAKFAGAKTKLELLATMRFFTWFSPCIFGDFDGFSWIRKVLHQTRLGRYFVHKFWEGIRMDIIDQNGYRKEECLQHLEPLESLFWSARVGILNYPSDIHDYLRSGQVKIIRKDIEHLSGPGVVTFADGTSLHTDALIAITGWKLAQSIKYQPEGLESSLGIPCSNTSAEDRSLWRRLDDEADKEILGRFPYLCNPPPAIPYKQDVSPYRLYRGIAPPSLAAKGDNSIAYMKMVHSTSNIIIAECQALWTYAYLNGKISLDKTEVYHQTALLSRYGKQRYPCGFSAWYPEFVYDAIPYADMLLHDLGLKRWRKPTFKKEMFEGYTIHDYRGINQEWLAAQMKATPKRS

SEQ ID NO: 68353 - protein, 471 aa, Synechococcus elongatus PCC 6301
MALQQFGLIGLAVMGENLALNIERNGFSLTVYNRTAEKTEAFMADRAQGKNIVPAYSLEDFVASLERPRRILVMVKAGGPVDAVVEQLKPLLDPGDLIIDGGNSLFTDTERRVKDLEALGLGFMGMGVSGGEEGALNGPSLMPGGTQAAYEAVEPIVRSIAAQVDDGPCVTYIGPGGSGHYVKMVHNGIEYGDMQLIAEAYDLLKSVAGLNASELHDVFAAWNKTPELDSFLIEITADIFTKVDDLGTGQPLVELIIDAAGQKGTGRWTVETALEIGVAIPTIIAAVNARILSSIKAERQAASEILSGPITEPFSGDRQAFIDSVRDALYCSKICSYAQGMALLAKASQVYNYGLNLGELARIWKGGCIIRAGFLNKIKQAYDADPTLANLLLAPEFRQTILDRQLAWRRVIAIAAERGIPVPAFSASLDYFDSYRRDRLPQNLTQAQCDYFGAHTYERTDRSGSFHAQWF

SEQ ID NO: 68354 - protein, 449 aa, Yarrowia lipolytica CLIB122
MKHLKSVAIIGGGPSAAPCIKALLAENYFGKITAYEQQPAPGAGVWNYNGLTRPTPNLPCTRDMPAEPIEHKKDGSIIYYNPMYRDLNTNLPHMLMAYKDFPFPEGVDLFPKRQVVKQYVQDYARHVVDHFKFETMVTGLKKTGDVWMVESKYVGPHAKENVQPELETYDYVIVCTGHYSHPFVPDVPGLKAYSDKHEVLHAKYFDNPDSYVGKTVLVVGNSSSGIDIANQAAKTAKKVIVSARSPSNAPTKGNIETVGVITKFHGDDIDVEGAPGVEGSSPQTLSDVDVVIYCTGYLYSFPFLHSYVHHSDDDLITDGVRIRNLYRQLFYINDPSIAFIGMPKNVVPFPLAETQAAVVARVWSGRLKLPSKETQFESLRKEEKERGTGSAHHTLKHPLDAEYQQALTDWLKADTYPDPDKGFFGVEWDEERYNWRRNVKKPQLGDLSL

SEQ ID NO: 68355 - protein, 757 aa, Candida glabrata CBS 138
MINRRVGIRIPTKLSIPKQDFSQSWEILESALNHIYAEDTEKLSFGDLYRTIYTQVLNRNGEKLYSAFEAYMAKKLDEIRELTFTEHVLSDNDSFLLEMGELWKKQSDILKTISDLTIYMDKVYSKPNRVPEIHELGLQIFKKHILMKIKDQLLNSILADINSVRDCQELDLQKAHLWKLLVSMMETITDTKDTFYLNYFEPKFLNDTGLYYKKSFTPTDKSATECLEKIRVLQSFEIEMCEDYLNKDTILKLNHVLEEVLYNQKLNIHVPELIKISFEQDNYELLDQIYTVSLSDDYRLQIVNAIKSYMLKHCNNSEPKEIPKKRYLYAIQWTARVLATYKKCHEFLSNVNFGSVVVRKSEADNETETKAYNSAVISNEVFSEYLNQDGKRSSEFVTIYLDSCLKLSIEKQKYKQVKQDLDAAVKLFKLLQEKDIFSQYYQQQLSKRLLQQKSSLDLERWLITQIKSEMGSLFTSKLEGMLRDVNSSIELYKTFQNTTKEAVAGFMFKPQILTPTSWPFQAPDRVDPNFKLPETLQGIQDSFETFYTNKYNQRILKWSHHLSSIEVGYQFAKTYHEIHLPIYAASIFFLFENHDSLTKDEIQDMTGLPDVELDKLLLSMTTAPRSKILVKSPPSKIINSTDTFAINEDFTAPTTKVKLQMIIGVVQPNNGTGEPNKASIMDNVERERQEVTNAAIVRLMKSERHLQFSELQEKTAVQLAQRFTLSLATFKACIETLIEKEYIQRDVDDHEFLHYIT

SEQ ID NO: 68356 - protein, 163 aa, Geobacter sulfurreducens PCA
MRHTITVLVENEFGVLSRVAGLFSGRGFNIDSLSVAPTNDESISRMTIVTRGDDQILEQITKQLNKLIDVIKVIDFTDGEVIEREMALIKVTAEDDARAEVLRIVDIFRSKIIDVTPRSFTIEATGTPAKIDAILELLRPLGLKELVRTGPAAIGRGAKGWKG

SEQ ID NO: 68357 - protein, 554 aa, Pseudomonas aeruginosa PAO1
MKHHLTPLDATQLDSWRALAAHRQELQDFRMRQAFIDDPERFKRFSFSACGLFLDFSKNLIRQDTIDLLVKLAEEARLSDAIRAMFDGEAINASERRPVLHTALRRPIGDKVLVDGVDVMPEVHRVLHQMTELVGYVHNGLWRGYTEKPITDVVNIGIGGSFLGPQLVSEALLPFAQKGVRCHYLANIDGSEFHELASRLNAETTLFIVSSKSFGTLETLKNAQAARAWYLAQGGTEEELYRHFIAVSSNKEAAIAFGIREENIFPMWDWVGGRYSLWSAIGLPIAMSIGISNFKELLSGAYNMDQHFQTAPFERNIPVLLGLLGVWYGDFWGANSHAILPYDYYLRNITDHLQQLDMESNGKSVRQDGTPVTSGTGPVIWGGVGCNGQHAYHQLLHQGTQLIPADFIVPVSSYNPVADHHQWLYANCLSQSQALMLGKSREEAEAELRAKGLPEAEVQRLAPHKVIPGNRPSNTLVVERISARRLGALIAMYEHKVYVQSILWGINAFDQWGVELGKELGKGVYSRLVGSEETPAEDASTQGLIDFFRGRHRG

SEQ ID NO: 68358 - protein, 566 aa, Geobacter sulfurreducens PCA
MKMTGARILLECLKLEGVDTVFGYPGGTVINIYDELFSFKEIRHILPRHEQAGVHAADGFARATGRVGVAIATSGPGATNTVTGIATAYMDSIPVVVITGQVPTALIGNDAFQEVDIVGITRPCTKHNFLVKDVKDIPSIIKKAFYIARTGRPGPVLVDLPKDVQIATAEFHYPDSIELRSYKPTVEGHPKQIEKAVSLMLEAKKPVIYVGGGVISGDAAGELYDFAKKLNMPVTTTLMGLGSFPEDDHQALRLLGMHGTYYANMAVTNCDMLFAVGARFDDRVTGKVATFAPHAKIIHVDVDPTSIRKNVRVDLPIVGEVKKVLSQMLKVLEEQGDKVERFRTGIEPWMAEIEGWKQKHPMTYKQTTSVIKPQYVIQKLRELSEPDAIIATDVGQHQMWTAQFFTFTKARTLLSSGGLGTMGYGLPAAMGAQAAYPDRQVIAICGDGGFQMNMQELATLVQNRLPVKICILNNNFLGMVRQWQELFFDRRYSQTCMELPIDFIKLAEAFGATGLQASKVDEVEGTIKKAFETPGPVIMEFKIAREEKVLPMVPAGASLNEMVLNA

SEQ ID NO: 68359 - protein, 194 aa, Oryza sativa Indica Group
MAKARKQQPQGPFAGGAAAGERSFLGFQYHHHHRGGSVAPAYGDDDDLPDLAEADVWYAPSSEGGADHRGGGGGGGGGGGLEIGGGGWGGGKHKVGGLSRAFADGRQVAASAPVQVPAWPGRYADPNQAAFAEEEKRREEEDDAGDGDGWVPPHVYLARRQARSSVVEGVGRTLKGRDASRVRDAVWSRTGFDG

SEQ ID NO: 68360 - protein, 218 aa, Moritella sp. PE36
MTQDELKKAAGWAALEYVKKDSIVGVGTGSTVNHFIDALGTIREDIKGAVSSSIESTKRLEAMGIEVFDLNSVPHLDIYVDGADEIDSNNNMIKGGGAALTREKIVAAVADQFVCIIDDTKNVAVLGDFPLPVEVIPMARSYVGRELVQLGGDPVYREGVVTDNGNIILDVYNMQITDPKALEIAINGLVGVVTNGLFAARGADIVLTGTQNGVKTTK

SEQ ID NO: 68361 - protein, 132 aa, Helicobacter pylori
SNIKYELDKESGALMVDRVLYGAQNYPANYGFVPNTLGSDGDPVDVLVLSDVAFQAGSIVKARLVGVLNMEDESGMDEKLLALPIDKIDPTHSYVKDIDDLSKHTLDKIKHFFETYKDLEPNKWVKVKGFEN

SEQ ID NO: 68362 - protein, 188 aa, Oryza sativa Japonica Group
MAVLLITRLLTLVLGYAYPAYDCYKTLELNKPQIDQLRFWCQYWILLAFLTTLETITYFTVSWLPMYGEAKLALVLYLWYPKTRGAKHVYESYLQPVLARHEADIDRGLLQLRASAKDATASHLQAAVSLGRACFAEVAGRVSSQLQAARSSGGGGRAGQADQLQKRQKINPEEEEEDEDATVSKTRR

SEQ ID NO: 68363 - protein, 262 aa, Muhlenbergia setarioides
WPCSSCVHWGMQGVRPLQVVWEQPVWSAQDQHRPGCDDWCRQLTVSIDGKPIYHFVGTSTFSEYTVIHVGCLAKINPEAPLDKVCVLSCGISTGLGASINVAKPPKGSTEAVFGLGAVGLAAAEGARIAGASRIIGIDLNTSRFEEAKKFGCTEFVNPKDHDKPIQEVLAEMTNGGVDRSVECTGNINAMIQAFESVHDGWGVAVLVGVPHMDAEFKTKPMNFLNERTLKGTFFGNFKPRTDIPNVVELYLKKELVLEKFIN

SEQ ID NO: 68364 - protein, 365 aa, Novosphingobium aromaticivorans DSM 12444
MDAYAAIIERQGGEFVLDNVSIEDPRDGEVLVKVAAAGMCHTDLTVRDQYYPTPLPAVLGHEGSGVVEKVGRGVTTVKPGDKVVLSFSYCGTCPSCLKGHQAYCPSLFPLNFMGRRLDGSTPITRNGQEVNACFFGQSSFATYSIASENNCVKVADDAQIELLGPLGCGIQTGAGSILNALCPEPGSSIAIFGVGSVGLSAVMAAKASGCLKIIAVDRNAGRLELARELGATDVIDANTVNAQEAIVAMTGGGADYAMDTTAIPAVLRSAVDSTHNMGETAVVGGAKLGTEFSLDMNNMLFGRKLRGVVEGSSTPQVFIPQLIAMQKAGLFPFEKLCTFYDLDQINQAVEDTEKTGKAIKAILKM

SEQ ID NO: 68365 - protein, 307 aa, Triticum aestivum
  misc_feature (135)..(135): Xaa can be any naturally occurring amino acid
  misc_feature (164)..(164): Xaa can be any naturally occurring amino acid
  misc_feature (174)..(174): Xaa can be any naturally occurring amino acid
  misc_feature (186)..(186): Xaa can be any naturally occurring amino acid
  misc_feature (206)..(206): Xaa can be any naturally occurring amino acid
  misc_feature (234)..(234): Xaa can be any naturally occurring amino acid
MAKEVSEEPEHAAPAHKDYSDPPPAPLFDMGELRMWSFYRALIAEFVATLLFLYITVATVIGYKVQSAADPCGGVGVLGIAWAFGGMIFVLVYCTAGISGGHINPAVTFGLLLARKVSLLRAVMYIVAQCAGGIXVGAGIVKGIMRDAYQANGGGANMVASGFXRGTALGAEIXAPSVLVYTVFSXATDPKRSARDSHVPVLAPLXPIGFAVFMVHLATIPITGTGINPARSLXAAVIYNKKAAWDNHWIFWVGPFVGALAAAAYHQYILRAAAIKALGLLPEQPGATEPPARPANNLMQRSPTAAS

SEQ ID NO: 68366 - protein, 397 aa, Synechococcus sp. RS9917
MHTSRRLERLGSGVFDRNDQRKHHYRLSEAAQGLPLVDLSLGSTDLEPPPQALAAMAAALEAPGSATYCLHAGTRPLREAVASWCQSRFAVDVDPEREVLLLVGSQEGTAHLPLAVLNPGEAGLILDPSYPSHRGGLLLADARIASLPLEEATGWRPCWDRLSSAEWDQLRLMVLGFPHNPTAQVGEQIWLDEAMQRAQRHDCVLAHDNPYLDLALEGEAPALLRSQGWRERGIEFFSLSKGWCLGGFRLAFAVGAAPLISALRQLKGVVDFNQSLALQQGAIAALTEVPDWPRRIVPIYRERRDRTLKALQRLGWQAPVPSMALYLWLPVPAWARQRGWNDEDLAAALLDQAGVALTPGSGFGAAGAHWLRLALVQPSDSLEQAIRRLEPWWRQQG

SEQ ID NO: 68367 - protein, 499 aa, Oryza sativa Japonica Group
MVQLFFQGTTDGGSVDTDAVKARRSLLGKVEPIIRSVIKSGGGYEARMWLCSTVSSIHLLDPYGQRDLFLNLLGMKNSKRDVAARLLRMIFDKKPKKAGSIIAKKCQMLEDFFQGNPKQIMQWFGHFAVTGELTHKKGARALSQFAFVNRDICWEELEWKGKHGQSPAVVATKPHYFRDLDVLRTVENFLEYVPDFWSSEELADSVKDGEILQIDTEYFVDQFVYLMYEENSRDAWQLVDEFLMDEQFSSLSQHLLIHLDEQRLLNFLRALGKLIKLNSQCKEMVFPCCWLEVLLSAHSDHISLDELVLLNCVISKGRQLWRLMNDEEQEEEQGQMQELLKSTNQLTDADHFALMKGFVDTELPDALKWIGIQSWLVFCELSKGCKSADSCEHLFTCNRIEFRKADDYPLVQNDGNSIALDSDDEDLIRGSHKRRKRDRKRKRRRYDSDEDDLDQLLELGTSNRRGIESHHGCWYLSTDGFSASWDIIHAFLDVLAAAT

SEQ ID NO: 68368 - protein, 289 aa, Desulfitobacterium hafniense Y51
MNQKKILREVLLPDGTKLAKLGQGTWYMGEKSRLWQQEVKALAMGIEYGMTLIDTAEMYGEGAAEELVGEAIKPYPRETLHIVSKVYPHHAGRKTIFKSCEASLRRLGLDYLDLYLLHWRGNIPLEETVECMNELVAQGKIKHWGVSNFDTEDMEELWQTPGGDRCSTNQVLYHLNSRGTEYDLQPWLKAHRLPMMAYCPMAHNLSTRQRIAQNPVVQEIAQNYGLTVEQILLCFVLGQENVMAIPKASQPDHVKDNAQVYDISIHEEDWQRINLAFPAPQHKTYLDIL

SEQ ID NO: 68369 - protein, 580 aa, Salmonella typhimurium LT2
MKPTFMRWVAIAALLAGGTFSAVANPPVAPPVSYGVEEDVFHPVRATQGMVASVDAMATQVGVDILKQGGNAVDAAVAVGYALAVTHPQAGNLGGGGFMLLRTKDGATTAIDFREMAPAGATRDMFLDDQGNADAKKSLTSHLASGTPGTVAGFSLALEKYGTMPLNKVVRPAMKLAEEGFVVNDALANDLKTYGSEVILNHENSKAIFWKDGEPLKKGDKLVQKNLAKSLEMIAENGPDAFYKGAIADQIAGEMQKNGGLMTKEDLANYKAVERTPISGDYRGYQVFSMPPPSSGGIHIVQILNILENFDMKKYGFGSADAMQIMAEAEKYAYADRSEYLGDPDFVKVPWQALTHKAYAKTLADQIDINKAKPSSQIKPGKLAPYESNQTTHFSVVDKDGNAVAVTYTLNTTFGTGIVAGNTGILLNNQMDDFSAKPGVPNVYGLVGGDANAVGPKKRPLSSMSPTIVVKEGKTWLVTGSPGGSRIITTVLQMVVNSIDFGMNVAEATNAPRFHHQWLPDELRVEKGFSPDTLKLLEQKGQKVALKEAMGSTQSIMVGPDGELYGASDPRSVDDLTAGY

SEQ ID NO: 68370 - protein, 424 aa, Synechococcus elongatus PCC 6301
MPSHPHLWFPFTSVKDAPDPLKVVSGKGARLTLADGRELIDCISSWWVNLHGHAHLRIVEAIAQQAATLEHVIFAGFSHEPAERLAMELCKILPEKLTRVFFSDNGSTAVEVALKMALQYWHNLDQPRSRILAFDGAYHGDTFGAMSVGERSLFNAPFEKLLFSVEFLPYPETWWGDETVEAKEAAAIAAVEQALAAGDVAAVIIEPLVQGAGGMRMARPQFLQQLAARVQAAGSLLIADEVMTGFGRTGAWFACQRAGIQPDLICLSKGLTGGFLPLSITVATEVIYDTFCSGNPDHTFYHGHSYTANPLGCAAAIASLELLLDSEAIVQGLEDAHLPGLELLAQHPKVTRPRLTGGIAACDLVSDRGGYLDPIGLRVRQAAIARGLLLRPLGNVLYLLPPYCLTPTELQDIYAAIADLLDEI

SEQ ID NO: 68371 - protein, 161 aa, Escherichia coli
MKNKSGNSYYREAVDIHSSLELSFILHKYHLRVDEKKSRNVFSAIRDELILDGDSRQNLATFCQTWIDDEIRELLNLSIDRNMIYKDEYPQMAEPEGRCVRMLSDSWSFPDSRHTLGCSTIGSSEAAMLGRLALKWQWCKKREVQGKSTEPDLRSCANMLA

SEQ ID NO: 68372 - protein, 604 aa, Yarrowia lipolytica CLIB122
MAVSSSKAKREAKKAEKAAAKAKAEGKEVGKSVDEIVAENTEKIKELKMQKDKDGLSDRVTTGVLASLETSRDLKLTSVSLNFHGKVLIQDSTLELNYGQRYGLLGENGCGKSTFLKALAEREYPVPEIIDIYLLNEPAEPSEWSALEYVVREAEAELKRLEHQVEKILEEDGPESPILEDLYERIDDMDPTTFESRASLILVGLGFNSKTIKKKTKDMSGGWKMRVALAKALFVKPTLLLLDDPTAHLDLEACVWLEEYLKKWPRTLILVSHSQDFLNGVCTNMLDMRMKKMLLYGGNYDSYVKTRNEQETNQMKQYHKQQEEIAHIKKFIASAGTYANLVRQAKSRQKILDKMEADGLIEKVVPDKVFEFRFPAVEKLPPPVLSFDNITFSYSGNPEENLYENLNFGVDMDSRIALVGPNGVGKSTLLKLMTGQLQPTGTEGRISRHTHLKIGVYSQHSQDQLDLTKSSLEFVRDKFSHISHDFQYWRQQLGRFGLTGEGQTALMATLSEGQRSRVVFALLAIEAPNMIFLDEPTNGLDIPTIDSLAQAINEFDGGVVVVSHDFRLLDKIAKDIFVCENKTATRWDGSILSYKAKLAKNVVV

SEQ ID NO: 68373 - protein, 198 aa, Triticum aestivum
IAPAWPPTVMALWATSVAPFRGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKASTAHSPRATYKVPLRFCQL

SEQ ID NO: 68374 - protein, 411 aa, Yarrowia lipolytica CLIB122
MNRFSKIRQYSTLLQTAEKYSVPTYAKPSVILTKGKGAYLWDSNDNKYIDFSAGIAVTALGHSNPEITKILAEQSSQLMHCSNLFNNEWAPRLQESLVEETLKSGGMKGARKVFLANSGTEANEAALKFARKVGTLSSPDKTEFVNFEKAFHGRTMGALSVTPNPKYQAPFAPLVPGVKTGVYNDPKAADLITEKTCGVIVEPVQGEGGVYKANDEFLQALRNKCDEVGAMLIFDEIQCGLGRTGRLWAHDKVHPDILTMAKALGNGFPIGATMVTEAVADKIAIGDHGTTYGGNPLASRVGHYVLSQVASKEVLDNVKKVSQQIRDAVAEVQEEFPELITEVRGDGLLLGIQFSKDPSKVVAAARENGLLVITAGTNTVRLVPALNIDQEAVTEGLEILKKAIRDNAKDL

SEQ ID NO: 68375 - protein, 326 aa, Moorella thermoacetica ATCC 39073
MQTDLRGKHLITLQEWTREEIDTLLDIAFDLKRRKALGEKHHLLEDKTFYMLFFDNSTRTRNAFETGMTQLGGHAIYLTPKTTQIGHGETPKDTVEVLGRFGNGIGVRNCTYKVGNAYMRELAKYSKIPVINMQCDLYHPTQALADIMTIQEKFGKNTRGLNFTISWTYAPKYIRPLSMPQSLILLMSRFGMNVTLAHPPEFHLLPEFIEQAKKNAAENGVKFNIVNDMDEACKDADIIYAKSWGPIAYTGSDTEGAELIDKYPNWVMDSRRMALGHKEAIYMHCMPADRGIEVTEEVMDGPQSVIYDEAENRLHTIKAILAATLK

SEQ ID NO: 68376 - protein, 598 aa, Prochlorococcus marinus str. MIT 9303
MTEGQTTSGQAADLKFAACLASGADLSKFEQFKADSCYLLDPLAAELENSSDHFSNDAVQLLKFHGSYQQDNRDNRQKGEGKDWQMMLRLRSPGGRIPPSLFLALDDLSNRLGNGSLRATTRQAFQIHGVRKEDLREVISTIIRSMGSTLAACGDITRNVMAPAAPYEKGGYPAARQLANEIADVLSPTAAEGSYLDLWVNGSATYRIRPSRRVKKVRTRQHQGNVFSGDTKEPLYGKTYLPRKFKCAVTVPGDNSVDLLTNDIGLVVFTAANGEIKGCNVYVGGGMGRTHNNEQTFARTADPLGYVAAEHVLDLVQSILALQRDYGDRKTRRHARMKYLLNDQGISWFKQELKSKYFLHPIKALRPEPKSKLEDYLGWHQQSVGQWFVGLPLLSGRLEGDLKKGLRQLVETFQLEIRLTPNQDLLLCNIGTSQRSSVRKGLAALGIRAPEAPAMLARHAIACPALPLCGLAVTEAERTLPVLLERIDAQLRRLEITKSILIRMTGCPNGCARPYMAELALVGSGVDQYQLWLGGTPNLQRLAKPYLQRMPLDQLESTLEPLLLSWKQAGGRRSLGDHVNKLGDQAVLGLLSGTGKAP

SEQ ID NO: 68377 - protein, 567 aa, Zea mays
  misc_feature (542)..(542): Xaa can be any naturally occurring amino acid
VFSISGKSGYTGNDVLQELEILTINAKAAQEVILSKILEKNQATEYLNKFMNGSVDISAFKSQVPVVTYDVVQPYIARIAAGERSSILCGEQIVELLRSQVSRYIRGLGEGKAMYLLFVKAETLTNAGIPVRSVLTSYYKSPQFLQRKHDLYNSYTSPDEVILCPDSQQSMYCQLLCGLVERQNVVRLGAVFASAFLRSISFLEKHWHDLVTDIRTGRINPSITNAACRVATESFLAQPNPELADEVEAICSSESWKGVLGRLWPNVKYIEAVLTGTMAQYVPMLEFYSDGRIPLVCTMYASSESYFGVNLRPLCSPKDVSYTILPNMAYFEFVPLDDGLRLAEDGEAVEKEKLVGLVDVKVGCYYELVVTTFAGLYRYRVGDVLQVTGFYNRAPQFKFICRRNVILSVDADKTNEEDLHGSVSRAKKILEDRGHILLEYTSFTDTSTVPGHYVLFWEVKATPTSGSGGARLDAQVLESCCVAVEESLDCVYRRCRAHDRSVGPLEIRLVEAGAFDALMDLLVSQGGSINQYKTPRCIRAGXAALELLDSKATASFFSPRDPEATGV

SEQ ID NO: 68378 - protein, 132 aa, Helicobacter pylori
SNIKYELDKESGALMVDRVLYGAQNYPANYGFVPNTLGSDGDPVDALVLSDVAFQAGSIVKARLVGVLNMEDESGMDEKLIALPIDKIDPTHSYVKDIDDLSKHTLDKIKHFFETYKDLEPNKWVKVKGFEN

SEQ ID NO: 68379 - protein, 414 aa, Moorella thermoacetica ATCC 39073
MSNITQLRCINCSRTYQPRPGFYTCPICGSTDGILDVEYDYDYINKSISRQSLASNREHSLWRYRPFLPVAQEGPLPPLRVGWSPLYRARRLGDELGLKELYIKDDGINPTGSLKDRPSAVAVARALAEGAKVVACSSTGNAASSLAGAAASVGLKAVIFVPGRAPQGKVAQLLIFGATVISVQGSYEDAFKLSAAAIAEHGWYNRNAAINPYLVEGKKTVCLEVAEQLNWEVPDWVVLSVGDGCTMAGAWKAWVDLKKAGWIDKLPRMLGVQAEGCCPITRAFREGTRVKPMPENTLADSIAVGVPRNPEKALRAVRDSGGTMINVSDEEILAAMRTLGRTSGIFGEPAGAAGTAGLIKAVQEGIIKSGDKVVVLVTGNGLKDVANAIKAAGEPIRVEPSLEALKEALARYGK

SEQ ID NO: 68380 - protein, 388 aa, Moritella sp. PE36
MNIIKMTDLDLAGQRVLIRADLNVPVKDGKVTSDARIRASLPTIKLALAAGAKVMVTSHLGRPTEGEFAQEFSLEPVVNYLKEALENNVVLARDYLDGIELNVGELVVLENVRFNKGEKKNEDALSKAYANLCDVFVMDAFGTAHRAQASTYGVGMFAPIACSGPLLSAELEALGKAMDKPARPFLAIVGGSKVSTKLTVLDSLSTIADQLVVGGGIANTFIAAQGHNVGKSLCEHDLIDTAKALMAKCDIPVATDVLVATEFSETAEATLKPASEVNDDEMIFDLGPDSANQLAEMIKAAKTIIWNGPVGVFEFANFAKGTEIIGRAIAESDAFSIAGGGDTLAAIDQFGLADGISYISTGGGAFLEFVEGKVLPAVAMLEERAKNA

SEQ ID NO: 68381 - protein, 340 aa, Moritella sp. PE36
MSVRVAINGYGRIGRSVVRALYESNRQDEIKIVVINELAEPEAIAHLTQYDSTHGRFPFPVQLGDNILQIKNDCIHLVRHPELADLPWREHDIDIVLDCTGIYGTRADAEAHIAAGAKKVIFSHPASADVDATVVYGINHTELTGDETYISGASCTTNCMIPVISILDAAFDIKCGTITTIHSAMNDQPVIDSYHTDLRRTRAASHSIIPVDTKLAAGIERILPKFANKFEAIAVRVPTLNVTAMDLSITVDKSVTIQDINDCLHAAAETELRGILGYTEAPLVSIDFNHDPRSSIIDGTQTRVSDGHLVKLLVWCDNEWGFANRLLDTTYYVATLAKMT

SEQ ID NO: 68382 - protein, 132 aa, Helicobacter pylori
SNIKYELDKKSGALMVDRVLYGAQNYPANYGFVPNTLGSDGDPVDALVLSDVAFQAGSVVKARLVGVLNMEDESGMDEKLIALPIDKIDPTHSYVKDIDDLSKHTLDKIKHFFETYKDLEPNKWVKVKGFEN

SEQ ID NO: 68383 - protein, 429 aa, Moritella sp. PE36
MKLYSIKDHAETVSFAQAVKQGLGKNQGLFFPSEINPIDDIDALLEMNLVDRSRVILQSLIGDEFSEQELHDIVATAFNFPAPVTKINDKISALELFHGPTLAFKDFGGRFMAQCLSRLSFDKKGNGDKITILTATSGDTGAAVAHAFYGMDNIDVVVMYPKGKISFLQEQMFCTLGGNIRTIAIDGDFDACQALMKRSFDDEELRKEIGLNSANSINISRLMAQICYYFEAFAQLPKAQRAQTVVSVPSGNFGNLTAGLLAKTLGLPVKRFIAATNINDTVPRYLASGEWDPKATQATLSNAMDVSVPSNWPRIEELARVKGWDLSELASDFLSDEDTKQAVAALDEQGYLCEPHGAIAYDRLTAQLSEDEFGLFLCTAHPAKFKESVEEILGRDIGLPQELADCADKPNLSIDMANDFAALRAFLMA

SEQ ID NO: 68384 - protein, 132 aa, Helicobacter pylori
SNIKYELDKESGALMVDRVLYGAQNYPANYGFVPNTLGSDGDPVDALVLSDVAFQAGSVVKVRLVGVLNMEDESGMDEKLIALPIDKVDPTHSYVKDIDDLSKHTLDKIKHFFETYKDLEPNKWVKVKGFEN

SEQ ID NO: 68385 - protein, 481 aa, Oryza sativa Indica Group
MDLSPSAAASPSLAKAVETYRKAVATAATVTAYAVLAHGMARELVPHDLRAALSWAASLVRARVEPRPAERRTAIIRSIEGNGHGHAQCIESRFFVDAHAYLATKIDPRSMSRFFLGGGRRGRNVLSMVPGDSMTDVFEGVEFKWTSVPAEGRFADTEVSLELSFDAAHTDMALGRYVPFIKEEVEQARRRDRELMIFMNEGSSWRGIAHHHPATFDTLAMDPELKRSIVADLDRFLKRKEYYRRIGKAWKRGYLLHGPPGTGKSSLVAAMANYLRFNLYDLDLSEVHSNSALQRLLIGMTNRCILIIEDIDCCFRARSRENGKERKTPTPTNNDGDDDDDDEEGDDFSEKRMTLSGLLNFIDGLWSTSGEERVIVFTTNYKDRLDAALLRPGRMDMHVYMGYCGWDAFKTLAHNYFLVDDHPLFPEIRALLAGVEATPAEVSEMLLRSEDADAALSGLVEFLEEKKEKKKKKQAMCEAGK

SEQ ID NO: 68386 - protein, 396 aa, Klebsiella pneumoniae subsp. pneumoniae MGH 78578
MFENITAAPADPILGLADLFRADDRPEKINLGIGVYKDETGKTPVLTSVKKAEQYLLENETTKNYLGIDGIPEFGRCTQELLFGKGNAIIADKRARTAQTPGGTGALRVAADFLAKNTDVKRVWVSNPSWPNHKSVFTSAGLEVREYAYYDAANHALDFDGLLASLNEAQAGDVVLFHGCCHNPTGIDPTLDQWQQLAQLSVEKGWLPLFDFAYQGFARGLEEDAEGLRAFAALHKELLVASSYSKNFGLYNERVGACTLVAADQETVDRAFSQMKSVIRANYSNPPAHGASVVATILSNDALRAIWEQELTDMRQRIQRMRLLFVNTLQEKGASRDFSFISQQNGMFSFSGLTKEQVLRLREEFAIYAVASGRINVAGMTPDNMAPLCEAIVAVL

SEQ ID NO: 68387 - protein, 280 aa, Bambusa multiplex
  misc_feature (97)..(97): Xaa can be any naturally occurring amino acid
IVESVGEGVTDLAPGDHVLPVFTGECKECPHCKSAESNMCDLLRINTDRGVMIGDGKSRFSINGKPIYHFVGTSTFSEYTVMHVGCVAKINPEAPLXKVCVLSCRISTGLGASINVAKPPKGSTVAIFGLGAVGLASAEGARIAGASRIIGIDLNPSRFEEAKKFGCTEFVNPKDHSKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSV

SEQ ID NO: 68388 - protein, 225 aa, Cryptococcus neoformans var. neoformans B-3501A
MAPESTPKKEKKDKKRKSEVADTSIAPEPVAPEEGTASAEAVAMEVDGDRALKKQKKEKKEKRKSLAAEGAEEVEDKKAEFAVPADAISPIASPLAGKKLSKKLHKTVKKASKARQLKRGVKEVVKALRKGEKGLLLLASNITPIDVISHLPLLAEEAAGVEYCWVLSKEELGVYAGTKRATSCVLISTTPNKKATVSEEDRADVKATLEECMEEVKKLETVIKY

SEQ ID NO: 68389 - protein, 291 aa, Arabidopsis thaliana
MATNAGYLRCKEERKNESFFKVVQSINVSSENKRALPHDFSRSFTDKELSRKMKIRAQWGNSWEVGISKNPRFYFMEKSGWEKFVRDNALGNSELLTFTHKGKMHFTVNIFKLDGKEMMQPPQSRSFFASSSRIKTEQEENDIKEEVVVSSNRGQTTAAESKGRKLNLGKRAAKESQSSKRTEKVVRARSDYAGASSSTAAAFTILFKQGYLVFLRIPNSVSKDQVPDEKTVFKIHHPNGKKSWNVVYLERFGAFSGGWRRVVKEYPLAVGDTCKFTFIKPKELLLVVSKP

SEQ ID NO: 68390 - protein, 437 aa, Clostridium acetobutylicum ATCC 824
MKIVVTKFGGSSLADSNQFKKVKGIIDSDANRKYIIPSAPGKRTNKDYKITDLLYLCNAHVKNGIPFDDVFKLISQRYTEIVSELNIDMDIAYYLEKVKKNIENGASSDYAASRGEYLNGVILAKYLNAEFIDAAEVIFFDKSGCFDEKKSYEKIKEKVLSCNKAVIPGFYGSSFNGDVKTFSRGGSDVTGSIISAGVNADLYENWTDVSGFLMADPRIVENPKTISKISYKELRELSYMGATVLHEEAIFPVKDSGIPINIKNTNKPSDPGTLILSDTHKEINLGTITGIAGKKNFTVIAIEKALLNSEVGFCRKILSILEMYGVSFEHMPSGVDSVSLVIEDCKLDGKCDKIIEEIKKQCNPDSIEIHPNMALVATVGTGMAKTKGIANKIFTALSKENVNIRMIDQGSSEINVIVGVETVDFEKAVKSIYNAFN

SEQ ID NO: 68391 - protein, 530 aa, Pseudomonas putida KT2440
MGNVKIAKESSMTSFSVPRTTVTPQQLLSEQVRRILAAPVYDLAIETPLQAAPALSAALGNQVLLKREDLQPTFSFKIRGAYTRLSRLTDVQRERGVITASAGNHAQGVALAASHLGMKATIVMPTTTPSLKVEGVRSRGGHVVLHGESFPHALTHALKLADSEGATFVPPFDDPDVIAGQGTVAMEILRQRPGALDAIFVPVGGGGLIAGIAAYVKYLRPDVKVIGVEPADSNCLQAAMAVGERVILPQVGTFADGVAVAQIGAHCFELCRHFVDEVVTVSSDELCAAIKDIYDDTRSITEPSGALAVAGIKKYVAREGVQGQTLVAIDSGANVNFDRLRHVAERAELGEQREAIIAVTIPEQPGSFRAFCHALGKRQITEFNYRFYPGKEARLFVGVQTHPVHDPREQLLASLREQGYSVLDLTDNELAKLHVRHTVGGHAASGADERVLRFEFPERPGALLGFLERLGKRWNISLFHYRNHGAAEARVFAALEVPADELAGLPSTLDEMGYRYWDETDNPAYKLFLG

SEQ ID NO: 68392 - protein, 353 aa, Vitis vinifera
MVGEEMSTESGFFLPVENVQALASNNSGEIPSRYLRPELQSEEVLADESIQIPTIDMRKLMVAEDEMGKLHYACKEWGFFQLINHGVAEEVIEKMKADLQEFFKLPLKEKNAYAKLPNGVEGYGQHFVVSQDQKLDWADILFLQCRPASERNMRFWPQEPTSFRATFDKYSSELQKVSICLLELMAKNLKVDPGQLMNMFQKGRQQIRMNYYPPCVHASKVIGLTPHSDICGLTLLAQVNEVQGLQIKKNGKWIPIRPVPGAFIVNIGDILEIMSNGEYKSIEHRAVVNPETERLSIAAFHSPSVETIIGPLPELVKENGAIYKSVSREEYYKFAFSRKLDGKSIISHMKLEN

SEQ ID NO: 68393 - protein, 325 aa, Synechococcus elongatus PCC 6301
MTIATTCQLGPNGPTVSALGIGTWAWGDSLYWTYGQDYDEAQLQTTFATAIAAGVSFFDTAEIYGLGESERILGRCLQQGDQPAQIATKYFPIPWRFGSKAVQKALDQSLERLQRQSIELYQVHWPPAFLLGQTKILKTLAAAYKRGQIQAIGVSNYNARQLRQAHALLAEQGVPLAVNQVQYSLLERRIETNGSLAAARELGVTILAYCPLAQGLLTGKYRPDADSRPTGARKINPQFRSQALEKLQPLLDQLAALGDRYDRTIPQVALNWLIAQGNVIPIPGAKSPAQAQDNAGALGWQLSPEDVASLAQLSSGGRSLAAAAH

SEQ ID NO: 68394 - protein, 418 aa, Escherichia coli
MTLLALGINHKTAPVSLRERVSFSPDKLDQALDSLLAQPMVQGGVVLSTCNRTELYLSVEEQDNLQEALIRWLCDYHNLNEEDLRKSLYWHQDNDAVSHLMRVASGLDSLVLGEPQILGQVKKAFADSQKGHMKASELERMFQKSFSVAKPFALKQISVPALCLSLLPACTVARQIFESLSTVTVLLVGAGETIELVARHLREHKVQKMIIANRTRERAQILADEVGAEVIALSDIDERMREADIIISSTASPLPIIGKGMVERALKSRRNQPMLLVDIAVPRDVEPEVGKLANAYLYSVDDLQSIISHNLAQRKAAAVEAETIVAQETSEFNAWLRAQSASETIREYRSQAEQVRDELTAKALRALEQGGDAQAIMQDLAWKLTNRLIHAPTKSLQQAARDGDNERLNILRDSLGLE

SEQ ID NO: 68395 - protein, 344 aa, Vitis vinifera
MVGSLPVANVQALASSYSGDVPLRYLRPELLSEEVLVDESLQIPTVDMRKLLVDDDEMSKLHLACKEWGFFQLINHGAAEEVIEKMKADVQEFFKLPLKEKNAYAKLPNGVEGYGQNFVVSEDQKLDWADMHFLQSLPASERNMRFWPEEPTSFRGTLEKYSLELVKVSNCLLKLMAKNLLINPEQLTNMFDVGRQAVRMNYYPPCVHASKVIGLTPHSDFGGLTLLVQVNEVQGLQIKRNGKWIPIRPVPGAFIVNIGDAIEIMSNGEYKSIEHRAVVDPEKERLSIATFCSPNAGAIIGPLPELTKEKGAIYKSVSREEYIKFVLGRKLDGKSTINHMKLEN

SEQ ID NO: 68396 - protein, 354 aa, Synechococcus elongatus PCC 6301
MSIKSLISFGLLVFVPISIAAEWLHWGEGAIFVTSALAIVPLAIWLSTATEEIAVVVGPSIGALLNAVFGNATELIIAVVALRAGLVDIVKASITGTIISNLLLAMGLSMLVGGIGRQEQTFKPVVARVNGSAMTLAVLAILLPTLAIATGGETPPSELGFSQFVAWILLAVYGLTLLFSLKTHRSLYDVGVTEHEHSGDRPNLLLWVGVLAAATLAVAYESEIFVGVVESVTEKVGLSPLFTGVILLPLLGGAAEYVTAVSVARKDNMDLSVSVALGSTLLVALFVAPLLVLIGPLFGHPLDLSFNLFELVAVVVAVAVSNLISIDGRSDWLEGCLLLAAYLILGAAFYFQSA

SEQ ID NO: 68397 - protein, 499 aa, Burkholderia xenovorans LB400
MDASTILADLGIAHAAQAGDIAVHSPITGELIGRVASNTVAEVDTALAQAKQAYTAWRNVPAPRRGELVRLLGNRLREKKQALGSIITLETGKILQEGMGEVQEMIDICDFAVGLSRQLYGLTIASERPGHRMAETWHPVGTCVVISAFNFPAAVWSWNAALALVCGNAVIWKPSEKTPLTALAVNQILSEALQEFGDAPAGLTALINGGRDVGAKLVADPRASIVSATGSTEMGRTVGVEVAKRFGRSLLELGGNNAGIVTQTADHELAMRGILFSAVGTAGQRCTSLRRLFVHESVYDKTIERLKQLYSKVPIGNPLEKGTLMGPLIDKQSYGRMQEALQQATAEGGKVFGGERVEVKGYEGGYYVRPAIVEMPSQTSVVLKETFAPILYVLRYTDFADAVEANNAAVHGLSSCVFTTDLREAERFLSDSGSDCGIANVNIGPSGAEIGGAFGGEKETGGGRESGSDAWKAYMRRATNTVNYSSALPLAQGIDFNIG

SEQ ID NO: 68398 - protein, 154 aa, Glycine max
  misc_feature (69)..(69): Xaa can be any naturally occurring amino acid
LAARIIRIRGPPATALVFASRNMVGSGAWRVPQSAGAACMFPWCFLKLGSPAVSRAFLPQDAAGSCVAXFPLRLEGPAWSHGACSGFHPLRFPGPRARWVQPKPALLVFLAGAGALAGPRGSGDSYSAVEGFYPVRSEFRTALRGAPRPCVLEL

SEQ ID NO: 68399 - protein, 513 aa, Myxococcus xanthus DK 1622
MPRAMSQDSRLLEKIAQVEKGGAQKYHAKNAEAGKLFARERIRLLVDEGSFVEDAKLANNLDPDLPSDGVVIGVGKVAGRTVAIMANDSTVKAGSWGARTVEKILRIQETARDLRCPLFYLVDSAGARITDQVEMFPGRRGAGRIFYNEVHMSGFVPQVCLLFGPSAAGGAYIPAFCDLVIMVEGNASMYLGSPRMAEMVIGEKVTLEEMGGAKMHCSISGVGDVLVKTEQEAIEAAKKYIGYFPENFSQAPPRAEPKAPKAGGKKVEEIVPVDQNKPFNMHELINELIDEGSWFEVKKLFAQELVTGLARIDGRPVGIVANQPKYKGGVLFVDSADKAARFIWLCDAFNIPLLYLADVPGFMIGTKVERAGIIRAGAKMISAVSEASVPRICVVVRKAYGAGLYAMSGPGFAPDATIALPGAMIAVMGPEAAVNAVYYNKIQELPEAERPAYVQKLRDEYKQDVDIYKLASELVIDDIVPGDRLRQELTQRYSVYSQRHQPRAEKKHGVYPV

SEQ ID NO: 68400 - protein, 216 aa, Haemophilus somnus 2336
MSKIQLVAEAKLPTEFGIFRIVGFEFPDTQKEHVALVMGDINDDKPVLARIHSECLTGDALHSLKCDCGFQLATALRQISEAGRGVLIYHREEGRGIGLINKIRAYALQDQGLDTIEANLALGFAADERNFSVCADIFALLGVKQVRLLTNNPNKIETMKKSGINIVERVPLNVGENRYNTEYLDTKAKKMGHFIVHNNEQHLIACPHCQEEIPKK

SEQ ID NO: 68401 - protein, 633 aa, Synechococcus elongatus PCC 6301
MLFFSGQRTMSPTAAPQKLSKVEDLKARSQYLLEPILSQLQEESTHFNEDGIQILKFHGSYQQDNRDNRVKGQEKDFQFMLRLRSPGGYIPPQLYLTLDQLADDYGNGTLRATTRQAFQLHGILKRDLKTVIRRIVENLGSTISACGDVNRNVMAPPAPFRDRPEYEWARTYANNIADLLTPESGAYYELWLDGEKVLSGEPDPAVLAARRNPKGRVADSVEPLYSDRYLPRKFKIAVTVPGDNSIDLFTQDIGLVVIGNDRGELEGFNVYVGGGMGRTHNKEETFARLADPLGFVPAADIYAAVQAIVATQRDYGDRSNRRHARMKYLIHDWGIAKFKEAVESVFGKAIAPVRELPPFRYRDYLGWHEQGDGKWFLGLPITSGRIKDDGNWQLRSALREIVSRWQLPLLLTGSQDVLIYDVQPGDRAAIDKLLRDRGVHTVEAIDSLQRYAMACPALPTCGLAITESERALPGLLVRIRRLLEEQGLPDEHFVVRMTGCPNGCARPYMAELAFVGSAPNTYQLWLGGSPDQTRLARPFIDRLADGDVETQLRPLFVFFKQSRQAGESFGDFCDRVGFDALRQFSESYQHEAAKPRYRVGLRADVHGRLKAEADKRGVSLTDLACEAIAAYLR

SEQ ID NO: 68402 - protein, 441 aa, Vibrio vulnificus CMCP6
MMIALAERLKSYRVQGLGSRPVASGKLVRVVGLTLEATGCRAPIGSLCLVETMTGQMEAEVVGFSGDNLFLMPSEQIGGILPGAKVTPLTSESGLPVGMELLGRVIDGVGNPLDGLGPIYTEHRASFNAEPINPLARKPITEPLDVGLKAINGLLTVGKGQRIGLFAGSGVGKSVTLGMMTRGTTAQVVVVGLIGERGREVKEFIEEILGEDGRKRSVVVAAPADASPLMRLKGCQTALTIAEYFRDQGLDVLLLMDSLTRFAQAQREIALSVGEPPATKGYPPSVFAKLPALVERAGNGGPQQGSITAFFTVLTEGDDLQDPIADASRAILDGHIVLSREMADAGHYPAIDVEKSVSRVMPQITTEEHVLMSKAVRQVLSICRKNQDLVSIGAYKPGTDPAIDSAFTLKPKLDEYLQQRMKETVPYAMCVNMLKNVLGVQ

SEQ ID NO: 68403 - protein, 251 aa, Pseudomonas aeruginosa PAO1
MRRPLVAGNWKMHGTHSSVAELIKGLRQLALPSGVDVAVMPPCLFISQVIQGLAGKAIDVGAQNSAVEPMQGALTGETAPSQLADVGCSMVLVGHSERRLILGESDEVVSRKFAAAQSCGLVPVLCVGETRAEREAGKTLEVVARQLGSVIDELGVGAFARAVVAYEPVWAIGTGLTASPAQAQEVHAAIRAQLAAENAEVAKGVRLLYGGSVKAASAAELFGMPDIDGGLVGGASLNADEFGAICRAAGS

SEQ ID NO: 68404 - protein, 706 aa, Yarrowia lipolytica CLIB122
MHGQPHQHLHTSPTAPFNMTIPYQPSTYYGCSNVTESYKPLGKIGEGTFGEVFRAEQITTKRHVALKKILLHSEKEGFPVTALREIRILKLLRHENVIPLVDLAVERGDQSKKERGCVYMVTPYMDHDLAGLLGNQSVQLSPAHIKCYMLQLLEGIGYLHAKKFLHRDIKAANILVNDQGILKLADFGLARGYDGPAPNSQTAGVNTENLTAMVVTRWYRPPELILGDRKYTTAIDMWGIGCVFGEFFTRKPIFPGASDVDQGSKIFQAVGVPTEDTMPGWSVLPGAQNSNIWGTDATNKLDKLFGRLSKDGLDFLKGLLLLDPTKRLTAIGGKNHAYFKTEPLPCQPHELPKWQSSHELDNHKRREQEKNESKVQPPPREKQPPVREPRDRDRSRDSRPPRERDSRDRRPPRGRYDSFERPERRPEGPRDGPRDRDRDEYPRELPPRDLPPRDLPPRDRDYPPRERDWDRRPPPRDRDYPPRERDYPPRDSRDRDYHPRDRDYPPRDSRDYPRDSRDSRDSRPISPSRERFHKRPQFDMYSDTDYDRERDEDDRRRRPLPRDSSRDMTRDVYVPSRGREPRELPKGPPPAPGDKVEDKGESHNKDDKPCDTENPRDSDKSRDLGPPPGPPLPADGPPPPPSSNPPRPSETYGGSRPPWRRDSRDRRESRDRDGRDRDGRDRRLSSSRYARDEFDEYGRKRPRIER

SEQ ID NO: 68405 - protein, 819 aa, Moritella sp. PE36
MRVLKFGGTSLANAERFACAADISVSKIEQSQVALVLSAPAKVTNNLVAAVQQTVRGLDAESSLEEIDGIFKALVAGLKAQYVNFNAELALTQLEKSLATLREYLYGVKLLSQCPENIEAKILCIGEKLSIVCMEQLLLARGFKVEVIVPQDKLVGKGGVLEATVDIDASRARFEQDPIKADHIYLMPGFTAGDEQGNTVVLGRNGSDYSAAVLAACLYAECCEIWTDVDGVYACDPRLVKDAKLLKTLSYPEAMELSYFGAKVLHPKTIAPIAQHHIPCLIKNTQNPEGEGTLIGGLVSKTQAEVKSLSELSGMTMINVSGPGMKGMVGMAGRIFETVSRAGVSIALITQSSSEYSVSFCIHSYDAGKAKLALNNEFTLEISNQLLEPIEMRDGLAIVSLVGDGMRKANGIAARFFTALAQASVNLVAIAQGSSERSISAVIDESKANDAIKASHNIFFGKQQYIDLFLLGCGGVGAALVEQIKRQKEFLAERHIEIRVCGIANSRQMLLDSEGLSLTHWADDLAASDIEFSLATLEDLVKHSHIINPVIVDCTSNDNLASQYVDFLGRGFHVVAANKKANTMSMDYYHELRSTALKTRRRFLYDTNVGAGLPVIENLQNLLSAGDELVRFNGILSGSMSYIFGKLDEGMSFSQATAQARDNGFTEPDPREDLSGMDIARKLLIIAREAGMDLTLDQVEVEAAIPAGFDATGTNDEFMANLPKADAYFADLQATAAAEGNVLRYIGQIEDGKCTVSIAAVPESDPLNKVKDGENALAFYSRYYQPIPMVLRGYGAGSEVTAAGVFADVLRTLNWKQEV

SEQ ID NO: 68406 - protein, 88 aa, Arabidopsis thaliana
YFFFKSINLLILLLLLCTFLCQTESALPSHQELVITGRRMMSYYKPNTDIGTPSSTSDRGGGGNGRRLMSQMDVGASSSGQGGGRNRH

SEQ ID NO: 68407 - protein, 264 aa, Prochlorococcus marinus str. MIT 9303
MPQGFSALKRCSLYQCRQQRECPYSRFLESPTPQLTSMSTKSLVIAPSILSADFSRLGEDVQAVDQAGADWIHVDVMDGRFVPNITIGPLIVEALRPVTSKPLDVHLMIVEPERYVGDFAKAGADHIYVQVEACPHLHRNLAQIKDLGKKAGAVLNPSTPLDTLEYCLELCDLVLIMSVNPGFGGQSFIDNQVQKIRDLRRICDEQGLDPWIEVDGGIKADNAWKVIEAGANAIVSGSGVFNQPDYAEAIRGIRNSKRPEGVLV

SEQ ID NO: 68408 - protein, 654 aa, Methylococcus capsulatus str. Bath
MTAASFAQILLLLGTTALVVAVFQWLRVPSSLAYLVVGVLLGPHTGGPVIENPEIHGAAEFGIVFLMFTIGLNLSLPQVHALRHLVLGLGTGQVVLTTLVVGAAAFAFGLSPEAAFVVGAVFAQSSTAIIGKQLAEQGEEYSRHGRLAVAMSVFQDVTAVPLIVVVPVLAVPSLRVLGESLAWALAKAVLAFVLVFFAGRWLLRPLFHAVASRRSAELFTLTVLLVSLGAGGLTYQLGLSVAFGAFLVGMMLGETEFRHQVESTIRPFRDVLLGLFFVSIGMLFDPSLMEGTWQWALGGAFVLLAAKTVLVAVLVRATGIDLATAWRVGLLVAVGGEFGFALLAIALDAGVISQLTGQIVLMAVLLSMITAPFLIRYNRVLVEGWFRPPPGEEGALSAGPGVAGSPHDHVIICGYGRIGQNIGRFLEEERIPYVALDLDPQRVKEARIACEPVYYGDSSERDMLEAVGIGKARLVVVSHEDLAAAHKVLHHAAALRPGLPVMVRTRDESHVEELRRAGAAEVVPETLEAGLMIASQALLLLNVPLSRVARRIREQRLNRYLLLREFFRGDETFSDDVQSQDGDRLRAVPLPPGCRVAGCTLAELALENVVVTALVRHGVRELAPAPETRLAEGDAVVLFGAVSDLDKAERRLLG

SEQ ID NO: 68409 - protein, 229 aa, Blastopirellula marina DSM 3645
MSSQSPIKLKPESALQIANPQDLLTIRYPATQSFVGKFDGVESSHGNFELGGTKPKIVFRGRKYKLVKIHIHELSEHVVGGDSPSQFEVHFVHIPVHGEGSDPKVVLGVLYRESEEAERLCGDEAIIASLGDEEGCGTEKGDGKPTHSVTPARFFPRVCGSSEPDFDSWYYYEGSLTSYPYSEDVSWFVMKDEAVVHPDETRAFKRCSQQHARGLQPLERRLVLRSFGE

SEQ ID NO: 68410 - protein, 436 aa, Prochlorococcus marinus str. MIT 9303
MHIAVVGLSHRTAPVEIREKLSIPEQTMETSLQTLRGNDQVLEVSILSTCNRLEIYTLVRHPERGISAISDFLGQHSGLAAEDLSPHLFNFHHDEAVAHLMRVAAGLDSLVLGEGQILSQVKKMVRLGQEHKSMGPILNRLLTQAVSTGKRVRSETNLGTGAVSISSAAVELAQLKLGQAQGEDQLMTLESELVAVVGAGRMSRLLLQHLQAKGCSGVMLLNRTRQRAEDLSADFPELPVECRPLDDLNHCLSTCSLVFTSTAADDPIVDASLLKQLKRRSFLRLIDIGVPRNIASDVVDLPGVESHDVDDLHEVVSRNQEARQQMAKEAEVVLQEETRLFLEWWDSLEAVPTINRLRATLEAIRAEELQKALSRMGPDFSARERKVVEALSKGIINKILHTPVTQLRAPQARQERQQALRVVACLFELDPPLEDG

SEQ ID NO: 68411 - protein, 161 aa, Oryza sativa
  misc_feature (21)..(21): Xaa can be any naturally occurring amino acid
MEYGNLRRQAASLKKSLFDQXGYLDEQFCQVEDLQDEANPNFAEEVVSLFFKDSTRVMLNFEQAIEKHPKDFARWDTHMQQLKGSCSSIGASRVKNECTSFRNFCGEENAEGSLLLWLCSCTRSFQKVKREHAVLRQKWESYFQLLRQAGPAGTATRPAGK

SEQ ID NO: 68412 - protein, 242 aa, Synechocystis
MTSAQKPVFSPSDLQTWLEIATEAVLAAGAEIFSSGVKVQQIQEKGRAGDLVTEADRQAEAIILEIIKRRCPDHAILAEESGQLGQVDNPFCWAIDPLDGTTNFAHSYPVSCVSIGLLIQDIPTVGVVYNPFRQELFRAATSLGATLNRRPIQVSTTASLDKSLLVTGFAYDRVKTLDNNYPEFCYLTHLTQGVRRSGSAAIDLHRCGLRSKDGYWERGINPWDMAGLALSLCGSRGNSFRL

SEQ ID NO: 68413 - protein, 431 aa, Prochlorococcus marinus str. MIT 9303
MKRVLAIILGGGAGTRLYPLTKMRAKPAVPLAGKYRLIDIPISNCINSNINKMYVLTQFNSASLNRHLGQSYNLSAAFGQGFVEVLAAQQTPESPSWFEGTADAVRKYQWLFQEWDVDEYLILSGDQLYRMDYSLFVEHHRRSGADLTVAALPVDAEQAEGFGLMRTDSDGNIQEFREKPKGESLKAMAVDTSRFGLSAESAKNKPYLASMGIYVFSRATLFDLLHKNPSHKDFGKEVIPEALARGDRLQSYVFDEYWEDIGTIGAFYEANLALTQQPNPPFSFYDEKFPIYTRPRYLPPTKLVDAQITESIIGEGSILKSCSIHHCVLGVRSRVESDVVLQDSLVMGSDFYESSEERTLLRQGGGIPLGVGEGTTVKGAILDKNTRIGNNVTIVNKDHVEEADRADEGFYIRNGIVVVVKNATISDGTVI

SEQ ID NO: 68414 - protein, 85 aa, Brassica napus
  misc_feature (62)..(62): Xaa can be any naturally occurring amino acid
  misc_feature (67)..(67): Xaa can be any naturally occurring amino acid
  misc_feature (73)..(77): Xaa can be any naturally occurring amino acid
  misc_feature (79)..(81): Xaa can be any naturally occurring amino acid
  misc_feature (84)..(84): Xaa can be any naturally occurring amino acid
MSSSETSHLATAKTALTAVASVAAAAMLARTVIQDYMPAEVHDFISCGIRKCFSYYGFQMTXVIEEXGGFENXXXXXAXXXYLXS

SEQ ID NO: 68415 - protein, 472 aa, Prochlorococcus marinus str. MIT 9303
MSKAHFGLIGLGVMGENLVLNAERNGFSSVVYNRTYAKTEEFLKGRGADKAIQGAKDLQDFVDKLERPRRILMMIKAGSAIDAVIEQISPYLQEGDLLIDGGNSEFRDTERRVAELESKSFGYIGMGVSGGAKGALEGPSMMPGGTKTSYEAIESLVCKMAAQVEDGPCVTYIGPGGSGHFVKTVHNGIEYGIEQILAEAYDLMKRVGGMTGTQMADVFAHWNATEELTSYLVEITEVCLRTKDPDDGSDLVEKILDKAGQKGTGLWTVVSALELGASVPTIYASLNGRVMSSMKPQRIAAEQILHGSAIRPFDLGSSADGMAPLMDAVVLSCMASYAQGMELLRIASAEYNYNLHLPSIAQIWKGGCIIRSRLLQRIQDAFNADPQLSNLLIDPWFAEQVNRRLPGLAKVVAGAAEAGIPVPCFSSTLDYINSYRTARLPQNLVQAMRDCFGSHTYQRVDKEGTFHTEWLD

SEQ ID NO: 68416 - protein, 438 aa, Edwardsiella tarda
MRLPDAQKILDRLDCPTLPSVTDVRLEGRLLTVGATLLRAHLPGVGLGEQCTLPDGSPAEVVAIEGDQALLSPYHAPLGLANGMLVTPSGAQARIGVGEALLGRVIDALGQPMDGCAPPQAAQWRSLESPAPDPMQRAPIDTLLPMGVRAIDAALSVGVGQRLGIFSPAGCGKSTLLGMLAAHSQVDVVVLALIGERGREVREFIEQIMSPELRARSVVILATSDRPALERIKAADTATVIAEYFRDRGHHVLLLVDSLTRYARAIREIALAAGEPMVSGGYPPSLYARLPRLLERAGPAACGSITAFYTVLVEQKSDPLAEEVRSLLDGHIVLSRRLAEASHYPAIDILASISRVMSQVVTPQHRQAANRLRHLLATWQEIALLVRVGEYRAGQDADADDAMARREAIASLLCQQTDERCPLSATLSALYSAVGQPC

SEQ ID NO: 68417 - protein, 438 aa, Xanthomonas axonopodis pv. citri str. 306
MSTPQPAPDATGLVRVVSRWQIVGLSINDVIGSGIYLLPAATAALLGPMSLWAVMLAGLAVALLVLCYAQAGSYFDTPGGSYLYTREAFGPFVGFQIGWMIWLTRISSAAALSNGLADAVARFWPTAATDTWARLLVVVGSLGLPTAINVIGVKSAARTGIALVIGKLVPLLLFVAIGLFYVDWSWAFAGTAPDLRDLGNLGEAALLLLFAYAGFENIPAAAGEYRNPRRDVPFALITMIVTVTLIYAAVQVVAQGTLPNLAASPTPLADAASRFGGEALALILTVGATISILGTTSNTVMLGPRFLFALARDGYGPAFLARVHPRFHTPAAAVLTQGALSLALALSGSFTQLALLSMVTRLFAYIGTAAAVIVLARRYRQRTDTLRLPGGPAIPIAALVLSLGLLASASWQNLAAAGVALLVGWVFYLFPRKRVEGG

SEQ ID NO: 68418 - protein, 413 aa, Coprinopsis cinerea okayama7#130
MSFPTSTANSAKYHAVPVIDHALVAPDDDDRARSDIEAPPVYKHPGNVEEQDLFLNRAGNRRRSGSHPSVSQFVFRLTAVAAGIFVMVTAMRMVLERFPSIECGRAWRGEGSTWSSKLPTHFTLPSGDKIPSVALGVWRAEKGKVGDAVKAALKTGYRHIDGAWIYGNEVEVGQAIRESGVPRKDIWLTSKLWNTFHRPEDIEPALDESLSRLGIDYLDLYLIHWPVAFEKDSEEIKIDWELTNDPYPTWKKLEELVEKGKIRNIGISNFNIKRIQNLTANSLKIQPAVNQVELSYWNPQPALLKWAKENGLLLEAYSPLGSAEKVKQSLEIPEVKEIAKKLGITPAQVYISWHVQRGTVVLPKSVHPHRVEENFHITRLPQAEFDLLEAASRAHKPERSVDPSERWGVDIFG

SEQ ID NO: 68419 - protein, 587 aa, Arabidopsis thaliana
MLRILGRRVVSASKELTSIQQWRIRPGTDSRPDPFRTFRGLQKGFCVGILPDGVDRNSEAFSSNSIAMEGILSELRSHIKKVLAGGGEEAVKRNRSRNKLLPRERIDRLLDPGSSFLELSQLAGHELYEEPLPSGGIITGIGTIHGRICMFMANDPTVKGGTYYPITIKKHLRAQEIAARCRLPCIYLVDSGGAYLPKQAEVFPDKENFGRVFYNESVMSSDGIPQIAIVLGSCTAGGAYIPAMADESVMVKGNGTIFLAGPPLVKAATGEEVSAEDLGGATVHCTVSGVSDYFAQDELHGLAIGRNIVKNLHMAAKQGMEGTFGSKNLVYKEPLYDINELRSIAPVDHKQQFDVRSIIARIVDGSEFDEFKKQYGTTLVTGFARIYGQTVGIIGNNGILFNESALKGAHFIELCSQRKIPLVFLQNITGFMVGSRAEANGIAKAGAKMVMAVSCAKVPKITIITGASFGAGNYAMCGRAYSPDFMFIWPNARIGIMGGAQAAGVLTQIERATKKRQGIKWTEEEEEAFKKKTVDAYEREANPYYSTARLWDDGVIDPCDTRKVLGLCLSAALNRPLEDTRFGVFRM

SEQ ID NO: 68420 - protein, 352 aa, Vitis vinifera
MVGGEISRELGGSVLVANVQALASSYSGDVPLRYLRPELHAEEVLVDESLPIPTIDMRKLLVDDDEMGKLHLACKEWGFFQLINHEVAEVIEKMKADVQEFFKLPQKKKNEYAKLPSGVDGYGQNFVVSEDQKLDWADMLFLQCLPASERNMRFWPDEPTSFRETLVKYSSELVKVSNCLLKLMAKNLEINPEQFTNMFEDGRQSVRMNYYPPCVHASKVIGFTPHSDPGGLTLLVQLNEVQGLQIKKNGKWIPISPVPGAFIVNIGDVIEIMSNGEYKSIEHRAVVDPEKERLSIAIFCSPGAGAIIGPLPELTKEKGAIYKSVSREEYIKFVLSRKPVRKSAINLMKLEN

SEQ ID NO: 68421 - protein, 672 aa, Cryptococcus neoformans var. neoformans B-3501A
MTTPAPSGPSRLPPHLADHLPPPSTSGDSESSAQQPAAGNGLETGLLKELARTSLIESLNNVQGAKTLILDPVLAGPLGLVTEVALLKHQAVDKMFWLERGPLNVNTRNVVWLCRPKMEFMNIIAEQIRSQQQNPSAAGPLTYTILLVPRVTELCKKVLEDQGVAGDVTLSEFNLGFIPMEDDLLSLEMEDVARDIYLNGDDTPIHSSSLALMTFQRAFGVFPRILGKGDGAKKLTDLLQRHRSSDPSQYSEIDSAEKVDGLIIIDRSVDWVTPMCTQLTYEGMLDEFMGIKNSHIEVDPSLLDPNPTGTNSPPSTALPSATVTKKRKHHLTSQKDALFQDIRDRNFAVVGSRLSKLAKRLQDDRGVVKNLRSVTQMKEFVGKIGGMKGDQQALKLHTELTETLMRITQTEEFNKNLEAQQNLVAGYDTSTQLSNIEDLMYQQIPWQTVLRSVILMSLTTGGIKPKNLEVFKRDFLQVYGYHHLPLLINLQSLNLLVRSPSLTSQNFPALRKSLRLLVDDINDAVPNDISYVYSGYAPLSIRLVQCVTQKNVILSGPTEEGPGRQVLPKAHRISGWKGFEDVLAGIPGSTVDVKQKVERVRSDMAGHNGEQFTTTVVFFLGGCTYTEISALRWMSNQTTGRRFLVATTGIINGNSLIEGFGDKMPVPLRAQD

SEQ ID NO: 68422 - protein, 353 aa, Vitis vinifera
MVGEEMSRELGGSVLVENVQALASSYSGDVPLRYLLPELHAEEVLVDESLPIPTIDMRKLLVDDDEMGKLHLACKEWGFFQLINHGVAEEVIKKMKADVQEFFKLPLKEKNAYAKLGNGLEGYGQNFVVSEDQKLDWADMLFLQCLPASERNMRFWPEEPTSFRETLEKYSSELVKVSNCLLKLMAKNLLINPEQLTNMFDDGRQAVRMNYYPPCVHASKVIGFTPHSDPGGLTLFVQVNEVQGLQIKRNGKWIPIRPVPGAFIVNIGDVIEIMSNGEYKSIEHRAVVDPEKERLSIATFCSPGAGAIIGPLPELTKEKGAIYKSVSREEYIKFVLSRKLDGKSTINLMKLEN

SEQ ID NO: 68423 - protein, 340 aa, Phaeosphaeria nodorum
MAPSLEEPTQIDFNAPLKAAPKLVAPEPEHCPGPESQQAGTADNCAGCPNQAICASAPKGPDPDIPLITARLSSVKHKILVLSGKGGVGKSTFSTMLSHGFSANPDSTVGLMDTDICGPSIPKMMGVEEETIHTTADGWEPVWVSENLGVMSVQFMLPNRDDAVIWRGPKKNGLIKKFLMDVKWGELDFLIVDTPPGTSDEHLSVNSFLKASGVDGAVLVTTPQEVALLDVRKEIDFCRKASIPILGIVENMSGFVCPGCKHESQIFRASTGGARKLAKEENIPFLGAVPLDPRIGMACDYGESFLTAYPDSPACAAIRDVVRRVGVEMGLEADEVLPEE

SEQ ID NO: 68424 - protein, 338 aa, Vitis vinifera
MSIRKEFGGSLPVANVQALASNNSSDIPIQYLMLELQSEEVLVDESLHIPTIDMRKLMVDDDEMEKLHFACKDWGFFQLINHGVEEEVIVKMMMDVQDFFKLSLEEKNAYAQLPNDIEGYGQAFVVSRDQKLDWGDMLFLLPLPASQRNMRLWPKKPTSFRETLEKYSSELHRVSINLLRSMAKNLGINPDKLATMFEDATQGVRMNYYPPCVNADKVMGLTPHSDATGLTLLKNGKWVPIRPVPDAFIVNIGDIIEIMSNGEYKSIEHRAVVNPEKERLSIAAFHSPNYRTMIGPLPDLLKENSANYKTISFEDFVRIVVTRKLDGKNLLGHMKFAD

SEQ ID NO: 68425 - protein, 349 aa, Vitis vinifera
MSTRKDFGGSLPVANVQALASDNSGDIPIRDLRAELQSEEVLVDESPHIPIIDMRKLMVDDDEMEKLHFACKDWGFFQLINHGVEEVIEKMKMDVQEFFKLPLEEKNAYAQPPNNIEGYGQAFVVSQDQKLDWGDMLFLFPLPASLRNMRLWPENPTSFRETLDNYSSELHRVSINLLRSMAKNLGVNPDKLASMFEDGTQGVRMNYYPPCVHADKVMGLTPHSDATGLTLLVQVNEVQGLQIKKNGKWVPIKPVPDGLVVNIGDIIEIMSNGEYKSIEHRAVVNPEKERLSIAAFHSPDHRTMIGPLPDLIKENSANYKTTSHDDFLRIVVTRKLDGKSLLGQMKFAD

SEQ ID NO: 68426 - protein, 345 aa, Streptococcus agalactiae 2603V/R
MKVATFIEPGKMVITDTPKPVIEQETDAVIKIVRACVCGSDLWWYRGISKRESGSFAGHEAIGIVEEVGTKVTDVSKGDFVIVPFTHGCGQCPSCKAGFDGNCTNHQAAKNVGYQGQYLRYTNANWALVKIPGQPSDYDNETLNSLLTLSDVMATGYHAAATAEVKEGDTVVVMGDGAVGLCGVIAAKMLGANRIIAMSRHKDRQELALTFGATDIVEERGDEAVKRVLDLTNQAGADAVLECVGTEQSVDTATQIARPGAVIGRVGIPQNPDMNTNNLFWKNIGLRGGIASVTTFDKSVLLDAVLTHKINPGLVFTKSFVLDDIQKAYEAMDKRDAIKSLVIVD

SEQ ID NO: 68427 - protein, 284 aa, Streptococcus agalactiae 2603V/R
MTDTMILNDNHKIPTLGLGTWMIDNDRVAQVVKDAIELGYRHIDTAQAYNNEKGVGVGIKESGITRESLFVTTKIAAEHKDYESATKSIDQSLEALGLDYIDLMIIHSPQPWKEWRETDKHFDQGNLEAWRALEDAQKSGKMKSIGVSNFLEKDLENILKNGHVKPAVNQILAHIGNTPFDLIDYCQSKGIQVEAYSPIAHGQALKSDGIQKMAEKYGVSVAQLCIQYLLQLNLIVLPKASSKEHLQSNLDFDFVISDEDMSILKSLMFDDYGEFSNFPVFSGK

SEQ ID NO: 68428 - protein, 384 aa, Vitis vinifera
MASPSPALSNTSNDTTTTATTTNAATAALANIAAAAAAAATPSSITSQPKNLRGLNKPKCIQCGNVARSRCPYQSCKSCCAKAQNPCHIHVLKANATFPDRTPSSSSPLFDQQSTEVSPSGTSLRVASLRQLSNNFAQFNNVQMPLRSRKPLTRKDAATINEWRFSKLKEYKNRNIEVENEAFDRYMQNISLLEEVFSVKSTPDGTTDHGISVSDAASPNLEDNSSVMVSWLKLRLKSNPTRSDNSRKRILEIVDRGLKKLNYVNDLNDQNELPAGSKRPKTGRADRLSALSELIDKLNKARNEEDLNSCMEMKSQIFNTNTETSQAEIEEVDTYTEQTAKDDLAPMHESNYTLPKFLGTTEIDQESLNNIDVHFSSTVQIEDL

SEQ ID NO: 68429 - protein, 529 aa, Myxococcus xanthus DK 1622
MTERELWERYQRYLCVVPALDFTLDVSRMRFPADYLERMRPRLEEAFGAMEALEKGAVANPDEKRKVGHYWLRAPELAPEPALQKEITDTVAAIHAFAKNVHEGRVKPQKAQRFTHMLIVGIGGSALGPQLVADALGTAKDPMQVSFFDNTDPDGFDRVLAQLGERLSETLTLVISKSGGTKETRNGMLEAERGYSARGLDFSKHAVAVTGAGSELDNHAKKQGWLRAFPMWDWVGGRTSVTSAVGLLPARLQGLDIDALLKGARDMDAATRERDALKNPAALLALMWHYAGDGRGHKDMVILPYKDRLLLMSRYLQQLVMESLGKETDLDGQVVNQGIAVYGNKGSTDQHAYVQQLREGVLNFFATFIEVLKDRDGGSQEVEPGVTSGDYLLGFLLGTRRALYEKDRESLTLTVPDVSARTLGALIALYERAVGFYATLVHINAYHQPGVEAGKKAAGVVLELQRKLTTRLREARAEARTAEQLAADIGMPDEVETVFKVLQHLAANPDRGVTRTPGATPTQARFQAK

SEQ ID NO: 68430 - protein, 187 aa, Triticum aestivum
MEDLSVEELASNLSTYKDQLREVRKFIKEKKDDAGISEYVDMEKELQEEPCPASYHEKAAWNSGFVITLTEELLATANPSESAQNDVGLSPPNYSAGVHSEALDGLSQSHEKFAVGTKVQAVYSEDGEWYNATIEGLTPIGYFVSYEGWGNKEEVDPANVRALDVEAADALGQAEKEAEATKMALKR

SEQ ID NO: 68431 - protein, 483 aa, Oryza sativa
  misc_feature (58)..(58): Xaa can be any naturally occurring amino acid
  misc_feature (61)..(61): Xaa can be any naturally occurring amino acid
  misc_feature (236)..(236): Xaa can be any naturally occurring amino acid
  misc_feature (280)..(280): Xaa can be any naturally occurring amino acid
  misc_feature (312)..(312): Xaa can be any naturally occurring amino acid
  misc_feature (346)..(346): Xaa can be any naturally occurring amino acid
  misc_feature (370)..(370): Xaa can be any naturally occurring amino acid
  misc_feature (426)..(426): Xaa can be any naturally occurring amino acid
MDISKFRFVKQLFINGKFVNSVKNQTFNVINPNDETILTSLQRASTEDVDIAVSAARXGLXNGPWSRMDPTDRARCLFRLADLVEKHASELAAIEAINNGKPVEVAKAADLTLTHRCYRYYGGWVDKIKGSTIAMDGPFNLSTRKEPVGVVGQIIPWNFPLLMQAWKLAPALAAGCTIVMKTAEQTPLSALRVAELIHEAGFPAGVVNIVSGFGDIGAYLARHPGVDKVAFTGSTXVGYDIMRNAHEKNLKRITLELGGKSPNIITKNANLDLAVNNQHXASSFNAGQCCVAGSRTFVHSSLYDQYVQRITXVAKKIKIGHSLNSDTDQGPLVSEDQMNRVLSYIXKGKAEGAKLLTGGKRWGNKGWYVXPTIFSDVKDDHTISKEEIFGPVKSVFKFEDNDEVIKRANDSQYGLGGGVVTENHSXAQYFIKKLKVGTVYVNSYNVFAAMTPFGGFKDSGIGRENGEEGLNNYLELKTVIERH

SEQ ID NO: 68432 - protein, 257 aa, Picea sitchensis
MALRGVEFHVEEAPEAIEKASDGSLTLKTTKGVNDGFSHVMFATGRVPNTKNLGLEEIGVKLNNNGAIEVDEYSRASVESIWAVGDVTNRVNLTPVAIMEGGAFAKTVFANQPTKSDYRNIPSAVFTQPPIGTVGLSEQQAIDQYKDIDVYTTSFRPMKATLSGLPDRILMKIIVCATTNKVIGVHMCGDDTPEILQGVAIAVKAGLTKADFDATVGIHPTAAEELVTMRTPTRRIRHSDAHAEIEGMSTASTPGSS

SEQ ID NO: 68433 - protein, 639 aa, Candida glabrata CBS 138
MQDNIYLNSDMVQKLNHTIQEYVRDILRNQSIINEDVVADPRIVMGTSMVATIFTLYVGYKLLLCSSGYKYKARKFNVSTPEEVQPNWKGKRLNPPKLVDDSKPRHIQSYCPATGQYLGEFKSMTADEIDELVGNANAAQMKWAESSIAKRLEVLATLQKFILENQDLIAKVACRDSGKTMLDASMGEILVTLEKIQWILKHGPSTLEPSRRPGPTNFFMKFYKGAEVRYEPLGVISSIVSWNYPFHNLMGPIIASIFTGNAIIVKCSEQVVWSSEFFIEMVRKCLDVCDVDSNIVQLCYCLPPTKDDDAANHFTSHPGIKHITFIGSQSVASHILNCASKSLTPVVVELGGKDAFIVLDSVKDLDALSSIILRGTFQSSGQNCIGIERVIVSEKNYDQLVNILEKRMKETPLRQGSDIDHLEVVDMGAMISDNRFKTLEALIQDAVSKGARLLYGGSQYNHPKYPQGHYFQPTLLVDVTPDMDIAQNEVFGPVLVMMKAKDTSNCIELANAAPFGLGGSVFGSDYSECNFVANKLKTGNVAINDFATFYVCQLPFGGINGSGYGKFGGEEGLLGLCNAKSVCFDTLPFISTQIPKPLDYPIQSNDKAWRFVKSFITGSYAMTTWQRIKALVSLAKNAN

SEQ ID NO: 68434 - protein, 322 aa, Prochlorococcus marinus subsp. pastoris str. CCMP1986
MEIAGDITSLVGKTPLVKLDRIKKYCNCHPEIIAKLESFNPSASVKDRIAYSMLNSAEKDGLILPGKTTLIEATSGNTGIALAMVAAAKGYRLILTMPDTMSIERRAMLRAYGAELQLTPGKEGMNGALDLASELSSSIPNSFQFNQFENLANPEIHERTTAKEIWDQSNQTIDGLVSGVGTGGTITGCSRFLKKVNPNCKIYAVEPAKSAVISGEKAGSHSIQGIGAGFVPKVLDTHLIDEIFKIDDEEAFYYGRLLARLEGLLSGISSGAALAATIKIGQRKELINQRLIVILPSFGERYLSTAMFESNTAIKARKDGYL

SEQ ID NO: 68435 - protein, 114 aa, Candida glabrata CBS 138
MSQKNGIATLLKAEKEAHEIVTEARKYRQEKIKQAKLDASKEIENYKAKKEQELKDFESNNAGGVQELEKKADAEVQSELDEIKKTVESKKKQVVDLLLEAVTKPTTEVHINAN

SEQ ID NO: 68436 - protein, 378 aa, Pseudomonas aeruginosa PAO1
MTKPAILALADGSIFRGEAIGADGQTVGEVVFNTAMTGYQEILTDPSYAQQIVTLTYPHIGNTGTTPEDAEANRVWAAGLIIRDLPLIASNWRSKQSLPDYLKANGTVAIAGIDTRRLTRILREKGSQNGCILAGADATEERALELARAFPGLKGMDLAKEVTTAERYEWRSSVWNLESDSHPEIPAGELPYHVVAYDYGVKLNILRMLVARGCRLTVVPAQTPASEVLALNPDGIFLSNGPGDPEPCDYAIQAIREFLDTEIPVFGICLGHQLLALASGAKTLKMGHGHHGANHPVQDLDSGVVMITSQNHGFAVDESTLPDNLRATHKSLFDGTLQGIERTDKVAFSFQGHPEASPGPHDVAPLFDRFISAMAERR

SEQ ID NO: 68437 - protein, 223 aa, Physcomitrella patens subsp. patens
MADSWTKEFQEAVRLTEDIEGRIAEKNALPPHSSESIRIVSVTRRKLAMLNNKLDRLESLLQNGSLKSSLSEKELYRRQNMLVDIRYKSKQMSASLSSAQDNSLMEGGIAPVETGRTQGLDNSGLVKLQRQIMKEQDQDLESLEKTVMSTKHIALAVNEELNLHTRLLDDMDQSADVTNNKLLAAQRRLGFLNKNLGQGWSLMTMIFLMVVVVVLVLFLFKLL

SEQ ID NO: 68438 - protein, 279 aa, Glycine max
FFFFIQARSLSLRSIQTLFLFFTIPILWRRFALEVLGKNGCLVEGVLHLPGNPPVKLDSQDLLQIGDKEFYFLLPVRSILVGPVGPRHYPNHAAPGPVVPHYNNYHLGPGPVKKAPRREYYEEEFDDEDDVGGRKMRRDGYDGYGYAGGKSSLSAPMDKKSEGRSRVDRDADNLQLQQLEEKDVVSSVATVLSDLCGPGEWMPMEKLHTELLEQYSSVWHHNRVRRYLTSEDWPGPESKGKPWYGLLMLLRKYPEHFVINTRSKGRVTLEFVSLVSLIS

SEQ ID NO: 68439 - protein, 377 aa, Pseudomonas aeruginosa PAO1
MAKRDFYEVLGVERGASEADLKKAYRRLAMKYHPDRNPGDKEAEDKFKEANEAYEVLSDASKRAAYDQYGHAGVDPNMGGGAGAGFGGASFSDIFGDVFSDFFGGGGARGGSRGGAQRGADLRYTLDLDLEEAVRGTTVTIRVPTLVGCKTCNGSGAKPGTTPVTCTTCGGIGQVRMQQGFFSVQQTCPRCHGTGKMISDPCGSCHGQGRVEEQKTLSVKVPAGVDTGDRIRLTGEGEAGSMGGPAGDLYVVVNVREHPIFQRDGKHLYCEVPISFADAALGGELEVPTLDGRVKLKIPESTQTGKLFRLRGKGVAPVRGGGAGDLMCKVVVETPVNLDKRQRELLEEFRKSLQSDTSHSPKASGWFEGMKRFFDDL

SEQ ID NO: 68440 - protein, 314 aa, Phytophthora nicotianae
MSQCASFSTGGKGPFARSRKKQQESAVESVEYAELDLNRLAVIGGGNMAEAIITGVLTEGLIPSSKVVVSDPNPSMRGKYAKLNVETHTRNSSAVKDADVILVAVKPQVVDDVLRAVKASMDPDALVISVVAGQSIKQLQQHLGQDSHIIRTMPNTPAMIGEGTTVWAQSAEVTSVQHELTKQILGSFGVEVFVDDENALDMATALSGSGPAYFFLVAEAMIDTGVHMGFSRPVATKLVQQTMLGSALYMQSEDVHPVELRNNITSPGGTTAAGLYRAEKNGFRAVIADSIWAAYERCLELGSSEPVQRQRPRS

SEQ ID NO: 68441 - protein, 170 aa, Methylococcus capsulatus str. Bath
MFEHVREDWKNYDGDLTRQGLWVMLVYRFGRWRYRIGPRWLRLPLSFLYKALKLASQILTGIDLPCEAQVGRHFTIEHFGDIIISGDAVIGDDVTVRNGVTIGLKRTNEPGSPVIGNRVDIGAGAKVLGPIRIGDDVVIGANAVVITDVPSNSLAVGVPARIKPRTGAGR

SEQ ID NO: 68442 - protein, 255 aa, Zea mays
  misc_feature (214)..(214): Xaa can be any naturally occurring amino acid
  misc_feature (237)..(237): Xaa can be any naturally occurring amino acid
  misc_feature (243)..(243): Xaa can be any naturally occurring amino acid
  misc_feature (247)..(247): Xaa can be any naturally occurring amino acid
MAGARSQVNKPHKTRFASKASRHSHKIDKVRSGKPAGSHRAAVKGARAARLQHSKAIRDQKRAALLKEKRSSNGSSSAPRVIVLCGLSSSANVGPLAEDLLTFAAGGDEKLTSNTVASPAYKLRTTVLQAPYGDLTSCMELAKVADLLAFVVSANSLYNSDSGNPIDEFGSQCLSVLRAVGLPSTAVFIRDLPSDTKSKQELKKAAVSFLSPEXPEDCRFYAAETKDDLHMFMRLFXEQHLSXTHWXNQRPYVMS

SEQ ID NO: 68443 - protein, 491 aa, Methylococcus capsulatus str. Bath
MSHELRLDQPGLLRTRCLIDGQWVDADHSKTFSVTDPATGRALADVPAMGAAETMRAIAAAEHAWTGWRGKTAKERAAVLRRWYELILSHTEDLARILTAEQGKPLTEARNEIGYAAGFVEWFAEEAGRAYGETIPSPVPDKRLLVIRQPIGVCAAITPWNFPAAMITRKIAPALAAGCTVVVKPAEQTPLTALALADLAVQAGFPPGVINVVTGDPEAIGGELTSNPLIRKLSFTGSTEVGRLLMAQCAATVKKISLELGGNAPFIVFEDADLDAAVEGALLSKYRNTGQTCVCTNRFLIQDSIYDAFAERLAAKVRRLEVGNGLDEGVVQGPLIDEQALAKVERHIADALDRGARVLAGGGRHPLGGRFFQPTVLVDVTPEMLCTREETFGPVAPLLRFGSEEEALAIANATEYGLAAYFYTRDLARAFRVGEALEYGMVGINTGMLSYDVAPFGGVKQSGIGREGSHHGMDEYLELKYLCLGGMAPSA

SEQ ID NO: 68444 - protein, 490 aa, Ipomoea tiliacea
MRINPTTSGSEVSTVEKKNLGRIVKIIGPVLDVAFPPGKMPNIYNALVVQGRGNEQTNVTCEVQQLLGNNRVRAVAMSDTDGLMRGMEVIDTGAPISVPVGGSTLGRIFNVLGQPVDNLGPVETNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 68445 - protein, 1331 aa, Saccharomyces cerevisiae
MMMDILNTQQQKAAEGGRVLAPHTISSKLVKRLSSHSSHKLSRSDLKALGGSETISDGPSQLTFKDRYVFNESLYLKKLKKTALDDYYTRGIKLTNRYEEDDGDDEIIRLSNGDRIDEDLHSGVKFFSTTPYCRKMRSDSDELAWNEIATERFKWQSMLARVLKGDIVKGEKTRIANQVKKPGLNKELSDEIWLELKAWLNGRTMQEMEQSLTYLRDSSDSVFEEIMKFQIPQGKILSLDALEAILQDLMNRYHSVVSYWPNLKKMYKDKPITNTAEFTARIDVMNSWLNFKTNLTLRRQELDDWINRFSPISSSDNCQEDFDGVPQWNCKMKILAEQLMKEKNIESIFQKKIFYPLSPWMFKLKLHFIVYRETLTKMNIKYPYERLRSLLAFPVYLIKEVILTRLSYARKLKNPTMMMIDQMIDDFNAFIRLSVQLKYTLTKYCSNLPFDVDFDPTFENTVIEAIRYLFFLLNLKLIDSSKQNFKAPDLLLKYWDHLKNTGHYINGAETVIPNEFLKLTLRLVHKLQFYLLKQQNFPPTFANASEAEKWLSSIFENLGAMKRKLNRFSNILVKAFQNSAVYQINHNAQLVKKLKDAHYFLVYSGNTFESSGVYMFAAPELLGCDNDTILRILRNKSIGCDLVPKLDIGNNLNVYDITTKETDLNILVSKGEDSKGIPYYRVVANSSSDLDRHAHQSKKKNFSTDPFDQHLDEKNNEVFELEVALSSLGALVVLYPGEPVVWDGPVYKLPGNNLFASNEMDLGKIGNPNTLILLNQGSNYALTYQIDKFNQTVGDSVSFIEKRCSLNSIESSLQKINKAYYKLTYTVLNNYKGILGSFMKQCPGNELLNSIFMFGRDFGRSFLKYNAFSSKRKYVIIFLMVKLGMNWLKFLVEECDPTDQRTFRWCVLAMDFAMQMTSGYNILALNVKQFQELKERVSVCMSLLISHFDVMGARATEAENGMQQARLNIDTEENIDEEATLEINSRLRLEAIKTLEKTMKRNPRQMGKVLDATDQGNKYLLSLASSLSNVSMRWQKRSFIGGGTFGQVYSAINLENGEILAVKEIKIHDTTTMKKIFPLIKEEMTVLEMLNHPNIVQYYGVEVHRDKVNIFMEYCEGGSLASLLDHGRIEDEMVTQVYTFELLEGLAYLHQSGVVHRDIKPENILLDFNGIIKYVDFGTARTVVGSRTRTVRNAAVQDFGVETKSLNEMMGTPMYMAPETISGSAVKGKLGADDVWALGCVVLEMATGRRPWSNLDNEWAIMYHVAAGRIPQLPNRDEMTAAGRAFLERCLVQDPTMRATAVELLIDPWMIQIREIAFGNSEKDQVPILSS

SEQ ID NO: 68446 - protein, 487 aa, Ipomoea batatas
NPTTSGSEVSTVEKKNLGRIVKIIGPVLDVAFPPGKMPNIYNALVVQGRGNEQTNVTCEVQQLLGNNRVRAVAMSDTDGLMRGMEVIDTGAPISVPVGGSTLGRIFNVLGQPVDNLGPVETNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 68447 - protein, 355 aa, Klebsiella pneumoniae subsp. pneumoniae MGH 78578
MRGIGLTHAFADISGLAFDRLFMVTETDGTFITARQFPQMVKFIPAPLHDGLHLSAPDGSSAVVRFSDFATQAEPTEVWGNHFTALIAPAAVNQWLSGFFKRDVQLRWLGPQLTRRVKRHDAVPLSFADGYPYLLANEASLRDLQQRCPASVSIEQFRPNLVVTGAAAWDEDSWKVIRIGEVVFDVAKPCSRCIFTTISPERGQKHPAGEPLETLKRFRTALDNGDVDFGQNLIARNSGVIRVGDEVEILTRGPAKAYGAGESDDTPAPEAQQQATVAIEWQGQQFTGNNQQVLLEQLEQQGIRVPYSCRAGICGSCRIRLEEGEVSPLKKNAVAGDGTILACSCVPKTALRLAP

SEQ ID NO: 68448 - protein, 589 aa, Thermotoga maritima
MAPGRSGYRLRFRSGARISGDSEQTQGFVQEPGSCAEDPGGIVLKRVIVIDNYDSFVYNIVQYIGEVEPDCEIEVFRNDEITIEEIERKNPTHIVISPGPGRPEEAGISVDVVRHFSGKVPILGVCLGHQVIGYAFGGKIVHAKRILHGKTSKIVHNGKGVFSGVKNPLVATRYHSLVVEEASLPEVLEITAKSDDGEIMGLQHKEHPTFGVQFHPESVLTEEGKRIIKNFLNIQDIQVKKVSEETEIDIVSALKKLVEFEDLTFEESRQVMNFIMSGNATDAQIAGFLVALRMKEETGDELGGMASVMREKSIHIKAPSPRTVDTCGTGGDGFGTFNISTTTAFVVAAAGIPVAKHGNRSVSSKVGSADVLEAGGYKLEKTPGEMERELKETGFSFLFAPLLHPAMKHVMPARRQLKIRTAFNLLGPITNPARVKYQVVGVFDLSFASKLATALQRLGTERSAVVNGGFTDELTTCGKNNLLLVTQEEIVPMVLDPEELGLKSGDPEELKGPSDPKEAYRMMESVLKGEASRTQVETVALNAGVVFWLVGECDTIKDGVGKALDLIRTGEAYKKLREVMDYQKTLGNS

SEQ ID NO: 68449 - protein, 264 aa, Arabidopsis thaliana
MESERLESHLLNKQEEEASSFTSGLLLSTSVVVAGSFCYGCAMSYSSPAQSKIMEELGLSVADYSFFTSVMTLGGMITAVFSGKISALVGRRQTMWISDVCCIFGWLAVAFAHDIIMLNTGRLFLGFGVGLISYVVPVYIAEITPKTFRGGFSYSNQLLQCLGISLMFFTGNFFHWRTLALLSAIPSAFQVICLFFIPESPRWLAMYGQDQELEVSLKKLRGENSDILKEAAEIRETVEISRKESQSGIRDLFHIGNAHSLIFR

SEQ ID NO: 68450 - protein, 497 aa, Pseudomonas putida KT2440
MLSELPILPATRAFLERKLKMRIGADWQDAASGRTLSFRNPATGEVLGEVPAAEAEDVDRAVRAARQAFDDSPWSRMRPRERQNLLWRLADLMERDARQLAELECLNNGKSAAVAQMMDVQLAIDFLRYMAGWATKIEGSTVEASMPLMPNDQFHGFVRREAVGVVGAIVAWNFPLLLACWKLGPALATGCTVVLKPADETPLSVLKLAELVDEAGYPAGVFNVVTGTGLNAGAALSRHPGVDKLTFTGSTEVGKLIGKAAMDNMTRVTLELGGKSPTIVMPDANLQEAAAGAATAIFFNQGQVCCAGSRLYVHRKHFDNVVADIAGIANAMKLGNGLDPAVQMGPLISAKQQDRVTGYIELGRELGATIACGGEGFGPGYFVKPTVIVDVDQRHRLVQEEIFGPVLVAMPFDDIDEVIGMANDNPYGLGASIWSNDLAAVHRMIPRIKSGSVWVNCHSALDPALPFGGYKMSGVGREMGSAAIEHYTELKSVLIKL

SEQ ID NO: 68451 - protein, 559 aa, Coprinopsis cinerea okayama7#130
MSTSHSGSDSDCYSSGYSDSDDDVVERKKAIPRVLANYYLEQVLGSGYSGSIYRAKHLHTGKVVALKVQDVDHECPTNRYERYLYPYLQGGKGMPTLWAAGMQGGWDYLAIDLLGPSLDNLFRQTGKDTMDLGSVCSIAMQLIARLQFMHTRGVLHRDIQLGNCVIGLPPNDKTIYMIDFGFSKQYIDPHTKRHITDSRSKRSFIGNYWFSSVNVHCRGRVPSRRDDLEAAALMLIHLLTPRGLTWTRNGIPKTDEAHDALMDEKRAARPEDLCRGLPVEFEDFLRYTRKLKFEQCPDYETWIENFRQLKVESGYSPSEDLVWPPQPPQMRKPVTIHTPLRIRVPGAVHRDEMEGILNGLTNLNLQAARPVLGDRTNVVPRTLLLSKEKPVATVNVSSGSEENKSALPQRRYAKPKAMILLDLAKKASTATDNASLARLVKEFVKALQMNSSRTLTKEGSQFLDVLYKQLDDPSVFIPPKRPSRGRSTIEQQQQEPARAKFGVIARLRYEVKSAPSNKALGSLVSDFAKVTNKCVGRTITKDGFVFLEGVAERLAALGR

SEQ ID NO: 68452 - protein, 173 aa, Alexandrium fundyense
MASNNRVLPVLLAMAAGTMLLRSVLMPSYGNDAAFTTPNLAAHSVHRNCRPVQSSGSLLAQGGLPAVVKGVPARQGVAAHFKVTLETPDGTQEFECPEDVYLLDQAEEEGLELPYSCRAGSCSSCAGKVLSGSIDQSDQAFLDDDQMGDGYCLTCVTYATSDVTIKTHCEDEL

SEQ ID NO: 68453 - protein, 205 aa, Triticum aestivum
TSRNPSAPLTQLFKELKVVFPNSQRMNRGVQVISEIVESCRSHEITDLILVHEHRGQPDGLIVCHLPLGPTAYFGLLNVVTRHDIKDRKAMGKMSEAYPHLILDNFTTKTGERTANIMKHLFPVPKPESKRLITFANRDDYISFRHHIYEKHGGPKSIDLKEVGPRFELRLYQIKRGTMDQSEAQNEFVLRPYMNTAKKQKSLGV

SEQ ID NO: 68454 - protein, 607 aa, Coprinopsis cinerea okayama7#130
MPGTGSNIESLQAEISRLRMEMQALHTKQGADTVRIGDYLLTRLAQLGVRHMFGVPGDFNLGFLDLVEDHRLMEWVGNCNELNAAYAADGYARAKSTIGVVLTTFGVGELSATNGIAGAFSEMVPVLHIVGVPSTTQQKKRPLLHHTLGDGRFDAFSKAAGQFTCYQTMINDPNTAASEIDRALSECITKNRPVYLMLPTDMVSFEITSNRLHTPLTRRETLNESQVEEFVLDLIELRVKEAEADVAVLVDACVMRYGIRKEVMEFLKETGFPVFAAPMGKTAVDENWKRYGGIYVGSVTPPEVKEQVEKAKLILSIGSLQTDFNSGNFTYNIPTRRLIELHSSYTQVQYAVFPNIGFKELLPKLKDRLQQFYPIANKIPVTPFANRLPQEATQSITQAYFWPRMGHFFKSGDIIVTETGTANFGIMDVPLPPKSHLLSQIFWGSIGWSVGAALGAAVAAREMKSAGRVILFVGDGSLQLTVQELSPMIRLGLKPIIFVLNNHGYVIERMIHGKHRKYNDIADWKWSQLLDVLGDRQTETASHTLTNKQDLDRLLNEDSFMNPDKITLIEVLMDRLDAPRILKLQTELSSKQNIYAPAKLGTVNSPV

SEQ ID NO: 68455 - protein, 375 aa, Aquifex aeolicus
TYLMNNYARLPVKFVRGKGVYLYDEEGKEYLDFVSGIGVNSLGHAYPKLTEALKEQVEKLLHVSNLYENPWQEELAHKLVKHFWTEGKVFFANSGTESVEAAIKLARKYWRDKGKNKWKFISFENSFHGRTYGSLSATGQPKFHKGFEPLVPGFSYAKLNDIDSVYKLLDEETAGIIIEVIQGEGGVNEASEDFLSKLQEICKEKDVLLIIDEVQTGIGRTGEFYAYQHFNLKPDVIALAKGLGGGVPIGAILAREEVAQSFTPGSHGSTFGGNPLACRAGTVVVDEVEKLLPHVREVGNYFKEKLKELGKGKVKGRGLMLGLELERECKDYVLKALEKGLLINCTAGKVLRFLPPLIIQKEHIDRAISVLREIL

SEQ ID NO: 68456 - protein, 333 aa, Methanosarcina thermophila
  misc_feature (159)..(159): Xaa can be any naturally occurring amino acid
MVTFLEKISERAKKLNKTIALPETEDIRTLQAAAKILERGIADIVLVGNEADIKALAGDLDLSKAKIVDPKTYEKKDEYINAFYELRKHKGITLENAAEIMSDYVYFAVMMAKLGEVDGVVSGAAHSSSDTLRPAVQIVKTAKGAALASAFFIISVPDXEYGSDGTFLFADSGMVEMPSVEDVANIAVISAKTFELLVQDVPKVAMLSYSTKGSAKSKLTEATIASTKLAQELAPDIAIDGELQVDAAIVPKVAASKAPGSPVAGKANVFIFPDLNCGNIAYKIAQRLAKAEAYGPITQGLAKPINDLSRGCSDEDIVGAVAITCVQAAAQDK

SEQ ID NO: 68457 - protein, 428 aa, Geobacter sulfurreducens PCA
MTADRTISVIGLGYVGLPVAVAFGRVRRTVGFDINAGRIAELKQGIDRTGEVTAEALAAANILFTDRIEELRLADFHIVAVPTPIDEANQPDLTLMLKASETVGKALKQGDIVVYESTVYPGVTEDECVPILERVSGLRCGTDFTVGYSPERINPGDREHTFTKITKVVSGQDAATLDVVARVYESVVTAGVHRASSIKVAEAAKVIENTQRDLNIALMNELALIFDRLGIDTSEVLEAAGTKWNFLRFKPGLVGGHCIGVDPYYLTHKAEKIGYIPQVILAGRRINDGMGKFVAQKTVKEMILAGHPVLGARVTVLGLTFKEDCPDLRNSRVIDIIRELEEYGVKVQVYDPLADPNEALHEYGVTLVPADGLEPAAAVVAAVAHRQFRSLAGDDLLRLMGHPPVLMDVKGMYDQNMLRQAGIRFWRL

SEQ ID NO: 68458 - protein, 509 aa, Zea mays
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTFKLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLASSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTGQSVVALHRIGISSVIKLLTVK

SEQ ID NO: 68459 - protein, 489 aa, Citrus unshiu
MWGRQREASMMYKRTSSRDRSSTFDVEETTALVQNGTEVENTNPSWKLSFPHVLVATLSSFLFGYHLGVVNEPLESISLDLGFNGNTLAEGLVVSMCLGGAFIGSTLSGWIADGVGRRRAFQLCALPMIIGASISATTRNLIGMLLGRFVVGTGMGLGPTVAALYVTEVSPPFVRGTYGAFIQIATCLGLMGSLLIGIPVKEIAGWWRICFWVSIVPAAILCLAMVFCAESPHWLYKKGRTAEAEAEFEKLLGGSHVKSSLAELSKLDRGDDGDIVKFEELLYGRHFRVVFIGSTLFALQQLSGINAIFYFSSSVFKSAGLSSGLANVFVGIANLLGSVVAMVLMDKLGRKALLQWSFFSMAVSMAIQVAASSSYIPGSASLYLSVGGMLMFVLTFALGAGPVPSLLLPEIFPSRIRAKAMAVCMSVHWVINFFVGLLFLRLLEQLGPQLLYSIFGTFCLMAVAFVKRNVVETKGKSLQEIEIALLPQE

SEQ ID NO: 68460 - protein, 335 aa, Borrelia bissettii
MKLAINGFGRIGRNVFKIAFERGIDIVAINDLTDPKTLAHLLKYDSTFGVYNKKVEARDGAIVVDGREIKIIAERDPKNLPWAKLGIDVVIEATGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSALKKASETPELKGILGYTEDPIVSSDIKGNSHSSIVDGLETMVLENGFAKVLSWYDNEFGYSTRVVDLAQKLLK

SEQ ID NO: 68461 - protein, 98 aa, Nostoc sp.
ATVYKVTLVDQEGTETTIDVPDDEYILDIAEDQGLDLPYSCRAGACSTCAGKIVSGTVDQSDQSFLDDDQIEKGYVLTCVAYPTSDLKIETHKEEDLY

SEQ ID NO: 68462 - protein, 98 aa, Nostoc sp.
ATYKVRLFNAAEGLDETIEVPDDEYILDAAEEAGLDLPFSCRSGSCSSCNGILKKGTVDQSDQNFLDDDQIAAGNVLTCVAYPTSNCEIETHREDAIA

SEQ ID NO: 68463 - protein, 96 aa, Synechocystis sp.
ASYTVKLITPDGENSIECSDDTYILDAAEEAGLDLPYSCRAGACSTCAGKITAGSVDQSDQSFLDDDQIEAGYVLTCVAYPTSDCTIETHKEEDLY

SEQ ID NO: 68464 - protein, 464 aa, Oryza sativa
MRPAFSWRKLWRFTGPGFLMCIAFLDPGNLEGDLQAGAAAGYQLLWLLLWATVMGALVQLLSARLGVATGKHLAELCREEYPPWATAALWAMTELALVGADIQEVIGSAIAIKILSAGTVPLWGGVVITAFDCFIFLFLENYGVRKLEAFFGVLIAVMAVSFAIMFGETKPSGKDLLIGLVVPKLSSRTIKQAVGIVGCIIMPHNVFLHSALVESRKIDTNKKSRVQEAVFYYNIESILALVVSFFINICVTTVFAKGFYGSEQADGIGLENAGQYLQQKYGTAFFPILYIWAIGLLASGQSSTITGTYAGQFVMGGFLNLRLKKWLRAMITRSFAIIPTMIVALFFDTEDPTMDILNEALNVLQSIQIPFALIPLITLVSKEQVMGSFVVGPITKVISWIVTVFLMLINGYLILSFYATEVRGALVRSSLCVVLAVYLAFIVYLIMQNTSLYSRLRSAMTKST

SEQ ID NO: 68465 - protein, 429 aa, Oryza sativa Japonica Group
MEMAEKLIKQGKAYVDDTPKEQMRSERMDGVESKCRNNTVEENLSLWKEMINGSERGMQCCVRGKLDMQDPNKSLRDPVYYRCNTDPHHRIGSKYKVYPTYDFACPFVDALEGVTHALRSSEYHDRNAQYYRILQDMGMRRVEIYEFSRLNMVYTLLSKRKLLWFVQNKKVEDWTDPRFPTVQGIVRRGLKVEALIQFILQQGASKNLNLMEWDKLWTINKKIIDPVCARHTAVLKDQRVIFRLTNGPEKSFVQILPRHKKFDGAGKKATTFTNRIWLDYADASAISKGEEVTLMDWGNAIIKEIKMENGVITELIGELHLEGSVKTTKLKVTWLPDIDDLVPLSLVEFDYLISKKKLEEDENFLDNLNPCTRKETLALGDANMRNLLRGEVIQLERKGYYRCDAPFVRSSKPVVLFAIPDGRQQASLN

SEQ ID NO: 68466 - protein, 176 aa, Triticum aestivum
  misc_feature (79)..(79): Xaa can be any naturally occurring amino acid
  misc_feature (139)..(139): Xaa can be any naturally occurring amino acid
MAPTVMFSSATAGAPFQGLKSTAGLPVSRRSNGASLGSVSNGGRIRCMQVWPIEGIKKFETLSYLPPLSTEALLKQVDXLGRFKWVPCLEFSKVGCIFREHKASPAHYDGRYWTMRKLPMFGCTDPTQVINEVEEVKKXEYPDAYVRIIGFDNMRQVQCVRCIAFKPPACEESGKA

SEQ ID NO: 68467 - protein, 360 aa, Zea mays
MAQVKGKNILTGPPMYPPPRSSPFGELHGCEGDGCASDQDTWPLHHVLRSGVHCRLCCSCILLSHRSLYCCRCFLLVTSPSCNYDNGDTLMAPPAPTVTCQVCHDAVAHLPCLYPPPTDGVFVCPPCTAAQNGRPFTYAPPCRQPLDERNARVLVLGARIALALLQRHATAAREAAERLAMEARDARARAHDALIVAFDLDAEEDLSCVVPQPTENDLAASEEEEEEEEEDSEAETDEGEVMLVRRNVMPPLVTPTIDTGGSVVPLASAEAKHMPPLSQPKLLFDLNENAAENEIDDAQAEPMRHQALNSFNVKEVAMAAGAEATRASPSTPQTLQLFPITYQDIVPRTLQLFNDDDEEM

SEQ ID NO: 68468 - protein, 387 aa, Ustilago maydis 521
MPGKVAPNNSLATEPAERNVSFVLQEIEKVSFEERPIVAPKPGQVQVNIRQTGLCASDCHYLHHGRIGDFVVRKPMVLGHESSGIVTAVGEGVTTHKVGDRVALEPGVPCRSCQVCLNGMYNQCAHLEFAATPPYDGTLCTYYNIQSSFAHHVPDHMSLEEASLMEPLSVAVYSAGMRGQVKAMENVLVFGAGPIGLLNAAVCKAYSAKRVVVVDVVESKLEFAKEWCATSTFKPSLPQEGETKAETAARNAQHLISSLGDDVAAREGFDLVLECTGAEPCINMGIQALRPQGRFVQVGMGRSEVEFPITRVCVKEINVTGSFRYGAGTYKTSINLVSTGAIDVTKMVTHRFLFKDAVKAFETTTKGVGEDGKTAIKVQISQGEGKQ

SEQ ID NO: 68469 - protein, 345 aa, Myxococcus xanthus DK 1622
MKAVVLRSFGEAGNLKMETMPMPRPGRGEVLLRVHACGVCYHDVINRRGNLPRTSVPAILGHEAAGEVIEVGPDTPGWKTGDRAATLQRMSCGDCALCRSGRNSLCKTDNRFFGEELPGGYAQFMVAPVGGLGRVPASLPWNEAATVCCTTGTAVHTVRTRGKVRAGETVLITGASGGVGLSSVQLARLDGARVIAVTSSEAKVQALKEAGADEVIVSRGLDFASDVRKRTQGAGVDVAVEIVGSATFDQTLKSMAPGGRVVVVGNLESGMVQLNPGLVIVKELEILGAYATTQAELDEALRLTATGGVRQFVTDAVPLAEAAKAHFRLENREVAGRLVLVPPEA

SEQ ID NO: 68470 - protein, 286 aa, Ustilago maydis 521
MSTKLTLQSAYPLLGESGVEMPVLGFGVYKSPAEVTERSVTTALKSGYRHIDSAQYYENEKQVGNAVRAWCLETHSSRRDVFVTTKIIAPGKTKEDTLESLRESVSKINLDGYVDCFLIHTPTSGPEGRKHLWEALKELQSEGKVITIGVSNYGVKHLQELVDRQQTPAVNQIEIHPWCQQRPIVEFCKRHKIVLQAYCPIVRAQHANDADVLEIAAKHKVDWSQVLLRWSLQKGFVPLPKSDTPSRIASNADIFGFELDEDDMKKLDAKDQGAKGAVAPNPVDCE

SEQ ID NO: 68471 - protein, 511 aa, Burkholderia xenovorans LB400
MRNTQFTQISRSFVVNIPDASVWRARAQEIRPEGRAFIDGNYVGALSGRTFATVNPATGQVIAQVAECGEEDVNLAVASARKAFESGVWSRRAPAERKAVMLRFAQLMMEHREELALLESLDVGKPVANAYNGDIVSSATCIQWYGEAIDKLYGETAPAAPDMTTMIVREPLGVVAAVVPWNYPLSMASWKLGPALAAGNSVVLKPAEQSPLSAIRIAALAMEAGLPAGVLNVLPGYGETAGRALGLHMDVDAVGFTGSTAVGKLFMQYSGQSNIKRVGLECGGKSPHIVLDDCADLDAAARAVAAGIFGNSGQVCNAGSRLIVQAAVRDELLEKVAAIARELVPGDPLDPATKMGAIVSDVQHASIMSYIDAGRADGARVVAGGRAARPESGGYFIEPTVFDGVNNDMRIAREEIFGPVLSAITVDSPEEAVRVANDTIYGLAAAVWTSNVTRAQQVSRQLKAGVVWVNCFDRGTMSSPFGGFKQSGFGRDKSMHAFDKYMDWKAIWIAG

SEQ ID NO: 68472 - protein, 77 aa, Aquifex aeolicus
SLEERVKEIIAEQLGVEKEKITPEAKFVEDLGADSLDVVELIMAFEEEFGIEIPDEDAEKIQTVGDVINYLKEKVGG

SEQ ID NO: 68473 - protein, 195 aa, Geobacter sulfurreducens PCA
MKWSDYTYTVSADLYRYGGRRDRAAFLKSLACIPGFRYTFLMRTAKYLKSRGTLLLPLYALSRFLLNHYQYKYGISIPYNTDIGPGLYIGHFGGIIVNAEATIGRNCNINQEVTVGATYGGKYPGTPVIMNNVYLGPGSKIIGGITLGSHAAVGANCVVTKPVPDHGVVVGIPGEVVSTKGSGEYVVNTVADDVA

SEQ ID NO: 68474 - protein, 360 aa, Methylococcus capsulatus str. Bath
MSAFNVRPSSRDLAGAVAIPADVRPFRHRLSVAPMMDWTDRHCRFFLRLISRHTLLYTEMVTTAAILHGDRERLLGFHPAEHPLAIQLGGSDPEALAECAKIAEFRGFDEVNLNVGCPSPRVQTGRFGACLMAEPERVADCVRAMCEAVSVPVTVKTRIGIDDRDSYEDLLHFVTIVAEAGCRTFIVHARKAWLQGLSPKENRQTPPLRYDVVRRLKSELPELAIVLNGGIQTLDEAERHLSWCDGVMIGRAAYHNPYLLAEADRRCYGHSDVRPRTREEVIEDFMPYVRNELSKGSRLHALTRHILGLYHATPGGKRWRRHISEGASRRGASEALLLEAAHALGANGLRGNQGRQGSFT

SEQ ID NO: 68475 - protein, 437 aa, Candida glycerinogenes
MSTVTKVFARSVYDSRGNPTVEVELTTAEGVFRTIVPSGASTGVHEALELRDGDKSKWLGKGVTKAVDNVNKIIAPALVEAKVPVTEQLKIDQFLINLDGTPNKGKLGANAILGVSLAVAKAAAAYEKVPLYQYIHKISGSKDAYVLPVPFMDVVNGGSHAGGSLAFQEFMIAPTGAESFSEALRMGSEVYHHLKSLTKKTYGQSAGNVGDEGGVAPDIHTPQEALDLIMSAIKAAGYEGKIDIAMDSASSEFYKNGKYDLAYKDPNSDGSKAITGSQLGDLYAELCKNYPIVSLEDPFAEDDWETWTNNFEKLPVQIVADDLTVTNPQRIKTAIEKKAASALLLKVNQIGTLSESIQAANDSFAAGWGVMVSHRSGETEDTFIADLTVGLRTGELKSGAPARSERMAKYNQLLRIEEELGDKAVYAGKKFRTAHEL

SEQ ID NO: 68476 - protein, 185 aa, Oryza sativa
  misc_feature (47)..(47): Xaa can be any naturally occurring amino acid
  misc_feature (115)..(115): Xaa can be any naturally occurring amino acid
  misc_feature (122)..(122): Xaa can be any naturally occurring amino acid
  misc_feature (148)..(148): Xaa can be any naturally occurring amino acid
AHGTGGACAPTQPSSIQPPSATTTTQQPRQRQQASTVRLSRLLGGHXLHPPRPHPCGCAARPVEAPAAAAPTAQGRAAAPRLQAISAAIRVVPHFPKPGIMFNDITALLLRPAVXKDAVDLXVARYRGLRIADSAGIEARGITLAPRXALAIGATFIPSSHTQQLPSAVHSAHYTLSMAGMAAQL

SEQ ID NO: 68477 - protein, 3944 aa, Klebsiella pneumoniae subsp. pneumoniae MGH 78578
MKYTVDGNQVNLNTQSVVVLHIKREDISSFSRQGNDLVLKINDGSTLTLKDFFVNDANGHHSDLVLQDDDSGALWWLEGAGTSDAHYSLISDISGLLAAGSSGGSIAPWVMAGAALLGIGAMIAGSSDKDHSSHSPNDDTDSDADSDSDSDSDSDTDPGGSESDADADSDTDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDSDSDSDSDSDSDSDSDSDSDSDSDSDSDSDSDSDSDSDSDSDSDTEPQANNDTHTAAIDTVDGNLNNVTGTASQLLGVSLLNTVDVSLLAANSTKFSVSEGTTEDVTIAVTGSTLLSLQSVLALVGQLVGGASSITADLSIVNTDTGEVVQIIPDAVSLTPSLALLNLVYSGSATFSDLPAGNYAVVVSSPQASGGLAAVVDELASANLLSVALATITDSTQYTSTAIAGNVLVADAGGDVADTGDGITVSKIASSVQTTPLDVTAAGVVINGLYGQLTIHADGSYTYKATGDADAVGQADIFTYTIVDADGDTATATLTINIVAGSDIGESDADADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSVEAIPDTNSSEVVQQYGNLNGTEGNLSQLVGVSLLSTINVSLLSGSSFRFNVDNNTTEDMTVDVSGVSLLSTAGLLTSIVNLLGAGNTLTADLSVIDIATGRVVAIDAGSVSISATLLGGLVYSGTASFENLPAGSYALAISSPNSDGVLVSLINTLAGAGVATFVEATVTDSLGYSGSTVTGNVLEGSDNGDMADSGTDLTVTSVTATTAAGETFSVNGGTISVTGAYGVLTINADGSYSYQASGKAGSAGNADVFTYTITDGNGLQSTTTLTINIGQEVETAQANPDTQAYYVGNVEDNLDIQGGNVVQVAGLSLLNTVNVALPTNGFKFVVAEGTEQDVTLGVSGSTALSIALGAVTLDLILINTDTNQIVGVIKDGITATPTGFLGLSLEYAGGGEFERIGAGNYMVVISSPTTEGLIGSILNLNLGTSISMEVTDSTKYVTGNVLHTDSDGDVGDTGNEITVSSIQFGSQIETVTAGGVTINGTYGTLIIKSDGSYSYHANGTTGVGQSDVFTYTITDGLGHTSSTTLTMNIESTPPVAVDDIASLSAATAMQSVTWTQSVSNLAVPNTAVAANATSAAKVTSQNFTIAEGREVDGASITLNLSGNRTSGLSLLNGDLSGTVSLIHHVTVDGVTTDVTVWTSSLTMALDGSLLSPSSDTDTVTLNMVNGGIPLQLAAGDYTLSISHTMHAGTALSYNLSASVAGTEILTDAHLTVGQSVVGNILDGSDANGTPDTLGSLHSGFTISGENNLGIATNWTFHSDGTVTNDTGTSASNGNAVLYGEYGILTINGQGGYTYQLNGGVNTDAITSKETFTYTLISSDGGSSTANLTIDLHPQIAGSVNDDSVHSTAYDDTFSMGVGADTLVYNLLADDNTGGNGSDIWSDFSVAQGDHIDVSALLVGWNGSSDTLGNYITLSYVGGNTVVSIDRDGTGGNTHQPATLITLQGVHINSLDELIDTNNSN

SEQ ID NO: 68478 - protein, 331 aa, Borrelia burgdorferi
MKLAINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKVLSWYDNEFGYSTRVVDLAQ

SEQ ID NO: 68479 - protein, 566 aa, Oryza sativa
EDEAEMASTRLSLELGKVGIQSSPPCSSSSSAGHPAMQPAAAATAAPGYGPRPRHMLTEAEKEAKRLRRVLANRESARQTILRRQAIRDELARKVADLSSQNETMKKEKDVVAIRTIKKAAVAEPMDTAPPAQQQAETAAAVAPPTTATPPSTAPQPSFLYTAAPAGVAPVPYVWGSWPPCGPTGYEPPPPLCLPPCAWYYPVVADPRVSSPPTSTYPQSYQEQPTSSPGGGTAEEDTDDDPCSLTLAIDVDKRSAPGAGGSAAGAGQHASISDREKATAAAEARKRRKELTKLKQMHGGGGGSRPGGGGEHCACPSLRGMPPPPPPQPQPTTTATTSANGGKVTPNLTMDAEGTRLLNLTVLQRLDPAVEDILITAAHVTLYDFNIDLNQWSRKDVEGSLFVVKRNTQPRFQFIVMNRRNTDNLVEDLLSDFEYELQPPYLLYRNAAQEVNGIWFYNQHDCEAVASLFGRILNAYAKVPPKAKVPSTKSEFEELEAPTSAAIDGPLEPSPATTTIVSDAPDESLVNYSSAASIGSVSNAPMAGRAHPSSESVATSVLIIPSCYSD

SEQ ID NO: 68480 - protein, 326 aa, Borrelia burgdorferi
MKLAINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKVLSWYDNEFGYSTRV

SEQ ID NO: 68481 - protein, 449 aa, Pseudomonas syringae pv. phaseolicola
MNAALSQWKDAHAARLRDYSAVRVSGRVSAVRGILLECKIPAAKVGDLCEVSKADGSFLLAEIVGFTQECTLLSALGAPDGIQVGAPIRPLGIAHRIGVDDSLLGCVLDGFGRPLLGDCLGAFAGPDDRRETLPVIADALPPTQRPRITNALPTGVRAIDSAILLGEGQRVGLFAGAGCGKTTLMAELARNMGCDVIVFGLIGERGRELREFLDHELDETLRRRSVLVCATSDRSSMERARAAFTATAIAEAFRARGQKVLLLLDSLTRFARAQREIGIASGEPLGRGGLPPSVYTLLPRLVERAGMSENGSITALYTVLIEQDSMNDPVADEVRSLLDGHIVLSRKLAERGHYPAIDVSASISRILSNVTGREHQRANNRLRQLLAAYKQVEMLLRLGEYQAGADPVTDCAVQLNDDINEFLRQDLREPVPLQETLDGLLRLTSRLPE

SEQ ID NO: 68482 - protein, 313 aa, Cryptococcus neoformans var. neoformans B-3501A
MSLPGCAPMRTRSYGIPKRNPNPPPTIPRRGAPPQKSKIRGVKQVVVVASGKGGVGKSTVAANLALSLLNTSPFDRAPKVGLLDLDIFGPSVPKLMGLENAGDPRLSDENKLLPLQNHGVKTMSIGYLLPPNPENDSPVVWRGMMVMKAVQQLLFDVDWTSPNVNGSKEDLDVLVIDMPPGTGDVQLSLGQLVVVDGAVIVSTPQDVALIDARKGVGMFNKVSIPIIGLLLNMSHFTCTSCTTPHELFGSSAKFEKAAKDLNLDVLGEQTPISNIGERWRRCGQAGYGSSRKRGGRGATNHETSRQQGLGMVS

SEQ ID NO: 68483 - protein, 312 aa, Bacillus anthracis str. Ames
MKKVYFNHDGGVDDLVSLFLLLQMDNVELTGVSVIPADCYLEPAMSASRKIIDRFGKNTIEVAASNSRGKNPFPKDWRMHAFYVDALPILNESGKVVTHVAAKPAHHHLIETLLQTEEKTTLLFTGPLTDLARALYEAPIIENKIKRLVWMGGTFRTAGNVHEPEHDGTAEWNSFWDPEAVARVWEANIEIDLITLESTNQVPLTIDIREQWAKERKYIGIDFLGQCYAIVPPLVHFAKNSTYYLWDVLTAAFVGKADLAKVQTINSIVHTYGPSQGRTVETDDGRPVHVVYDVNHDRFFDYITRLAKKVST

SEQ ID NO: 68484 - protein, 326 aa, Borrelia burgdorferi
KLAINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKILSWYDNEFGYSTRVV

SEQ ID NO: 68485 - protein, 428 aa, Synechococcus sp. RS9917
MTPERLGLLWGVTVFAGASARLLAALSGLPGVVLLLLAGLLIGRSGLGLVEPLDLGQGLETVVGLLVSLVLFDGGLNLRLPGDTIKATVLRILLIRLLLSLAAGLLAAHWLAGLGWSVAAVYSAIVLATGPTVVTPLVQQIRLAPPLGDVLEAEGLVLEPVGAVLALLLLELLLGDLHGWRGLAIGLLSRLGGGVLIGLACGWLLSEALRRLKADPSVGLRLQLTLGVLFLMFGACEWLLPESGLPASVAAGVVVGRRPSTDAAQLDELIRELARLAITMLFPLLAADVSWAELSPLGWGGISCVLVLMVFVRPVAVSVATIGLPLDWRQRLFLGWLAPRGIVTAAVASLFAIRLEQAGVLGAGRLQGLVFLTILMTVGLQGLTAQPLAHWLGLIAADEGDDAPGAGEAPDGSATAVDPLPVVADSSQ

SEQ ID NO: 68486 - protein, 621 aa, Cryptococcus neoformans var. neoformans B-3501A
MDNTVAPSKGKKPGGARPNPGTRPESGGPARPTGAGGVPKLSIPPDNVPGMHVDQAGQGGWHQPSSLPSLALRPMRPSPTPSSSSRPKLSLTPLTPTIPASSSSAPSSASPAPPNRPALLNAHSARGYGERNTPSLKLSIPGASSVGPGFSTEHDYPLELPDDTDALSSELKTPTPGRPAGGGLNLSLSSLSLTSSEDANPTLQARGRDYDEGESSYGYGCVGNGLIGPGGDAISAMTEDIRQALSRNRFETGSDRGGARSRAGSLMSDSSRATAGRDRSDSASLYNAASRRESPSASLSGGSARQSLDLPRAAEEVNEHKESPVFDPEGLVMMRRLGEGTGGSVDMVQDRATGRIMAKKVITRTSNPMVHKQLLRELEILNSCASPFIVEHYGSFLADHDSSIGILMEYCEAGSLDSLLGKMKKKSMRCSEHVLGRVASSVLKGLDYLHQRRIVHRDIKPSNILITRQGAVKLCDFGVSGELVESLAGTFTGTSFYMAPERIQNKPYSIKADVWSLGMTLHEIAHLRFPFPPEGENQSVAPIELLSYIVTAPVPVMIDDLSVGRVWSEPIKDFMGQCLIRSGTDRPYPWQLLQHPFIVASEAKKVNMAKWVAALCNWPLS

SEQ ID NO: 68487 - protein, 332 aa, Zea mays
FGSREHSKACGHSQFGRIYEQGHYPEWDEDHPIHFVGHSAGAQVIRVLQQMLADKAFKGYENTSENWVLSVTSLSGAFNGTTRTYADGMLPEDGRTLKPICLLQLCRIGVIIYDWFDISWLKNYYNFGFDHYNMSWRKMGIWGLVDCLLGNAGPFASGDWILPDLTIQGSIRLNYHIRTFPNTYYFSYATKRTTKIMGVKVPSSILGIHPLLFIRVLQMCQWRFPPDVPPPYKGYRDEDWQDNDGALNTISMTHPRLPIEHPNCLVEKESDCQPLQPGIWYYKYVEGDHILFIINRERAGVQFDVIYDSIFQRCRKHVFRKKLPTMPNEINH

SEQ ID NO: 68488 - protein, 364 aa, Oryza sativa Indica Group
MGNGKVYATVVLIRLIYAGMHILTKASFNEGASTTVFVFYRHAVAAIFLLPFAYFLEIRKKQAPPLTFRLSAKIFVHGFYGMAGTINLYSIGLNYASATSSSAIFNIVPVVAFILAVMFRMETLNLKSTHGMAKASGILLCIGGVIVLALYQGPEFKSLNHHQLLHHASAAAAAAAHSKKNWALGIFLMTTSVVIWSFWTVKQGPLLLEYPSKLMNTTLQCVFASVQSLVIALVLERDFSRWILPGVVSLVGVLFTGIVVAAISYYLQIWVIEKKGPVFLSMSMPLSLVFTMAIASFLLGEDVSLGSIIGSLLLVAGLYNVLWGKSREEHGGGGGVVVAGAGTAGGEKDGAVAPAAADVVMAKV

SEQ ID NO: 68489 - protein, 324 aa, Borrelia burgdorferi
AINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKILSWYDNEFGYSTRVV

SEQ ID NO: 68490 - protein, 512 aa, Clostridium perfringens ATCC 13124
MSKKPVMLMILDGFGISPNKEGNAVAAANKPNYDRLFAKYPHTELQASGLEVGLPEGQMGNSEVGHLNIGAGRIIYQELTRITKEIKEGTFFTNKALVKAMDEAKENNTSLHLMGLLSNGGVHSHIDHLKGLLELAKKKGLQKVYVHAFMDGRDVAPSSGKEFIVELENAMKEIGVGEIATISGRYYAMDRDNRWERVELAYNAMVLGEGEKASSAVEAIEKSYHDNKTDEFVLPTVIEEDGHPVARIKDGDSVIFFNFRPDRAREITRAIVDPEFKGFERKQLHVNFVCMTQYDKTLECVDVAYRPESYTNTLGEYVASKGLNQLRIAETEKYAHVTFFFNGGVEQPNTNEDRALIASPKVATYDLKPEMSAYEVTDELINRLDQDKYDMIILNFANPDMVGHTGVQEAAVKAIEAVDECLGKVADKVLEKEGTLFITADHGNAEVMIDYSTGKPMTAHTSDPVPFLWVSKDAEGKSLKDGGKLADIAPTMLTVMGLEVPSEMTGTCLLNK

SEQ ID NO: 68491 - protein, 66 aa, Oryza sativa Japonica Group
MTTSRRLADRKSAKFQKNITKRGSVPETTVKKGNDYPVGPMVLGFFIFVVIGSCKLWPFTFLFLSV

SEQ ID NO: 68492 - protein, 360 aa, Festuca arundinacea
MGSTAADMAASADEDACMFALQLASSSVLPMTLKNAIELGLLEILVAAGGKSLTPTEVAAKLPSAANPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGSLVDVGGGVGATVAAIAAHYPTIKGVNFDLPHVISEAPQFPGVTHVGGDMFKEVPSGDAILMKWILHDWSDQHCATLLKNCYDALPAHGKVVLVECILPVNPEANPSSQGVFHVDMIMLAHNPGGRERYEREFQALARGAGFTGVKSTYIYANAWAIEFTK

SEQ ID NO: 68493 - protein, 428 aa, Mycobacterium sp. JLS
MDDVTMPQTPAERTWHAQGHQPRPRTFTQSSKLQDVLYEIRGPVHEHASRLEAEGHRILKLNIGNPAPFGFEAPDVIMRDIIQALPYAQGYSDSKGIMPARRAVFTRYELVDGFPRFDVDDVFLGNGASELIQMVLQALLDNGDQVLIPAPDYPLWTACTSLAGGTPVHYLCDETQGWNPDVADIESKITDRTKAIVVINPNNPTGAVYSRETLERIADLARKHQLLLLADEIYDKILYDDAKHISLASVAPDVLTLTFNGLSKAYRVAGYRSGWLVITGPKEHASSFIEGISLLANMRLCPNVPAQHAIQVALGGHQSIDDLVLPGGRLLEQRDVAWEKLNEIPGVSCVKPAGALYAFPRLDPEVYEIHDDELLVLDLLLQEKILVVQGTGFNWPTPDHLRIVTLPWARDLANAIERLGNFLVSYRQ

SEQ ID NO: 68494 - protein, 360 aa, Festuca arundinacea
MGSTAADMAASADEEACMFALQLASSSILPMTLKNAIELGLLEILVAAGGKSLTPTEVAAKLPSAANPEAPDMVDRMLRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAIAAHYPAIKGVNFDLPHVISEAPQFPGVTHVGGDMFKEVPSGDAILMKWILHDWSDQHCATLLKNCYDALPAHGKVVLVECILPVNPEAKPSSQGVFHVDMIMLAHNPGGRERYEREFEALARGAGFTGVKSTYIYANAWAIEFTK

SEQ ID NO: 68495 - protein, 260 aa, Coprinopsis cinerea okayama7#130
MPGALEQTVPEDAKESLVKEVFNSVASKYDLMNDATSFGVHRLWKDTFVSSLRPGRRGPQKCIDVAGGTGDIALRILDYAREKYADRETTVDIVDINAEMLKEGYRRFKKTMYHNTPQVAFHEGNAQLMSQFPDNTYDIYTIAFGIRNCTSIPDVLKEAHRILKPGGTFACLEFSRVGNPLLSTLYDQYSFSVIPLMGTVLAGDRDSYQYLVESIRKFPPQQEFAQMIRDAGFATGKDEDGGAWTDLWGGIASIHKGVKL

SEQ ID NO: 68496 - protein, 450 aa, Salmonella typhimurium LT2
MTKHYDYIAIGGGSGGIASINRAAMYGQKCALIEAKELGGTCVNVGCVPKKVMWHAAQIREAIHLYGPDYGFDTTINQFDWSKLIASRTAYIDRIHTSYDNVLGKNNVDVIKGFARFVDAKTIEVNGETITADHILIATGGRPSHPEIPGVEYGIDSDGFFALSALPERVAVVGAGYIAVELAGVINALGAKTHLFVRKHAPLRSFDPMISETLVEVMNAEGPQLHTHAVPKAVVKNADGSLTLELEDGRSETVDCLIWAIGREPSTDNINLAAAGVKTNEKGYIIVDKFQNTNVEGIYAVGDNTGAVELTPVAVAAGRRLSERLFNNKPEEHLDYSNIPTVVFSHPPIGTVGLSEPQAREQYGDEQVKVYKSSFTAMYTAVTTHRQPCRMKLVCVGPEEKIVGIHGIGFGMDEMLQGFAVALKMGATKKDFDNTVAIHPTASEEFVTMR

SEQ ID NO: 68497 - protein, 188 aa, Streptococcus agalactiae 2603V/R
MLLLVDNYDSFTYNLKQYLSVYKEVFVIKNDVPNLFLLAESAEAIVLSPGPGHPKDAGKMVELINQFIGKKPILGICLGHQALAECLGGRLNLANHVMHGKQSWVTINDHTSLFKGIDSPTQVMRYHSLVVTDLPENIAVIARSNEDNEIMAFHCPSLKVYAMQFHPESIGSIDGMKMIENFLTLIND

SEQ ID NO: 68498 - protein, 760 aa, Coprinopsis cinerea okayama7#130
MAAPASLPMPPPSADLATTWRYLEDGVDHIMTKLQTGVSYTKYMSLYTVAYNYCTSSKMHGSDGSIGLQNRTGANLMGSDLYNNLIRYFNGHLQGLRESAENLQDEALLRYYAAEWDRYTIGANYINRLFTYLNRHWVRRERDEGRKSVYPVYTLALVQWRTQLFIPIQRKQKIVNALLRLIENQRNGDTIDQGLVKKVVDSFVSLGLDEADINKACLDIYREHFEVPFIDATETYYKHESEAFLGSNSVSDYLKKAEERLREEEDRVERYLNTSTRKALITKCEHVLIRDHSQLMWDSFQSLLDYDKDEDLQRMYALLSRIPEGLEPLRKRFEEHVKKSGQDAVARLMGANNEALDPKEYVDALLAVHQKNADTVNRSFRGEAGFVASLDKACREFVNRNGATGNSNSKSPELIAKHADLLLRKNNKVAEEGDLEGALNRVMILFKYIEDKDIFQQFYTTKLSKRLIHGVSASEESESSMISKLKEACGFEYTNKLQRMQSPDMSLSKDLTDQFKTRMEQNHDDMDINFSIMVLGTNFWPLTAPQHEFIIPEEMLTTYDRFQKYYQTKHSGRKLTWLWNYCKNELRTNYTNQKYILMTSTFQTAILTQYNRNDTLSLDELVTATSIPKDHLVQVLALLVKAKVLINEETDQYDLNPGFKSKKIRVNLNLPIKAETKAESKDVMKTVEEDRKYVIQATIVRIMKARKTMKNQALLDEVISQISQRFTPKVPDIKKAIDTLLEKDYIERVEGTRDTFAYLA

SEQ ID NO: 68499 - protein, 360 aa, Festuca arundinacea
MGSTAADMAASADEEACMFALQLASSSILPMTLKNAIELGLLEILVAAGGKSLTPTEVAAKLPSAANPEAPDMVDRMLRLLASYNVVSCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFQGLGTLVDVGGGVGATVAAITAHYPAIKGVNFDLPHVISEAPPFPGVTHVGGDMFKEVPSGDAILMKWILHDWSDQHCATLLKNCYDALPAHGKVVLVECILPVNPEAKPSSQGVFHVDMIMLAHNPGGRERYEREFEALARGAGFTGVKSTYIYANAWAIEFTK

SEQ ID NO: 68500 - protein, 347 aa, Salmonella typhimurium LT2
MKIRVFMATVLLLISHCVFSTTSLPHIVILATGGTIAGTAANNTQTAGYKSGELGVQTLINAVPEMNNIARVDGEQVANIGSENMTSDIILKLSQKVNALLARDDVDGVVITHGTDTLDETAYFLNLTVKSDKPVVFTAAMRPASAISADGAMNLLEAVTVAADPNAKGRGVMVVLNDRIGSARFVTKTNATTLDTFKAPEEGYLGVIVNGQPQFETRVEKIHTLRSVFDVRNIKKLPNVVIIYGYQDDPEYMYDAAIAHHADGIIYAGTGAGSVSVRSDAGIKKAEKAGIIVVRASRTGNGVVPLDKGQPGLVSDSLNPAKARVLLMTALTQTRNPELIQSYFSTY

SEQ ID NO: 68501 - protein, 298 aa, Pseudomonas fluorescens
MGSSHHHHHHSSGLVPRGSHMHNYVIIDAFASVPLEGNPVAVFFDADDLPPAQMQRIAREMNLSESTFVLKPRNGGDALIRIFTPVNELPFAGHPLLGTAIALGAHTDNHRLYLETQMGTIAFELERQNGSVIAASMDQPIPTWTALGRDAELLKALGISDSTFPIEIYHNGPRHVFVGLPSIDALSALHPDHRALSNFHDMAINCFAGAGRRWRSRMFSPAYGVVEDAATGSAAGPLAIHLARHGQIEFGQPVEILQGVEIGRPSLMFAKAEGRAEQLTRVEVSGNGVTFGRGTIVL

SEQ ID NO: 68502 - protein, 360 aa, Festuca arundinacea
MGSSAADVAASADEEACMYALQLGSSSILPMTLKNTIELGLLETLMAAGGKSLTPTEVAAKLPCAANPEAPDMVDRMLRLLASYNVVSCLVEEGTDGRLSRRYGAAPVCKFLTPNEDGVSMAALALMNQDKVLMESWYYLKDAVLDGGIPFNKAYGMSAFEYHGTDPRFNRVFNEAMKNNSIIITKKLLELYDGFQGIGTLVDVGGSVGATVAAITAHYPAIEGINFDLPHVISEAPPFPGVTHVGGDMFKKVPSGDAILMKWILHDWSDQHCATLLKNCYDALPAHGKVVLVECILPVHPEAKPSSQGVFHVDMIMLAHNPGGRERYEREFEALAKGAGFAGFKSTYIYANAWAIEFTK

SEQ ID NO: 68503 - protein, 402 aa, Oryza sativa Indica Group
MDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRYTLSLLSASHFAYGTSNFILINNSEFTKSWNYSVLYEVFPMSFLMEQAGGQSFTGKERALDLVPTKIHERSPIFLGSFEDVEEIKGLYAAQANVIVLRPGTAS

SEQ ID NO: 68504 - protein, 85 aa, Arachis hypogaea
LAPLPIGFAVFMVHLATIPVTGTGINPARSFGAAVIFNQDKPWDDHWIFWVGPFIGAAIAAFYHQFILRAGAVKALGSFRSDPNV

SEQ ID NO: 68505 - protein, 175 aa, Glycine max
MSAYKDQDPRLHGIKTKIRVVPNFPKSGLMFLDITTLLLDPKAFKDSIDLFVERYKGKNISVVAGIEARGFIFGPPIALAIGAKFVPLRKPKKLPGKVISQEYILEYGRDCLEMHVGAVDDLIATGGTLCAAMDLLERVGAEVVECACVIELPELKGRERLNGKPLCVLVEYVDI

SEQ ID NO: 68506 - protein, 169 aa, Triticum aestivum
  misc_feature (84)..(84): Xaa can be any naturally occurring amino acid
  misc_feature (116)..(116): Xaa can be any naturally occurring amino acid
MAAAAVDPMVLGLGTSGGASGSGVVGGGVGRAGGGGAVMEGAQPVDLARHPSGIVPVLQNIVSTVNLDCRLDLKQIALQARNAXNIVASCDVKFPIRLEGLAYSHGAFSSYEPELXFPGLIYRMKQPKIVLLVFVSGKIVLTGAKVRDEIYAAFENIYPVLTEYRKSQQ

SEQ ID NO: 68507 - protein, 162 aa, Arachis hypogaea
LFGLALGGQITILTAIFYIISQLLGSIAACLLLKLVTGGLTIPIHNVGSGVGAGEGVVAEIIVTFGLVYTVYATAADPKKGSLGTIAPIAIGFIVGANILAAGAFSGGSMNPARSFGPAVISGDFTNHWIYWVGPLIGGAVAGLVYSFFYMPTEHAPLAGDF

SEQ ID NO: 68508 - protein, 174 aa, Physcomitrella patens subsp. patens
MSEVEGRGGKVLVTVGTTLFDALVREASSQPCRQVLADFGYSSLVIQRGKGSFIPSDGKDGGLKVTSFDFEPNLSDHIASSALVISHAGSGSIFETLRAKRPLVVVVNDLLMDNHQCELAEELAARKHLVYASSPATLIETLKNMELPSLVPYPPSNPLAVVSALNQYLGFVDT

SEQ ID NO: 68509 - protein, 378 aa, Brassica napus
MTCFSCLNPRTKDIRVDIDTARPTTDSSVRGSDTTGTGSISGILVNGKVNSPTKPGGGARSFTFKELAEATRNFREVNLLGEGGFGRVYKGRLDSGQQVVAIKQLNPDGLQGNREFIVEVLMLSLYHHPNLVTLIGYCTSGDQRLLVYEYMPMGSLEDHLFDLDSNQEPLTWNTRMKIAVGAARGIEYLHCTANPPVIYRDLKSANILLDKEFNPKLSDFGLAKLGPVGDRTHVSTRVMGTYGYCAPEYAMSGKLTVKSDIYCFGVVLLELVTGRKAIDLSQKQGEQNLVAWSRPYLKDQKKFGHLVDPSLRGKYPRRCLNYAIAIIAMCLNEEAHYRPFIGDIVVALEYLAAQSQSHEARNVSCTSPEVRRTPRRDS

SEQ ID NO: 68510 - protein, 323 aa, Borrelia burgdorferi
AINGFGRIGRNVFKIAFERGIDIVAINDLTDPKTLAHLLKYDSTFGVYNKKVESRDGAIVVDGREIKIIAERDPKNLPWAKLGIDVVIESTGVFSSATSDKGGYLDHVNHAGAKKVILTVPAKDEIKTIVLGVNDHDINSDLKAVSNASCTTNCLAPLAKVLHESFGIEQGLMTTVHAYTNDQRILDLPHSDLRRARAAALSIIPTSTGAAKAVGLVLPELKGKLNGTSMRVPVPTGSIVDLTVQLKKKDVTKEEINSVLRKASETPELKGILGYTEDPIVSSDIKGNSHSSIVDGLETMVLENGFAKILSWYDNEFGYSTRV

SEQ ID NO: 68511 - protein, 362 aa, Methylococcus capsulatus str. Bath
MANDPSLAELRKRIDELDDRVLELLNQRARCAQRVADIKVAAGETDCFYRPEREAEILQRLTAHNPGPLGREAVVRFFREVMSECLALEKPLSVAFLGPEGTFTQQAAYRHFGHAIQAVPMPAIDEIFRAVESGACHYGVVPVENSTEGVITHTLDSFVRFSLIIAGEVQLRIHHNLLCRTPTALTELTEVFSHPQSLAQCRGWLDRFLPGVRRTPLGSNAEAARRAAETAGTAAIAGEVAAGLYGLEILNRNIEDEPDNTTRFLVIGGQPVGPTGHDKTSLLLSTRNDPGALFRLIEPFARLGISMTKIESRPSRRGMWDYFFFIDVEGHQADPTLAQALAEVREHCCMMRILGSYPRALS

SEQ ID NO: 68512 - protein, 536 aa, Zea mays
MALELSLASASPPAGGGLAQPPPLAPPGKEQQVAGVGILLQISMLVLSFVLGHVLRRHRFYYLPEASASLLIGLVVGGLANISNTETNTRTWFNFHEEFFFLFLLPPIIFQSGFSLSPKPFFANFGAIVTFAILGTFIASVVTGVLVYLGGLTFLMYKLPLVECLMFGALISATDPVTVLSIFQELGSDVNLYALVFGESVLNDAMAISLYRTMSSVRSHAAGGENFFMMILQFLETFVGSMSSGVGVGFISALLFKYAGLDVDNLQNLECCLFVLFPYFSYMLAEGLGLSGIVSILFTGMVMKHYTYSNLSDNSQRFVSAFFHLLSSLAETFVFIYMGFDIAMEEHSWSHVGFIFFSIIFIVVARAANVFSCAYLVNMSRPEHRRIPVKHQKALWFSGLRGAMAFALALQSVHELPEGHGKTIFTTTTAIVVLTVLLIGGSTGTMLESLDVVGDENTSRENYEDNNGYMPPSYEEGTSSGGGLRMKLKQFHKSTTSFTALDKNYLTPFFTSQTDDDNDDDFSQQPQNRRLAFYDQ

SEQ ID NO: 68513 - protein, 297 aa, Bordetella bronchiseptica RB50
MQTSAQRSPASATLDLGAAVDAAVTAAHAGAAILQSYAHHRSDLVIDRKARNDLVSQADRESEAAVISVLRERTPQFGIVAEETGGAAQGPATWYIDPLDGTTNYLHGIPHYAVSIALVAHAGTRVVAGADLQEDTPVIGVVYDPSSEELFTAVHGIGSWLNGHRISCSRTSTLDDAVLATGFPFRDFSFAHQYMPMLHDAIRRTRGVRRMGAAALDLAWTACGRYDGYWEMGLAPWDVAAGTLLVREAGGVCTDMMRQQSWPSGGRVVAGNRHIHGALFDMVSPHLDAPAPGSSQA

SEQ ID NO: 68514 - protein, 447 aa, Oryza sativa Indica Group
MSMHAQKIADGDVAIDLHPFIRKYNDGRVERILRSSFVPASEDPAASRGGVATRDVIIDERNGVFARLFLPSAAPAAGSRRRLPVILYIHGGSFCTESAFCRTYHRYAASLASRAGALVVSVEYRLAPEHPVPAAHDDAWAALRWVASLSDPWLANYADPSRTFIAGDSAGGHIAYRTAVRAASREGGDIGIEGLIIIHPYFWGARMLPSEAAWDGESVIKPHQVGELWPFVTSGKAGNDDPWIDPPVEEVASLTCRRALVAVAEKDFLRDRGRLLAARMRGCAWAGGGDGRNVTLVESEGEDHGFHLYSPLRATSRRLMESVVRFINERSAAAAVAATSPWPAGVLPELHECSPSRARKGKMSKAQPLLSVPSRPYQGVFLNGPDLQAPRGPSAMKINNALTVGLDKASKRGFGSFATWANPNNRRAIKRPLSASVSRNIVAKNFF

SEQ ID NO: 68515 - protein, 286 aa, Synechococcus sp. RS9917
MNLFADLLAASNGAQAPARAKATATGPRIQQRRGVEVKSARELKIMAQASKIVATVLREIMAAVEPGQTTADLDAIAESRIRAMGATPSFKGYHGFPASICASINDEVVHGIPSARRVIRSGDLLKVDTGAYFDGYHGDSCVTICVGDVPEEARTLSRVAQESLMAGLGQIKAGNTLLDIAGAVEDHVKAHGYSVVEDYTGHGVGRNLHEEPSVFNFRTNDLPNVTLRPGMTLAVEPILNAGSKRCRTLKDRWTVVTRDGSLSAQWEHTIVVTSDGCEILTDRGES

SEQ ID NO: 68516 - protein, 310 aa, Clostridium perfringens ATCC 13124
MNKICVLGSMNMDLVLKVKDMPKVGETILSKSFQKIAGGKGANQAVAAKRSGAEVFMISKIGKDENGRELRDKLVEDNIDVKYVFEDRIEPTGMALIMVNDNGNNSIIVNAGSNMTLTKDEIHSAENLIKESDIIISQFETPEDITIEAFKIAKENGKVTILNPAPAKKIKDELLNYTDIIVPNETEAELLTGIEIKYIEDAKKAGDIFLGKGVKFAIITLGEKGAALIGKDFCEIVPAYRVNAIDTTAAGDSFIGGLSSKLDTKNLGRETLSSSIRFGNKVSSIAVQRKGAQPSIPYLKEVLEVYKGEE

SEQ ID NO: 68517 - protein, 321 aa, Candida boidinii
MSSPLLTLNNGLKMPQIGFGCWKVDNATCAETIYEAIKVGYRLFDGAMDYGNEKEVGEGVNKAIKDGLVKREELFIVSKLWNNFHHPDSVKLAIKKVLSDLNLEYIDLFYMHFPIAQKFVPIEKKYPPNFYCGDGDKWSFEDVPLLTTWRAMEELVEEGLVKSIGISNFVGALIQDLLRGCKIRPAVLEIEHHPYLVQPRLIEYAKTEGIHVTAYSSFGPQSFVELDHPKVKDCTTLFKHETITSIASAHDVPPAKVLLRWATQRGLAVIPKSNKKERLLGNLKINDFDLTEAELEKIEALDIGLRFNDPWTWGYNIPTFI

SEQ ID NO: 68518 - protein, 107 aa, Triticum aestivum
YNKFVQKSRLVPVRNSRDIVDPRVRAPVSGPGFGGKIGTTKGSLLTQYLMKEGGLIKETWMDEDPREAILKYADAAKNDPKFIAPAYAQTQPETVFAESDSDGEEKK

SEQ ID NO: 68519 - protein, 461 aa, Oryza sativa Indica Group
MASMQEKMIREAMAAMNGQTAADVAVNLYPFIRKYTDGRVERLLTSSYVPASEDAGRGRGGVGVATRDVVVDRDNGVSARLFLPSSAATGGGGGGRRLPVVLYFHGGSFCTESAFCRTYHRYASSLASRAGALVVSVEYRLAPEHPIPAAYDDAWAAFRWVESLSDPWLAEYGDLRRTFVAGDSAGGNIAYHTVARAGRENVGGGIQGLIMVHPFFWGPERLPCETVWDGASVFPAFGVDWLWPFVTAGQADNDDPRIDPADDELASLPCRRVLMAVAGRDTLRDRGRRLASRMRGDVTVVESEGEDHGFHLYSPLRATSKRLMQSIVQFINQPPNPCPPPPAPAPSPAMRWPATILPELDEWSSSTYSDDAANSSQILLGMPARAYKAIFVDRMDRKAAKTGRLSSNPTVNASLSIGPSGKASKTSCYGMSFGRTRAYNFRGVAAAGSGQCQPPFRGVTI

SEQ ID NO: 68520 - protein, 332 aa, Buchnera aphidicola (Acyrthosiphon pisum)
MTIKVGINGFGRIGRVLFRLAQKRSDIEIIAINDLLAPEYIAYMLKYDSTHGVFKKHITFDKDNIIINGKNIRVTSIKDPEKLMWHDLSIDVVIESTGLFLKREQAYKHILAGSKKVVVTGPSKDDIPMFVRGANFHKYQGESIVSNASCTTNCLAPLSKVIDDNFGIIEGLMTTVHASTATQKIVDGASDKDWRGGRGALQNIIPSSTGAAIAVGKVLPNLNGKLTGMAFRVPVSNVSVVDLTVRYKKSATYSEICQKIQQASQKEMKGIMGYTEDEVVSTDFNGEELTSIFDAKAGLSLNKNFVKLIAWYDNETGYSSKVLDLVSLVSKK

SEQ ID NO: 68521 - protein, 482 aa, Klebsiella pneumoniae subsp. pneumoniae MGH 78578
MSVFHSDLFRQQALIAGSWRDAADGTTLAVSNPSTGATLGQIPNMGRAEAQQAVDAAAAALPNWRALTAAQRAALLKNWHRLILENKTALAQIMTAEQGKPLAEAEGEIAYAASFIEWFAEQGKRANGEIIPSPGADKRLMVIRQGVGVCAAITPWNFPAAMITRKAGPALAAGCTMVIKPANETPFTALAMAELANQAGIPQGVINVVTGQSREIGAVFTGDERVRKLSFTGSTEVGRVLMRQCAESIKKLSLELGGNAPFIVFDDADIDKAVEGALIAKFRNAGQTCVCVNRFYIHRAIYDQFCDKFVARVAALKVGDGSESDVQIGPLINADAGRKVQSLLDDALSRGATLLTGGKAHPLGGNFFTPTVIGDVQPGSLLLQEEIFGPVAALVKFDDEQQVIEQANNTIYGLASYFYSNDAARIWRVSEQLEYGMVGINTGLISNEVAPFGGVKQSGLGREGSEHGIEDYLEMKYLCQGL

SEQ ID NO: 68522 - protein, 418 aa, Coprinopsis cinerea okayama7#130
MQYKALVTFVALACSLAGASPIPQRDGTDPRPTLVIPVPGQPTILPPWPPVPPQPTDLPTKPPVDPPKPTVEPPKPTVAPPKPPVEPPKPPVEPPKPPVEPPKPPVEPPKPPVEPPKPPVEPPKPPVEPPKPPKPPVEPPVPPKPPVEPPKPPVVPPFPPKPPVEPPAPPKPPVEPPKPPVVPPFPPKPPVEPPKPPVVPPFPPKPPVEPPAPPKPPVEPPKPPVVPPFPPKPPVEPPKPPVVPPFPPKPPVEPPVPPKPPVEPPKPTAVPPKPPVVPPLPPKPTVVPPKPPVVPPAPPKPTDVPPKPPVVPPAPPKPTVVPPKPPVVPPAPPKPTVAPPKPPVVPPAPPKPTVVPPKPPVVPPAPPKPTVAPPKPPVVPPAPPKPTVVPPSPPKPPVVPPFPPKPTVVPPKPKPAEN

SEQ ID NO: 68523 - protein, 426 aa, Prunus avium
MAGICCGVVGEAEASTTIEASSRNSRRRRLELLPLKYIADMAVKPSTVENSRKRQKIDLYRSSSSVPHNAVESSSEAKSKSESEGSKLNATVRFGDDDFDAVNTRGDHQESKSVRVDNEAVQVQALQGSPRFGMTSVCGRRRDMEDAVSIHPSFYQNDGPDSNGAHFYGVFDGHGCSHVALKCKDRLHEIVKQELETEGGYIQWKGAMERSFAKMDDEVQEGNLVAQGPNCRCELQTPQCDAVGSTAVVAVVTPEKIIVSNCGDSRAVLCRNGVAVPLSSDHKPDRPDELVRIEAAGGRVIYWDGARVLGVLAMSRAIGDNYLKPYVISEPEVTIMDRSAEDECLILASDGLWDVVSNDTACGVVRMCLRAQKTTSHSESSGRDAAVRSDKACSDASILLTKLALARQSSDNVSVVVVDLRRPGRC

SEQ ID NO: 68524 - protein, 478 aa, Vitis vinifera
MDGSENTVSIPNEDELGLGLRPSSPAQPDVEKLNQEFLSLVLEQHEPVVESLALEQHEPVVESLALEQHEPVVESLALEEREEEKEEDEESDSNGEVKASDDEEEQCENLEDESAAKDDKSARFQYPVRPDAVDCSFYLRTGTCKFGSNCKFNHPIRRKNQVSFIDQLGGKFPERPGQTECKYYLRTGGCKFGKACRYNHTKAKPSAVPVLELNFLGLPIRMGEKECPYYMRTGSCKYGANCRFNHPDPTAAGGYESPSGYGNGGSVPLQGASQSNMASWSSPRALNEPAPFVPIMFSPTQGVPPPNPEWNGYQVFMLLLKRSMHPPPAFVINNTATDANVYGHHQQQQQSLIEDFPERPGQPECSYFLKTGDCKFRAACKYHHPKNRIPKSPPCTLSDKGLPLRPDQNICTHYNRYGICKFGPACKFDHPVNYGNSASAPSAESGQDQPPPFGGSVTADGVRPGSGNGNEILIQQPV

SEQ ID NO: 68525 - protein, 283 aa, Bdellovibrio bacteriovorus HD100
MENSVKSRDWKQVLGQAIEAVNLGRQVLLNYFGNLEHVEEKFQAGLVSEADKESERVIAEHLRKNFPEIEFLGEETFAASHGTGTKVAWSKAGANGRWILDPLDGTTNYVHRFPIFCISLGLEIDGQIQLAVIDVPMLNETYTAIRGQGAFVNGKPLRVSKNTELKKGLLATGFVSEHEHVISEQLRIFDEMVRKCRGVRRPGAAAYDLAQVARGVFDGYWERNIQPWDAAAGILLVEEAGGVVQTYRGEAYTPYKNSIVAGNADMVTEIQKVLVPRLSVGTD

SEQ ID NO: 68526 - protein, 403 aa, Myxococcus xanthus DK 1622
MRSDTVNVVKLELARGLGRHLRAGHPWVFRKALEHVPKIPAGSVVDLTENGKFVARGYYDPHSAIAVRVLTRDSRDTVDAGFITRRVRQALSERTALIDLTDTDSYRLIHGEGDGLPGVVVDLYAGWAVMKLYSAGLTPYRPLLIEALKAGVPGLKGIIGRDEVGRDDVDEDEGRGSGKMLFGHEAPELIPIRERGATFLVDAWKGQKTGFFLDQRENRYLIRRLGKGRDVLNCFSFSGGFSVNAALGGANSVFSVDQDPDAIALARENFTRNGIAAEKHDFLAADVFKIIQSFKDEGRTFDLIILDPPAFAKSQRAVQAAIDGYASLNRQALAILRPGGLLATASCSARVSPDDFMGAVREAGFKAGVDLALVEERYQPPDHPVRLQFPEGKYLKFYVLQSV

SEQ ID NO: 68527 - protein, 309 aa, Salmonella typhimurium LT2
MSKKIAVIGECMIELSQKGADVQRGFGGDTLNTSVYIARQVDSAALAVHYVTALGTDSFSQQMLEAWQHENVDTSLTQRMENRLPGLYYIETDDTGERTFYYWRNEAAAKFWLESEQSAAICETLATFDYLYLSGISLAILSPTSRDKLLSLLRECRANGGKVIFDNNYRPRLWTSREETQQVYQKMLECTDIAFLTLDDEDALWGQQPVEEVIARTHAAGVQEVVVKRGADSCLVSIQGEALIDVPAVKLPKEKVIDTTAAGDSFSAGYLAVRLTGGSATDAAKRGHLTASTVIQYRGAIIPHDAMPQ

SEQ ID NO: 68528 - protein, 471 aa, Mycobacterium sp. JLS
MSEQRPAPHIFVLFGATGDLAKRKLFPGLYRLAAAGRLPEEYAIIGSGRHSPGGDDEFRDSVGDGLRDSVDDIDDRVLSNLLQSLSFQTSDSDDGSDLAEAVRSARTRLGDGAQTLIYLSVPPRAMQPMIAMLGREGLAEGARVVVEKPFGTDLDTARELDATLKDVVDEDQVYRIDHFIGKEAVQNILAVRFANGLIEPAWHRNHLVSVQIDVPEELTIEGRGSFYESTGCFRDMISTHLCQVLGFVAMEPPVHLDPVSLRNEKAKVFEAMRPLDPDRVVFGQYDGYREEEGVADDSQVETFVALEAFIDTERWQGVPFYLRTGKALGATRRTVTLTFRGPPMALFGADDNEHSPNQLVLELTDSPEFQVRLLAKRPGPDLGLMPLDLSLGVADEDSDDTPLEAYERLLLDVMRGDQTLFTRADEVDRLWQVCQPVLDAPPQALTYASGSWGPQEALALPGAAGWRLPDA

SEQ ID NO: 68529 - protein, 334 aa, Oryza sativa
  misc_feature (198)..(198): Xaa can be any naturally occurring amino acid
  misc_feature (310)..(310): Xaa can be any naturally occurring amino acid
MAKARKQQPQGPFAGGAGAGERAVLGFQYHHHHRGGSVAPAYGDDDDLPELAEADVWYAPSSEGGADHRGGGGGRMKGDKGTVEVAGTNKETTTQGHDDLGKRCAKYYEAGARFAKWRAVLKIGPNEPSQLSIDLNAQGFARYAIICQENGLVPIVEPEILVDGSHDIERCAYITEKVLAACYKALNEHHVLLEGSLXLKPNMVTPGSESKKVSPQLIAEYTVRALQRTVPAAVPAIVFLSGGQSEEEATVNLNAMNKLSTKKPWALSFSFGRALQQSTLKAWGGKTENVVKAQKAFITRCKANSEATLXGTYQGDAVLGEGASESLHVKDYKY

SEQ ID NO: 68530 - protein, 608 aa, Spinacia oleracea
MHHHHHHSSGLVPRGSGMKETAAAKFERQHMDSPDLGTDDDDKAMGCQKAVSPAAETAAVSPSVDAARLEPRVEERDGFWVLKEEFRSGINPAEKVKIEKDPMKLFIEDGISDLATLSMEEVDKSKHNKDDIDVRLKWLGLFHRRKHHYGRFMMRLKLPNGVTTSEQTRYLASVIKKYGKDGCADVTTRQNWQIRGVVLPDVPEIIKGLESVGLTSLQSGMDNVRNPVGNPLAGIDPHEIVDTRPFTNLISQFVTANSRGNLSITNLPRKWNPCVIGSHDLYEHPHINDLAYMPATKNGKFGFNLLVGGFFSIKRCEEAIPLDAWVSAEDVVPVCKAMLEAFRDLGFRGNRQKCRMMWLIDELGMEAFRGEVEKRMPEQVLERASSEELVQKDWERREYLGVHPQKQQGLSFVGLHIPVGRLQADEMEELARIADVYGSGELRLTVEQNIIIPNVENSKIDSLLNEPLLKERYSPEPPILMKGLVACTGSQFCGQAIIETKARALKVTEEVQRLVSVTRPVRMHWTGCPNSCGQVQVADIGFMGCMTRDENGKPCEGADVFVGGRIGSDSHLGDIYKKAVPCKDLVPVVAEILINQFGAVPREREEAE

SEQ ID NO: 68531 - protein, 436 aa, Triticum aestivum
AVAAALELVDPPGCRAYSYNDSKCSVWNGELLSVTLSDGIEYTSKDVLYLRLAAKDFMPSLRKNKRKPNVGVVTAASIIGFGLLMLMFLLLIWRNRFKWCGFLPLHYDNQGSVGGIIAFRYTDLVRATKNFSEKLGGGGFGSVYKGMLSDSKTTVAVKRLDGARQGEKQFRAEVSSIGLIQHINLVKLVGFCCEGDHRLLVYEHMLNGSLDGHLFKKSNNVDAVVLNWNTRYQISLGVARGLSYLHQSCRECIIHCDVKPENILVDASFVPKVADFGLAAFVGRDFSRILTTFRGTAGYLAPEWLTGVAITPKVDVYGFGMVLMEIISGSRNSPETHNTSSSTSYHAEYFPVQAINKLHGGDVKSLVDPRLHGDFNLEEAERVCKVACWCIQDNEFDRPTMGEVVRVLEGLQEIDVPPMPRLLAAITAQPGAAYSV

SEQ ID NO: 68532 - protein, 191 aa, Arachis hypogaea
AGCLFCMLRSLCAVLLVANISGGHVNLAVSFGLALGDQITILTAIFYIISQLLGSIAACLLLKLVTGGLTIPIHNVGAGVGAGEGVVAEIIITFGLVYTVYATAADPKKGSLGTIAPIAIGFIVGANILAAGAFSGGSMNPARSFGPAVISGDFTNHWIYWVGPLIGGAVAGLVYSFFYMPTEHAPLASDF

SEQ ID NO: 68533 - protein, 224 aa, Streptococcus agalactiae 2603V/R
MMNLQENKTAIFDNVSKLALKAGRAHESVHIVAVTKYVNCQTTEALIRTGVNHIGENRVDKFLEKYQALKDEKLTWHLIGSLQRRKVKDVINYVDYFHALDSVKLAAEIQKHAQKLIKCFLQVNISREDSKHGFTIEQIDDALNLISRYDKIELIGIMTMAPLKATKEEISSIFEETESLRKRLQARNIERMPFTELSMGMSRDYDIAIQNGSTFVRIGTSFFK

SEQ ID NO: 68534 - protein, 145 aa, Magnaporthe grisea 70-15
MMFRATALRSAAASVARAGAVRPVVSSSAVARLATRRAAPTAWVPRTAAPWTAVRCYAAAGGLDKPQVEGRIISLLQKFDKVNDPSKIQPSSHFANDLGLDSLDTVEVVMAIEEEFSIEIPDKDADQIHSVDKAVEYILSQPDAN

SEQ ID NO: 68535 - protein, 368 aa, Arabidopsis thaliana
FGFRESRFIKDMGQKRWFFLLAIFVCLVSSSCGRVLKFKSDDGRPVYNHTLAITLVEYTSAVYMSDLSELFTWTCERCNGLTKGFEVIEIIVDVEHCLQAYVGVAKDLNAIIIAFRGTQEHSIQNWVSDLFWKQLDLNYPDMPDAMVHHGFYSAYHNTTVRPAVLDAVKRAKESYGANLNIMVTGHSMGGAMASFCALDLVVNEGEENVQVMTFGQPRVGNAAFASYFNLLVPNTFRIIHDRDIVPHLPPYYHLFPQKTYHHFPTEVWLTELSILNIVIRGVEKVCDNTGEDPTCSRSVMGNSISDHLTYFGVELMGETWRQCNIVMGHEMESYSRKDSKGNIFLSRTVPSTEVIKTKSISKTGISSL

SEQ ID NO: 68536 - protein, 413 aa, Brassica napus
EECFTKNDVVLANRPNTIASKYVSYDHTTMVTAPYGEHWRNLRRIGAVEIFSAHRLNKFLSIRQDEVRRLIVRLSQNSSHEFAKVEINSMFSDLTFNNIIRMVAGKRYYGDGAEENSEAKLIRQLIADLMNIFGAGNAADYVPILRWVTGFEKRVKELAGRFDEFLQGLVDERRSAKEKGNMMIDHLLSLQETQPEYYTDCTIKGTILSLILAGTDTSAVTLEWALSSLLNHPEKLRKAREEIDSKIGLDRLVEESDISNLPCLQSIVSETLRLYPAGPLMVPHVASEDYKVGGYDMPQGTTLLVNLWAMHRDLQLWDDPETFKPERFEKEGEAHKLMTFGLGRRACPGSGLAQRLVSLTLASLIQCFEWERTGEEEVDMTEAGGVTMPKARPLVAMCRTRTTLVGKIVHESA

SEQ ID NO: 68537 - protein, 520 aa, Zea mays
MDKAYVAVLSFAFLFVIHYLVGRAGRKGNGKGKGTQRLPPSPPAVPFLGHLHLVKTPFHEALAGLAARHGPVFSMRMGSRRALVVSSPECAKECFTEHDVVFANRPRFATQDLVSFGGAALAAASYGPYWRNLRRVATVQLLSAHRVACMSAVVAAEVRAMARRMGRAAAAAPGGAARVQLKRRLFEVSLRVLMETIARTKTSRAEADADSDMSPEAHEFKQIVDEIVPHLGTANLWDYLPVLRWLDVFGVRNKITAAVGRRDAFLRRLIDAERRRLDDGGGDSDSDKKSMIAVLLSLQKSEPEVYTDTMIMALCGNLFGAGTETTSTTTEWAMSLLLNHPEALKKAQAEIDAVVGTSRLLAAEDVPRLGYLHRVISETLRMYPAAPLLLPHESSADCKVGGYDVARGTLLIVNAYAIHRDPLVWEDPDEFRPERFEDGKAEGRLLMPFGMGRRKCPGETLALRTISLVLGTLIQCFDWDRVDGHEIDMAAGGGLTLPRAVPLEATCKPRAAMRHLLLEL

SEQ ID NO: 68538 - protein, 127 aa, Brassica napus
  misc_feature (11)..(11): Xaa can be any naturally occurring amino acid
  misc_feature (22)..(22): Xaa can be any naturally occurring amino acid
  misc_feature (32)..(32): Xaa can be any naturally occurring amino acid
  misc_feature (37)..(38): Xaa can be any naturally occurring amino acid
  misc_feature (40)..(41): Xaa can be any naturally occurring amino acid
  misc_feature (45)..(46): Xaa can be any naturally occurring amino acid
  misc_feature (50)..(50): Xaa can be any naturally occurring amino acid
  misc_feature (58)..(60): Xaa can be any naturally occurring amino acid
  misc_feature (64)..(64): Xaa can be any naturally occurring amino acid
  misc_feature (67)..(68): Xaa can be any naturally occurring amino acid
  misc_feature (79)..(80): Xaa can be any naturally occurring amino acid
  misc_feature (83)..(83): Xaa can be any naturally occurring amino acid
  misc_feature (86)..(87): Xaa can be any naturally occurring amino acid
  misc_feature (89)..(89): Xaa can be any naturally occurring amino acid
  misc_feature (93)..(93): Xaa can be any naturally occurring amino acid
  misc_feature (100)..(100): Xaa can be any naturally occurring amino acid
  misc_feature (103)..(103): Xaa can be any naturally occurring amino acid
  misc_feature (105)..(105): Xaa can be any naturally occurring amino acid
  misc_feature (107)..(107): Xaa can be any naturally occurring amino acid
  misc_feature (112)..(112): Xaa can be any naturally occurring amino acid
MASFTASASTXSIARPALLLKXTVAVSAPVLXLPPMXXRXXGEKXXMETXQGNVSAVXXXVSAXPTXXLTAVMSNPGYXXSLXDRXXNXRGTXLWPFGLXNNXLXNXFLFGXRFSSGTFTFFFGPKN

SEQ ID NO: 68539 - protein, 468 aa, Pseudomonas aeruginosa PAO1
MNARLHATSPLGDADLVRADQAHYMHGYHVFDDHRVNGSLNIAAGDGAYIYDTAGNRYLDAVGGMWCTNIGLGREEMARTVAEQTRLLAYSNPFCDMANPRAIELCRKLAELAPGDLDHVFLTTGGSTAVDTAIRLMHYYQNCRGKRAKKHVITRINAYHGSTFLGMSLGGKSADRPAEFDFLDERIHHLACPYYYRAPEGLGEAEFLDGLVDEFERKILELGADRVGAFISEPVFGSGGVIVPPAGYHRRMWELCQRYDVLYISDEVVTSFGRLGHFFASQAVFGVQPDIILTAKGLTSGYQPLGACIFSRRIWEVIAEPDKGRCFSHGFTYSGHPVACAAALKNIEIIEREGLLAHADEVGRYFEERLQSLRDLPIVGDVRGMRFMACVEFVADKASKALFPESLNIGEWVHLRAQKRGLLVRPIVHLNVMSPPLILTREQVDTVVRVLRESIEETVEDLVRAGHR

SEQ ID NO: 68540 - protein, 389 aa, Mannheimia succiniciproducens MBEL55E
MSVIKMTDLDLAGKRLFIRADLNVPVKDGKVTSDARIRATIPTLKLALEKGAKVMVTSHLGRPTEGEFKPEDSLQPVVDYLKDAGFNVRLAQNYLDGVEVNEGEIVVLENVRINKGEKKNDPELGKKYAALCDVFVMDAFGTAHRAQASTYGVAEYAPVACAGPLLAAELDALGKALKEPQRPMLAIVGGSKVSTKLTVLDSLSKIADQLIVGGGIANTFIAAEGHNVGKSLYEEDLIPEAKRLAAATNIPVPVDVRVGTEFSENAPATEKSVTEVQADESIFDIGDKSAEELAKIIKSAKTILWNGPVGVFEFPNFRKGTEVISNAIAEATANGAFSIAGGGDTLAAIDLFGIKDKISYISTGGGAFLEFVEGKVLPAVEILEKRANG

SEQ ID NO: 68541 - protein, 361 aa, Klebsiella pneumoniae subsp. pneumoniae MGH 78578
MKKTCRIAAIPGDGIGKEVLPEGIRVLQAAAQRWDLSLSFEQMEWASCEYYAHYGKMMPDDWREQLQGFDAIYFGAVGWPDTVPDHISLWGSLLKFRREFDQYVNLRPVRLFPGVPCPLAGKKAGDIDFYVVRENTEGEYSALGGRANEGTEHEVVIQESVFTRRGVDRILRYAFELAKSRPRKTLTSATKSNGLAISMPYWDERVEEMAKNYPEIRWDKQHIDILCARFVLQPERFDVVVGSNLFGDILSDLGPACTGTIGIAPSANLNPERNFPSLFEPVHGSAPDIYGKNIANPIATVWAGAMMLDFLGNGDERYHAAHDGILAAIEQTIACGPKTPDMKGSASTQQVSEAICKAILA

SEQ ID NO: 68542 - protein, 464 aa, Oryza sativa
MASLALVFLALLLPTISWLWDYIIVPHIWRPYIAAKRLREQGIRGPPYKFLKGCNEDVKKMKDAADDLVLDVHDHNYLPRGLVLVEGIDWERHRRVINPAFTMDKIKMMTKTMVACAQNMVKELEDQASSNKNGETQVELDKQFQELTADIISHTAFGSSYKLGIEAFHAQKELQEIAVKSLLNVQIPGFSYLPTKGNWRKLTLEKKLRGTLMQIIQSRLSSKGSGYGSDLLGLMLEACIATDQGREQHQLSLSIDEIIHECKTFFFAGHETTSLLLTWTVFLLSVYPEWQARLRLEALRECGKENPNGDNLSKLKEARKLMSMVFLETLRLYGPALFLQRKPLTDITVGETKIPKDHAIIIPSAIMHRDKEIWGDDTDEFNPLRFQNGVTRAAKVPHALLAFSIGPRSCIGQNFAMLEAKSVMAMILKKFSFTLSPNYVHAPVDLLTLQPKFGLPVVLRLLDA

SEQ ID NO: 68543 - protein, 336 aa, Streptococcus suis
MVVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVITAPGGNDVKTVVFNTNHDILDGTETVISGASCTTNCLAPMAKALHDAFGVQKGLMTTIHGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 68544 - protein, 537 aa, Triticum aestivum
MSGFLAVAGKIVTFLLWVLFLVLQTATKVVGGLLQVAPPAEPQEEPQPEAAPRPRSPPAARNRAGGGPADPYGPQSQLWDPPPPPHTAPVTDEYHSSSIYRRRVSAPQAAEDLVVSSSSYSHSAVAAAPASPAHAVSVPPVSRTIKTPAVASKRPKLERKYSKIVDQYRSLDEVIEALAQAGLESSNLIIGIDFTKSNEWTGKSSFNGVSLHHIGDAPNPYEQAISIIGQTLSAFDEDNLIPCYGFGDASTHDQDVFAFNPDERPCYGFQEALARYREIVPHLRLSGPTSFSPIIEMATTIVEQSGGQYHVLVIIADGQVTRSVNTEFGQLSTQEQMTVDAIVQASEFPLSIILVGVGDGPWDMMNEFDDNIPARSFDNFQFVNFTGIMSKKISQSNKETEFALSALMEIPLQYKATLQLGILGRRLAKSPERVPLPPPFASYNTTSRAAPSWANNFRSVPSNLREEATLDSTITPSVTPPPAADARASELQFCPVCLAKPRDMAFGCGHQTCSGCGPQVVDCPICRRPIDTRVKLY

SEQ ID NO: 68545 - protein, 524 aa, Vitis vinifera
  misc_feature (66)..(66): Xaa can be any naturally occurring amino acid
MTMKISENMLLLFSQSSANQWLLALGILSFPILYLFLLQRWKKKGIEGAARLPPSPPKLPIIGNLXQLGKLPHRSLSKLSQEFGPVLLLQLGRIPTLLISSADMAKEVLKTHDIDCCSRAPSQGPKRLSYNFLDMCFSPYSDYWRAMRKVFVLELLSAKRAHSLWHAWEVEVSHLISSLSEASPNPVDLHEKIFSLMDGILNMFAFGKNYGGKQFKNEKFQDVLVEAMKMLDSFSAEDFFPSVGWIIDALTGLRARHNKCFRNLDNYFQMVVDEHLDPTRPKPEHEDLVDVLLGLSKDENFAFHLTNDHIKAILLNTFIGGTDTGAVTMVWAMSELMANPRVMKKVQAEVRSCVGSKPKVDRDDLAKLKYLKMVVKETFRMHPAAPLLIPHRTRQHCQINANGCTYDIFPQTTILVNAFAIGRDPNSWKNPDEFYPERFEDSDIDFKGQHFELLPFGAGRRICPAIAMAVSTVEFTLANLLYCFDWEMPMGMKTQDMDMEEMGGITTHRKTPLCLVPIKYGCVE

SEQ ID NO: 68546 - protein, 361 aa, Oryza sativa Indica Group
MGNGSIKAYAAVVLIRIMYSVMQVVSKVALDQGMSPLVFIFYRHTAAALVLIPIAFVLERGKAKRVTLKNAGKMFIHALYGVTGCGDLFNLGLNYASATSSSALYNVQPVVTFILAVIFGLESMKLKRFHGHVKSAGILFCIGGVIVLAFYEGPMFKSFNHHHLFQQGSSSSSSAGDTHYSKKQWALGIFLMTLSNVLAGLWNVFQGPLIEDTSKLMNTTTQISFASVQAFVVAVAAERDFSKWKLGWNFGLAAIIYNGVIVTALSYYMQIWTIAKRGPVFLAMSMPLTLIFTIIISSFILGEAVSLGSIVAGILLIGGLFNVLWGKNLEEHDELNKIGPAIPDLEMQDKEAQVPNDRATN

SEQ ID NO: 68547 - protein, 496 aa, Klebsiella pneumoniae subsp. pneumoniae MGH 78578
MMNFQHLAYWQEKAKNLAIETRLFINGEYCAAADNTTFETIDPAAQQTLAQVARGKKADVERAVKAARQAFDNGDWSQASPAQRKAILTRFANLMEAHREELALLETLDTGKPIRHSLRDDIPGAARAIRWYAEALDKVYGEVAPTGSNELAMIVREPIGVIAAVVPWNFPLLLACWKLGPALAAGNSVILKPSEKSPLTALRLAGLAKEAGLPDGVLNVVSGFGHEAGQALALHPDVEVITFTGSTRTGKQLLKDAGDSNMKRVWLEAGGKSANIVFADCPDLQQAVRATAGGIFYNQGQVCIAGTRLLLEESIADEFLARLKAEAQHWQPGNPLDPDTTMGMLIDNTHADNVHSFIRGGESQSTLFLDGRKNPWPAAVGPTIFVDVDPASTLSREEIFGPVLVVTRFKSEEEALKLANDSDYGLGAAVWTRDLSRAHRMSRRLKAGSVFVNNYNDGDMTVPFGGYKQSGNGRDKSLHALEKFTELKTIWIALES

SEQ ID NO: 68548 - protein, 685 aa, Oryza sativa Indica Group
MHAQKNAVVVANDVAIDLHPFIRKYNDGRVERILRSSFVPASEDPAASRGGVAARDVIIDERNGVSARLFLPSGADGGRRLLPVVVYFHGGCFCTESAFGRTYHRYAASLASRAGALVVSVEYRLAPEHPVPAAHDDAWAALRWAASLSDPWLADHADPGRTFVAGDSAGGHIAYRTAVRAASREGGDICIEGLIIIHPYFWGARMLPSEAAWDGESVIKPHQVGEVWPFVTSGKAGNDDPWIDPPVEEVASLTCRRALVAVAEKDFLRDRGRLLAARMRGCAWAGGGDGRNVTVVESEGEDHGFHLYSPLRATSRRLMESIVRFINQPSPAPPPLRWPATILSELHDTTDSSQILLPMPTREYKAVFIDRLEKRTKTGASSANSTAVNASLAIGRGKLATKKSYGLFFGRTRAHIYGGLASAGSLQCPRPFCGAPSSGYSSRPVRAAATGRRRLPIVVYFHGGSFCTESAFCRTYHRYATSLAWRTGALVVSVEYRLAPEHPIPAAYDDAWAALQCRPLGVPPVQYKVDTLWPFVTLVESEGEDHGFHLYSPLRGPRRQAGRSWRASCCRSCTSTSTLRCTQAMAIRRCQGAQLICLRPGRFLLSVPSRPYLAAFRDEPDKVIARSGKRCMEINNALIVGQEKASRRSFGLISARAKPDNWRASKNPLLSASVRLRITMAKNFL

SEQ ID NO: 68549 - protein, 640 aa, Cyanidioschyzon merolae
MATTAGTRRSPSGGALCWAAAPVAAVRFGRWAPPRAHSWTPRRTYPTWSLSLVRSARWCLLRGRRAQVCGAAVMSATEGSSPSSAVRESASSHPAGRAISDAGVIGLAVMGQNFALNLASHGWRVSVYNRTYARTAETVERAQRELAADDTTASGSVTGFADLRSFVLSLKRPRRVFLLVKAGSAVDATVEALAEVLEPGDIIVDGGNEWYENTERRAASVAARGLLYVGMGVSGGEEGARYGPSLMPGGSREAYQQLAPLLEQVAAQVPGSGPCVTYIGPGGSGNYVKMVHNGIEYGDMQLIGEAYDLLRGAVGLDAMAAAEVFASWNAGALQSFLVEITARILRVPDTSSSAASAPALVDQILDRSESKGTGLWTMTEALRRGVAVPTIAAALDGRYLSARKDERERASRVLRGPERLSGTGHASELAAAGASPGAAGAVAETGPDTAPERVAALASGSVRASASTSRSDASAERALIAAIEDALFCSKLCSYAQGLSLLQRASGEQGWSLDLGELARIWKGGCIIRAQLLERIEGAFRRDPSLPNLLLDADLAAEIGRRHESWRRVVGLAASLGVPAPALTASLSYYDTYRQAVLRSSQLVQAQRDCFGSHGYERLDDPGRRWHTRWLSGGDSAEVS

SEQ ID NO: 68550 - protein, 473 aa, Klebsiella pneumoniae subsp. pneumoniae MGH 78578
METNIVEVENFVQQTEERRVSAFAKEVKRYLETYPDTQYVDVLLTDLNGCFRGKRIPVAGLSKLEKGCYFPASVFAMDILGNVVEEAGLGQEMGEPDRSCIPVPGTLTPSAADPQSIAQVQLTMVDEDGAPFDVEPRNVLNRLWQQLRQRGLFPVVAVELEFYLLDRKRDAEGYLQPPCAPGTDDRNTQSQVYSVDNLNHFADVLNDIDELAKLQLIPADGAVAEASPGQFEINLHHTDNVLDACDDALALKRLVRLMAEKHKMHATFMAKPYEEHAGSGMHIHISMLNNKGENVLVDGDGEDSALLKRALAGMIDLMPASMALLAPNVNSYRRFQPGMYVPTQASWGHNNRTVALRIPCGERQNHRVEYRVAGADANPYLVMAAIFAGILHGLDNPQLPLQEEVEGNGLEQEGLPFPIRQSDALWEFMQNDHLRERLGERFCHVFHACKHDELLQFERLITETEIEWMLKNA

SEQ ID NO: 68551 - protein, 498 aa, Cyanidioschyzon merolae
MNKALDSDHPNQAVADVGLIGLAVMGQNLVLNMADHGFKVAVFNRTVSKVQEFLETVAKDRETIFGARTIQEFCALIKKPRKVILLVRAGPAVDDFIEKLQPHLDPGDVIVDGGNSYYQDSTRRMKHCAEHGLLFVGCGVSGGEEGARYGPSLMPGGTEAAWPLLRPVLQAIAARADGEPCCDWVGSGGAGHFVKMVHNGIEYGDMQLISEVYDVMRRGLGLSVEECGDIFAAWNETELCSYLIEITANILKYKDDETGKPLVSLILDKAEQKGTGRWTVESSLEHSVPVTLIAEAVFSRMLSSRKAERVRASKVLQGPPAQPPLNEQDRQNMIEKLRLALYASKIVSYAQGYMLMKEAAAAEDWNLNYGGIALMWRGGCIIRSRFLGKIREAYQDEPNLENLLLYRFFRDALLAAQQSWRDAVVFAVSRGITCPAISTALAFYDGYRAETLPASLLQAQRDYFGAHTYERIDKPENQYFHTNWTGTGGTTTSNAYSA

SEQ ID NO: 68552 - protein, 463 aa, Klebsiella pneumoniae subsp. pneumoniae MGH 78578
MAINPPAHNAAQAGRPRLRKSLKLWQVVMMGLAYLTPMTVFDTFGIVSGISNGHVPASYLLALAGVLFTAISYGKLVRQFPEAGSAYTYAQKSISPHVGFMVGWSSLLDYLFLPMINVLLAKIYLSALFPEVPPWVWVVTFVAILTAANLKSVNLVANFNTLFVLVQISIMVVFVILVVQGLHKGEGVGTVWSLQPFISQNAHLIPIITGATIVCFSFLGFDAVTTLSEETPDAARVIPKAIFLTAMYGGIIFIVASFFMQLFFPDIHRFKDPDAALPEIALYVGGKLFQSIFLCTTFVNTLASGLASHASVSRLLYVMGRDNVFPERIFGYVHPKWRTPALNVIMVGIVALSALFFDLVTATALINFGALVAFTFVNLSVFNHFWRRKGYNKTWKDRLHYLLLPMVGALTVGVLWINLEATSLTLGLVWAALGLLYLTYLTRRFRKPPPQFDAAKAEQAWES

SEQ ID NO: 68553 - protein, 333 aa, Escherichia coli K12
MSKVGINGFGRIGRLVLGRLLEVKSNIDVVAINDLTSPKILAYLLKHDSNYGPFPWSVDFTEDSLIVDGKSIAVYAEKEAKNIPWKAKGAEIIVECTGFYTSAEKSQAHLDAGAKKVLISAPAGEMKTIVYNVNDDTLDGNDTIVSVASCTTNCLAPMAKALHDSFGIEVGTMTTIHAYTGTQSLVDGPRGKDLRASRAAAENIIPHTTGAAKAIGLVIPELSGKLKGHAQRVPVKTGSVTELVSILGKKVTAEEVNNALKQATTNNESFGYTDEEIVSSDIIGSHFGSVFDATQTEITAVGDLQLVKTVAWYDNEYGFVTQLIRTLEKFAKL

SEQ ID NO: 68554 - protein, 178 aa, Cryptococcus neoformans var. neoformans JEC21
MSDVAYIKSLLGVHPDFPKKGITFLDIFPILRDPIAFETLITHFVSHIFNTHKVKPDVIVGLDARGFLLGPVIAMRLGAAFVPVRKAGKLPGSVEVVTYEKEYGVDQFEMQSDAVTPGQKFIIIDDLIATGGSAAAAGELVKKSGGETLEYLFIVGLPFLKGHEKLDAPVYSMIEAED

SEQ ID NO: 68555 - protein, 621 aa, Solanum tuberosum
MKVGFLVCIWFVLCGCCMGRFVVEKNSLRVTSPDSIKEVYECAIGNFGVPQYGGTMVGNVMYPKTNQKSCKNFSDFDIFYKSKPGGMPVFLLVDRRDCFFTLKAWNAQQAGAGAILVADDRVEPLITMDTPEEEDAKADYLQDITIPSALISKSLGDSIKKELSKGEMVNINLDWREALPHPDDRVEYEFWTNSNDECGPKCESQREFVKNFKGAAQILEQKGYTQFSPHYITWYCPEAFILSKQCKSQCINHGRYCAPDPEQDFSKGYDGKDVVLQNLRQACFFKVANESGKPWLWWDYVTDFAIRCPMKEKKYTKECADQVIKSLGFDVKQIENCVGDPEADTDNPVLKAEQDTQIGKGARGDVTILPTLVINNRQYRGKLEKGAVLKAICSGFEETTEPAICLTEEIETNECLESNGGCWQDKAANITACQDTFRGRVCECPVVQGVKFVGDGYTHCEASGALRCEINNGGCWKGTQNGRAYSACIDDHTKGCKCPPGFKGDGVNSCEDIDECKEKLACQCAECKCKNTWGSYDCSCNANLLYMHEHDTCISKDAKSEFSWGLVWTIILGLAVAGVSAYAVYKYRIRRYMDSEIRAIMAQYMPLDQGEGATNVPHGNV

SEQ ID NO: 68556 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLAVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 68557 - protein, 222 aa, Oryza sativa
  misc_feature (64)..(64): Xaa can be any naturally occurring amino acid
MAAAAPATTSSAAARPSSSSSFSRQSDAPLRAATVSFPYSPRPAALAAGARASRVSPVVVAAGXGGHQRLMGSLTNTQGLRFGVVVARFNEIVTNLLLQGALETFERYSVKKENITVVSVPGSFEIPVAAQKLGKSGKFDAILCIGAVIRGDTTHYDAVANSAASGVLSAGLSAEIPCIFGVLTCDDMDQALNRAGGKAGNKGAEAALTAIEMASLFQHHLA

SEQ ID NO: 68558 - protein, 300 aa, Candida albicans SC5314
MYNPYGNAADAYQQQQQQQYQQQQQQPHSTNLQHPQPIHHVSSHQPPPGAAGGQFNFLNDPAAALASQFARSGFEQSNQYLQENFGSLQGDIKYYFQVSNSYVFKKIILILMPYNHKDWNRVSTKETGTNQFLPPNLDINAPDLYLPLMSFVTYILLWAAFQGINGDFHPQLFGYLASQTIAFSVLDVVIFKTGLYLLNCPQSKIYDIISFSGYKYVSIIVLLILKYLVGNYLGLFYYIVVLLLIANLSIFLMRSLRFLILPQSTSMNNTITSKQRKIRIQFLFVYSVIIQGLIILYMSK

SEQ ID NO: 68559 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKADIDVKDQKAVDDFLISLDGTANKSKLGANAILGVSLAASRAAAAEKDVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 68560 - protein, 314 aa, Arabidopsis thaliana
MESTKKQVSLELLPWLVVHTDGTVERLAGTEVCPPGLDPITGVFSKDIIIEPKTGLSARIYRPFSIQPGQKIPLMLYFHGGAFLISSTSFPSYHTSLNKIVNQANVIAVSVNYRLAPEHPLPTAYEDSWTALNTIQAINEPWINDYADLDSIFLVGDSAGANISHHLAFRAKQSDQTVKIKGIGMIHPYFWGTQPIGAEIKDEAMKQMVDGWWEFVCPSKKGSDDPWINPFADGSPDLGGLGCERVMITVAEKDILNERGKMYFERLVKSEWKGKVEIMETKEKDHVFHIFEPDCDEAMEMVRCLALFINQVEA

SEQ ID NO: 68561 - protein, 290 aa, Oryza sativa Japonica Group
MEESRADGRNPNQLRPFSCTRNPLDRAHGSARWAQGDTIVLAAVYGPKPGTRKGENPEKASIEVVWKPMTGQIGKQEKEYEMTLKRTLQSICLLTVHPNTTTSVILQVVGNDGSVSFCRNVLLSIVSGCLLDYEHSLVFAGIPLKHLAVAIGCGVLEDGEVILDTNKAEEQQLKSFAHLVFPNSRKSASSKEPNQKEEDSERGLITSITHGVMSGRLFQLHREGPCCIVTDLGFYEDNIAEAGTWRCLRGGNHAIENASTLQKHKVVAAHVLNMKRVGTLGALLMFEIGS

SEQ ID NO: 68562 - protein, 177 aa, Zea mays
FAIGSAALVSLRLFGAFVSRAAISTVDVLTPEVFIGLIVGAMLPYWFSAMTMKSMGSAALKMVEEVRRQFNTIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAA

SEQ ID NO: 68563 - protein, 259 aa, Zea mays
  misc_feature (194)..(194): Xaa can be any naturally occurring amino acid
MAMAAIASPSSRTLIPPRHHGAAPSPSTSGDSSLRLLRAHPRHGRRGRAVSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNDGFVEVLAAQQSPDNPNWFQGTADAVRQYXLWLFEELNVMEFLILAGDHLYRMDYEKFIQAHRETDADITVAALPMDEKRATAFGLMKNDEEGRI

SEQ ID NO: 68564 - protein, 408 aa, Moorella thermoacetica ATCC 39073
MPEQVLLEIGLALAIVAFAGILAARFRVSIVPLLILAGMVVGPHAPVIGILDFRFIKSAPLIDFMGRVGILFLLFSLGLEFSVGRLLKAGRSILVGGSIYMAINFTLGMVLPIIWGWPLRETLVVAGLISISSSAIVAKVLVDLKRTARPETEMILGLMLFQDVFVAVYLSIISGLVLTGSASPASVLKSTSLALGFMLGLILAGRKLAPLINRLLNVPSDEVFMLIVFAFLTLVAGFSETIHVAEAIGALLVGLILAETDHLDRIEHIVVPFRDFFGALFFFSFGLSIDPLTLGGAVGPVLTAVAATLTGNFLAGILAGRMAGYSYRGCTNIGLTITPRGEFSIILANLAKTGGLLPVLQPFAALYVLLMAILGPLLTKESKWIYNQLAHIFGWPAWKEINKPDRTI

SEQ ID NO: 68565 - protein, 379 aa, Staphylococcus aureus subsp. aureus MRSA252
MAKRDYYEVLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINDQPSNFKDRAKRFFKGE

SEQ ID NO: 68566 - protein, 371 aa, Methylococcus capsulatus str. Bath
MTLNTIEEIIEDIRQGRMVVIMDDEDRENEGDLVMAAGHVRPEDINFMARYGRGLICLTLTRERCQQLRLPLMVNENRTPHSTNFTVSIEAATGVTTGISASDRARTIQCAVAPDARPDDLVQPGHIFPLMAQPGGVLNRAGHTEAGCDLARLAGLVPAAVIVEILNEDGSMARRADLEKFAAVHGLKIGTIADLIHYRMQNEQTVERICECDFPTEHGRFRLHAYQDRLDNKLHLALTLGDVAGGEPVLVRVHGRNLLTDLFGVRRGDIGISLRAAMKRIADEGRGVLVVIRNEEDDRCLVERIHQYQMEDHGVDIGQREDPGVDWRTTGTGAQILADLGVRKLRVLGAHKKYLGLSGYGLEVVDYVTTD

SEQ ID NO: 68567 - protein, 110 aa, Lilium longiflorum
MISSANNKGAGTSRRKLRSEKAALQFSVSRVEYSLKKGRYCRRLGATAPVYLAAVLENLVAEVLDMAANVTEETSPIVIKPRHIMLAPRNDVEVEQAVSRCHHLGIRCRP

SEQ ID NO: 68568 - protein, 159 aa, Methylococcus capsulatus str. Bath
MAHIKIFEGGMNAAGLRVCIAASRFNSFIVDHLVSGAVDALIRHGASREDICIAKTPGAYELPLAVKKIADSGRFDAIIALGAVIRGATPHFDYVAGECVKGLAGVSLQHGLPVAFGVLTVDTIEQAVERAGTKAGNKGAEAALSAIEMVNLLRQLGAE

SEQ ID NO: 68569 - protein, 80 aa, Triticum aestivum
MSEESGRPLPKFGEWDVNDPASADGFTVIFNKARDEKKAGNGQDTESPCKDARTERVESYATKANSKKWFCCVTPSPTQS

SEQ ID NO: 68570 - protein, 436 aa, Mannheimia succiniciproducens MBEL55E
MAKIVKVIGREIIDSRGNPTVEAEVHLEGGFVGLAAAPSGASTGSREALELRDGDKSRFLGKGVLKAVGAVNNEIAGAIVGKDASNQAEIDQIMIDLDGTENKSKFGANAILAVSLATAKAAAASKGLPLYAYIAELNGTPGVYSMPLPMMNIINGGEHADNNVDIQEFMIQPVGAKTLREALRIGAEVFHNLAKVLKAKGLNTAVGDEGGFAPNLGSNAEALACIKEAVEKAGYVLGKDVTLAMDCASSEFYNKENGKYEMKGEGRSFTSQEFTHYLEELCKQYPIVSIEDGQDESDWEGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAPFLGLKAVKGQA

SEQ ID NO: 68571 - protein, 477 aa, Cyanidioschyzon merolae
MIAFVINSATKAAVSPLKGQICRGLPKNPSFAASTWLGQAALSTRPRSSQGRGRSGVRESAATRARAPVCVQTSDVAMRVRSIRDLQDAEIRGKRVFVRSDLNVPLDGKRITDDTRIRASVPTIKYLADKGAKVIVVSHLGRPKGGFEDKYSLAPVAERLSELLGKKVRMAKDCIGDAVATEVAAMSPGDVVLLENVRFYPEEEKNDPDFARKLAANADLYVNDAFGTAHRAHASTEGVTAFLKPAVAGFLLEKELDYLSNAIESPKRPFAAIVGGSKVSTKIAVLEKLLQKCDTIIIGGGMVFTFLRARGLKTGSSLVEEDKIELARVIEEEARKRGIELLLPLDVVVADKFANDANTKVVPVEEIPDGWMGLDNGPETTRMIQEKLRTMKTVLWNGPLGVFEMPNFAKGTFAIAETLAEITQNGCITIVGGGDSVAAMEQSGKADKVSHISTGGGAALELIEGRVLPGVAALQRA

SEQ ID NO: 68572 - protein, 644 aa, Cryptococcus neoformans var. neoformans JEC21
MVGRRRGKSGKIGQFFERIPLYFSYLILTSVWLLFMLFITLGEVLIKRRQIGRFLEQVITFNTLLFFTVLSLITTSLRSPGSPDQTFAPTSYVPGFSLVRQRQERKQHLSKNNHLPVRPPIGKSKLKINIKTEPPPSLKFLRNPQWVSSRLHKDRPSPLPLFKNQSYPSIPSTADSPPSENEKGSCESNNMGWSDLGSESELESDYSPFPLSLSSRNSDRDKDVERNGDGGERDPLLILEEGRVPAHADMSEKVDSPTSTSTSTPAIDTSGKIQPRWCKRCDAWKPDRTHHCRHCHRCVLKMDHHCPWVGTCVGYRNYKPFLLFITYGTLLAIYTTFETGYEVYLYFFHPLDHPLPSHLGDLSSPSPLPAPVSLQLGPAVSIMLLTMGIFITFSVGGLACFHWWLASKNMTTLESITHSYPTSLLSSLPSNHNTSLSSPPATAPNLSYKQRQSLSRRAQEINVYDLGWRRNLKQVFFGGHNRHRDRGPDLGDGGRCEDEDKRVTIGMVLGAMWPTKIGYDQSDPIAGSGYDFPYDPCALERLKTLTEKLRSSTLTFDDGDACDPCDREDGGEGTSDVGSGCENEEDEYHDEENANGFGGKKAKYEAMDEKLTMPDPDKVDTSRRKKRLAVPMKNHERGVKWFEV

SEQ ID NO: 68573 - protein, 583 aa, Penicillium marneffei
MYNAHRGMVPAPNNRLTELLEQLRQEFESQSRSTGEFEHQLTGQIQEMEMIRQKVYQLEQAQIKIKAEYENEIRVLRHELESRGVQTVPSHVGGPTHAGPSQAPPALGHGTNNLFGGIMANQGGSGPGLAPPPPQEQQPPQHGLQQPAPAAQQGPPQPPQSSYGGYQPSAGVNGYGPPPPPTASPGPGKGRGRAPPGPATPQQTHQLNYPAPGASPQIPRPTPTGQLVRERPGNTLANWNPDDLPASQKREGPDWYAVFNPEVQRVLDVELVHHLVHDSVVCCVRFSRDGKYVATGCNRSAQIFDVATGQNVATLQDESVDKDGDLYIRSVCFSPDGKYLATGAEDKQIRVWDIATRSIKHVFTGHEQDIYSLDFAGNGRYIASGSGDKTVRLWDVLEGKLVYTLSIEDGVTTVAMSPDGHYVAAGSLDKSVRVWDTTTGYLVERLENPDGHKDSVYSVAFAPNGRDLVSGSLDKTIKMWELTAPRGMLPGTGVKGGKCVRTFEGHKDFVLSVCLTPDGHWVMSGSKDRGVQFWDPNTGSAQMMLQGHKNSVISVAPSPTNNLFATGSGDMRARIWRYVEFPE

SEQ ID NO: 68574 - protein, 117 aa, Helicobacter pylori
MKIKNILLSGGSGKRLWPLSRSLYPKQFLKLFNHKSLFELSFKRNASLVDETLIVCNEKHYFLALEEIESEIKNKSVGFLLESLSKNTANAIALSALMSEREDLLIVTPSDHLIKDL

SEQ ID NO: 68575 - protein, 523 aa, Yarrowia lipolytica
MSNALNLSLALGVFLLAYYGFSVIQYRIKTRKLEKKWKCGKPKDISRFPFSASFFIPFLVESKKNRLLEFVQWMFESQVYPGYTCKTTVFGVDMYHTVDPENLKAVLATQFKDFCLGERHAQFLPVLGNGIFTLDGQGWQHSRAMLRPQFARDQVSDVEMIEEHIQYMTSRIPKDGSAFDAQELFFNLTLDTATEFLFGQSVGSQTVETNPTAVPTDMPVHLRKSFQEDFNTAQEHLGQRARLQMFYWAWRPRELYSSGERVHAFVDHYVKKALEESEKHVDDGKYVFLRELAKETKDPIVLRDQALNILLAGRDTTASLLSWCLYLMARRPEVYAKLREEVIENLGDGEDLSTITFESLKRCDYLRYVLNEVLRLYPSVPANMRYATRDTTLPRGGGPDGMQPIVVRKGNLVSYHVFTTHRLKEFWGEDAEEFRPERWYEDGASQAKGWEYLPFNGGPRICLGQQYALTEAGYALARIAQLYDTIENADDKPEPPVKFHALTMCHHTGVLVKLYNSKTTKAQ

SEQ ID NO: 68576 - protein, 261 aa, Glycine max
  misc_feature (211)..(211): Xaa can be any naturally occurring amino acid
  misc_feature (228)..(228): Xaa can be any naturally occurring amino acid
  misc_feature (254)..(254): Xaa can be any naturally occurring amino acid
MGSGNHEVSMLMENGGGGNIVKGLSKEMRHGRTAHNMSSSSLHKKSDLTLVSKVHSIPLRNVLVNLQEVVLGTKLSILFPAIPLAVVAQCYGFGRPWIFALSLLGLTPLAERVSFLTEQLAYYTGPTVGGLLNATCGNATELIIAIFALSNNKIHVVKYSLLGSIISNLLLVLGTSLFCGGIANIRKEQKYDRRQADINLLMLFVALLCHXLPVLFHYVGASAADTAXVILCSCQELLAMVMVIAYCAYLVFQXWTHRQLF

SEQ ID NO: 68577 - protein, 343 aa, Triticum aestivum
  misc_feature (113)..(113): Xaa can be any naturally occurring amino acid
MSVSNIGMMDGAYFVGRNEILAWINTTLQLSLAKVEEAASGAVACQLMDAAHPGAVPMHKVNFDAKNEYDMIQNYKVLQDVFNKLKITKHIEVNKLIKGRPLDNLEFMQWMKXRYCDSVNGGFMTSYNAFERRESSKGGKDTNRRTSGTSQAPAKSASATHKAQPPPHAAKRANGHASNAPQRCAKPPPAAAPAYDAQMTELKLLVDSAEKERDFYFSKLRDVEILCQSPEVEHLPIVKAIQKILYASEDDPSTVAEAQAEMVAQQNQMQQQPMLSPILEASEAPSITPKDSSEESLRQEAAAAHKRKSISDLEEFEMGSSSRMRLSDVSDVQLCGSPLMSFT

SEQ ID NO: 68578 - protein, 290 aa, Streptococcus agalactiae 2603V/R
MVTIEKIDEAIHRYYKQTHSVVSPDLIKAILYSVDGGGKRIRPRILLEILEGFGVELIDGHYDVAAALEMIHTGSLIHDDLPAMDNDDFRRGRLTNHKKFDEATAVLAGDSLFLDPFDLVVKAGFKADVTVRLIELLSMSAGSFGMVGGQMLDMKGENKVLSIDDLSLIHINKTGRLLAYPFVAAGILAEKSEEVKGKLHQAGLLIGHAFQVRDDILDVTASFEELGKTPNKDIVAEKTTYPNLLGLDKSQEILDDTLKKAQAIFQNLEKKANFNARKIIDIIEGLRLNG

SEQ ID NO: 68579 - protein, 444 aa, Saccharomyces cerevisiae
MKQRFIRQFTNLMSTSRPKVVANKYFTSNTAKDVWSLTNEAAAKAANNSKNQGRELINLGQGFFSYSPPQFAIKEAQKALDIPMVNQYSPTRGRPSLINSLIKLYSPIYNTELKAENVTVTTGANEGILSCLMGLLNAGDEVIVFEPFFDQYIPNIELCGGKVVYVPINPPKELDQRNTRGEEWTIDFEQFEKAITSKTKAVIINTPHNPIGKVFTREELTTLGNICVKHNVVIISDEVYEHLYFTDSFTRIATLSPEIGQLTLTVGSAGKSFAATGWRIGWVLSLNAELLSYAAKAHTRICFASPSPLQEACANSINDALKIGYFEKMRQEYINKFKIFTSIFDELGLPYTAPEGTYFVLVDFSKVKIPEDYPYPEEILNKGKDFRISHWLINELGVVAIPPTEFYIKEHEKAAENLLRFAVCKDDAYLENAVERLKLLKDYL

SEQ ID NO: 68580 - protein, 460 aa, Magnaporthe grisea 70-15
MATTKSAFLHRSLKEFPAQVVEAKDKTLVFSDGTKVLDSTCGAAVACIGYNNDLSERVKQAMIRQMDKFPYCNSFFGHEVGEQLAQELMDGTGGAMSKAYIVNSGSEAMEGTMKMARQYFLELQPPQPSRINFIAREGSYHGTTLGALSMSGHVGRRSKFLDLLLPNVARVSRCDAYRGMKEGQSVAEYVEQLADELDKKFQELGPETVCAFVAEPVVGATLGCVPAVPGYFEAMRKVCDKYGALLILDEVMSGMGRSGTLHAWQQEGVVPDIQTIGKGLGGGYAPVAAFMINHRVADTLESGTGEFMHGHTYQGHALGCAAALEVQRIVREENLIDNVKQRGVQLEKLLQQHLGNHPNVGNIRGKGLFWGIEFVADKASKEPFPRSVDLANKVNRAGVKEFGVSLYPGTGTKDGVLGDHVILAPAYNCTADEIEEIVIKTKETVARVLRVKNAETATSA

SEQ ID NO: 68581 - protein, 345 aa, Thermoplasma volcanium GSS1
MKKYLVMEDGTVLSGQGYGSYKEAYGELVFTTSMTGYLETLTDPSYVGQMLVFASPTIANYALEMGKMESNGVKVSALITKDAHIELKKGGYGREFDEFLKEQGIPGIDGIDTRMLVRKIRANGVLRSYVVNDPSHSLDFPDPMNDDLVSKAVPHHDPVFVKGEEGGTVLFIDLGSKNTLKELMLQNFSLIVVDKQTNLDEIEGYDAIFVSNGPGDPSHPSLSNVIKFLSHNIGVKPLFGICFGLQAISLAYGAKTYKMKFGHRGSNHAVTDGTHSYVTTHNHGYAVDGSTVKDFKVIGWDANDGTVEIIEGDDMFAVQFHPEASPGPHDTRWFFGEMKRRIGYA

SEQ ID NO: 68582 - protein, 350 aa, Arabidopsis thaliana
MSSSNTPSSSAAAAGSIDSSAARRNSKRPKYSKFTQQELPACKPILTPGWVISTFLIISVIFIPLGVISLFASQDVVEIVDRYDSACIPLSDRANKVAYIQGTGNKSCTRTLIVPKRMKQPIYVYYQLENFYQNHRRYVKSRSDSQLRSVKDENQIDACKPEDDFGGQPIVPCGLIAWSLFNDTYVLSRNNQGLTVNKKGIAWKSDKEHKFGKNVFPKNFQKGNLTGGASLDPNKPLSDQEDLIVWMRTAALPTFRKLYGKIESDLEKGENIQVTLQNNYNTYSFSGKKKLVLSTTSWLGGKNDFLGIAYLTVGGICFVLALAFTVMYLVKPRRLGDPTYLSWNRIPGGR

SEQ ID NO: 68583 - protein, 164 aa, Brassica napus
MESTRPEDPEIDDDFSEIYKEYTGPVTTTTIVQEKPKLPEDKCDEEEEQQELPDPNSVPTDFTSREAKVWEAKSKATERNWKKRKEEEMICKICGESGHFTQGCPSTLGANRKSQEFLERVPARDKNVRALFTEKVVEKIECETGCKIKIDDKFIIVSGKDRLI

SEQ ID NO: 68584 - protein, 352 aa, Cryptococcus neoformans var. grubii
MGCTQSTEDVAAKARSAEIDEQLKRDRANLRNEIKMLLLGAGESGKSTVLKQMRLIYNKPYDAEERDSYREIVYSNTVQSMRVLLEGVQFMDIPIDTSNQSRWELIMAAPPQIEGDVFPSKLTDAVAGLWKDYGVQQAFFRRNELQLNDSAPYYFDAIARIAQPNYMPTDQDILRARVKTTGITETHFKIGELTYKLFDVGGQRSERRKWLNIFDSVTALVFLIAISEYDQKLYEDESVNRMQEAMTLFESVANSRWFTKTSIILFLNKIDIFREKLPVSPLSNTFPEFRGGNDYDMACAFLLEKFVGLNNSPSKSIYAHYTDATDTKALKFVISAINDVIIQVNLRDCGLL

SEQ ID NO: 68585 - protein, 590 aa, Thermoplasma volcanium GSS1
MNDNSNLVSGKLRKSLNSTDLFFLAVTGMIGSGWLFAALDTASYVGPGSIFTWMIAALFFFVIALAFAELSSIIPYSGSIVRFNQYSHGSISNFMIGWAYLIGAVSTVTVEAISLVTYTSTYMPQLYNSSVGVLTPLGIIVSIFLILFFFFIQFMGVNVYGKLNTVLTTWKIAIPVITVVLLMSFSFHPGNFKVAHGFLPYGTSAIFAALIPSGVVYAFEGFRQGIEYAGEAKNPQRDVPMSLIAALLVTIAIYVALQIAFIGSIRWSDLSLSPGDWTLLSKSTWASGPFYYATKYSGVAILAIFAIVILIDAFISPLASLGVYEGTSARSFYGLSRLNVLPEFFGSIHPKFRTPWVGLIFTLIISSLFLAPFPSWYLIVGINASFTVYAYLSAGTTNSVLRKLAPDLNRPFKLPFATVLSPVAFVAASMLVYWSGWSIIDFLILIVYAGLPLLILSKFRESLDITSREAIALSAVYWILLSIVGYFGYISYIPFEVYWPILNSIPAITFAFLYIRSRSNEVVSSVWIIVYNSILGTMSYFGSLGTNAIAYPYDYLIFAALSFFIFFVSVKTGIETNELTELKRSGPVPE

SEQ ID NO: 68586 - protein, 395 aa, Methylococcus capsulatus str. Bath
MPGRNHLYVPGPTNIPDAVLSAMHVPMEDHRRPDFPALVTPLLENLKKVFRTEAGQCFIFPATGTAGWEIALSNTLSPGDKVLSYRFGQFSHLWIDLARRLGLEVEYEEVPWGQGVPLDRLEARLKADTAHEIKAVLICHNETATGVTNDLPAVRKAIDAAGHPALFYVDGVSSIGSLDFRMDEWGIDIGVAGSQKGFMLPAGLALLGFSQKALKARESAKCKRAFLDINDHILHNAGGFFPYTPSIPLLYGLRKSLELLLEEGLENVYARHARLAEGVRRAVAAWGLQLCAQDPKWYSNTVSAVVVPPEFDARDVIHTAYFRYNLSLGAGLSEVSGKVFRIGHLGDLNELSLASAIVGSEMAMLDVGIPLTPGSGIAAASAHWRETAPVIQPRV

SEQ ID NO: 68587 - protein, 332 aa, Saccharomyces cerevisiae
MIRIAINGFGRIGRLVLRLALQRKDIEVVAVNDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLEKEATYDQIKKAVKAAAEGPMKGVLGYTEDAVVSSDFLGDTHASIFDASAGIQLSPKFVKLISWYDNEYGYSARVVDLIEYVAKA

SEQ ID NO: 68588 - protein, 576 aa, Schizosaccharomyces pombe
MQPQEVDLMENSTMRNGARVLPPEAISKRHIGPYIIRETLGEGSFGKVKLATHYKTQQKVALKFISRQLLKKSDMHMRVEREISYLKLLRHPHIIKLYDVITTPTDIVMVIEYAGGELFDYIVEKKRMTEDEGRRFFQQIICAIEYCHRHKIVHRDLKPENLLLDDNLNVKIADFGLSNIMTDGNFLKTSCGSPNYAAPEVINGKLYAGPEVDVWSCGIVLYVMLVGRLPFDDEFIPNLFKKVNSCVYVMPDFLSPGAQSLIRRMIVADPMQRITIQEIRRDPWFNVNLPDYLRPMEEVQGSYADSRIVSKLGEAMGFSEDYIVEALRSDENNEVKEAYNLLHENQVIQEKSHLSKSKRVDSFLSVSPPAFSEYTSELQKKSKQELIDPTLEGPRWTVSDPPTYAKQTIDSNICVLVPTAEKNKLEMRTLADAASAVDTSQSTRKKSRRNKWHFGVRCRGDAPEILLAVYRALQRAGAQFTVPKPVNGKYRSDMYTIKSRWEIPHCKREGKNTYAYIELQLYEVMPGCFMLDVKSNGYKDIYSHPERTADHGMDDLKSSSPFSDLCAMLVCKLFSA

SEQ ID NO: 68589 - protein, 510 aa, Plantago major
MENSNRGVGAKTIITTTPPPEEAAPIRNIFLVAAIAAGVQFGWALQLSLLTPYVQLLGIPHKWASYIWLCGPISGMIVQPVVGYFSDNCTSRFGRRRPFIAAGAGLVGVAVVLIGFAADLGHAGGDSLGDGLKPRAIGVFVFGFWILDVANNMLQGPCRALLADLSGGNTKKMANANSFFSFFMAVGNVLGYAAGSYSRMYKVFPFSKTKACDIYCANLKSCFIISITLLITLTTLALSIVREKRHVAEEQVTAAKKGFKIPVFPELFGALKDLPRPMWVLLLVTALNWIAWFGFLLFDTDWMGREVYGETQQHKAPELAVIYNKGVSAGALGLMLNSIVLGFASLGVQYMARALGGVKRLWGVVNFILAICLCMTIVITKVASHHRPYSNGVLQTPESSVKIGALVVFSALGIPLAITFSVPFALASIYSTTTGSGQGLSLGVLNLAIVIPQMIVSVASGPWDAMFGGGNLPAFVVGAVAAAASGIFAFTMLPSPPAESIKNLSVAGGH

SEQ ID NO: 68590 - protein, 820 aa, Vitis vinifera
  misc_feature (38)..(38): Xaa can be any naturally occurring amino acid
  misc_feature (68)..(68): Xaa can be any naturally occurring amino acid
  misc_feature (90)..(90): Xaa can be any naturally occurring amino acid
  misc_feature (242)..(242): Xaa can be any naturally occurring amino acid
  misc_feature (534)..(534): Xaa can be any naturally occurring amino acid
  misc_feature (724)..(724): Xaa can be any naturally occurring amino acid
  misc_feature (780)..(780): Xaa can be any naturally occurring amino acid
  misc_feature (799)..(799): Xaa can be any naturally occurring amino acid
MAENAQQERGRSASTGMEFLTYRMREGEFGRGFLEILXLLSILDLKNEEKTQKAVTHIEYCFLVPTCXQQASFYHSDNQYRHYNLTNVFXELSNLFILDTGERPVEPANLREQPNLLEDERVPRVVTDQPISFDAIGDFNAGYPQDAYASINRPFYYGGYDNSTSYWDGYPHYVNADSMQVFPPVIYNDNPSLVFSSGYGFNPQMAYGQYTNVATPLPSLMVDRQLYSPHQNPFSQPYYPQXIPSVPNISSAVSVPQTELMAPESSVQEGFSGNMRSSQGSSYVIQFGSFGRGGLSQNSAYGPGSSNFQGEFVPPNFLPNQSNLPEADVSLSSVTSQAAHPQPVGILGSYEHNVRQRAAHGLGLVPSSSNIFYPDGGLYESTNFGGASVSPLGANDRNRLILDKGKIRERDRSSGVFSTDSSNFSSDRNRGPRASKPKGQSTSGQGVSSSSRKSDASNSVVHFDSYNQPDFVTDYENAKFFIIKSYSEDNVHRSIKYSVWASTALGNRKLDAAYQKAKEIETNCPIFLCFSVNXSSQFCGVAEMVGPVNFEKDAEYWQQDRWSGLFPVKWHIIKDVPNSLFRHILLENNENKPVTHSRDTQEVNLEQGIEMLKIFKSYDAHTSILEDFDFYEQRERASKERKARQQACSTTKSPGSEESVNHVSNSFSQSLQLEESNREVIATEWGDNSRTESGAHCLEESGEAVEPERGCSTTTGALVSLADXSMNQMSDSFAQTLRLEGSIKELRAASSSGTDAEVSLDDAITLMTLESKKNNKELPXAGRINSPRPDAFVSLVDYXKGQISDSSVQSPQLEESSKEV

SEQ ID NO: 68591 - protein, 106 aa, Glycine max
SMIFFPAGTTVNRAGARMGGSFTGLKFMGGFPTKKNNHDLTFIGCNRGRIPCMPVWAPIGKKKFETLFYLPDLDDAPLGKEVEYLLRKGWISCVEFELEHRFVYRE

SEQ ID NO: 68592 - protein, 490 aa, Borrelia burgdorferi
NKETKLKDLENQEFDLIIIGGGATGLGIAVDAITRGYKAILIEKFDYAKGTSSRSSKLIHGGVRYLAQWNISLVKEALREKAILEKNAPHLINECALITPIYNVLEIPYYYFGLSYYHNLMGKEKTTKYKTKLLSKKSTIEKAPNIKTEGLKCSVLYYDDSFDDARMAITLLRTFTEKGGIALNYTELKKFNKENGKLSGVLIQNKLSKEQISLKSKCIINATGIFSDEIRRLDDEKALNIIKPSQGSHLVVKKDKFPKNHAILIPKTSDNRILFAIPWYDSVVCGSTDIPIKEIEEEPKRFEEEIDFIINNLNNYLNIKIEKSDVKSVYTGIRPLIMDPKAQGNTSKISRNEKIFISDSNLITIAGGKYTTYRKMAEKTLLKAIEQNLIPNRAPTTEDLKLHGYLKKEEAMKIPEPFRAYGSDFEILKNMEGFDKKIHENLDLNEAQIDFSIKFEQAKTIEDVLARRTRSLPLNPQATIEAAPRVAEIM

SEQ ID NO: 68593 - protein, 480 aa, Oryza sativa Japonica Group
MAVALEAGRRKRAAVVVLGDIGRSPRMQYHSLSLANQAGMEVDIVANGGSDPHLLLRENPSIHIHEMKSVQLTGILKISGALTLLLKAAIQFIILIWYLCFKIPRPDVFIVQNPPSVPTLAAVKLASWLRGAKFIVDWHNFGYTLLGLSHGRSHIIVKIYFWFEKHFGRMADGAFCVTKAMKHELDQKWGINHSKYLIAVRKFHFDIVSTVCSYNTEKEVEDRNTTVFTSWVDGEIFLKPNRPALVVSSTSWTPDEDFSILLEAALMYDRRVAATLGEDDSMDEGKLWIDIKNGKQFVYPRLLFIITGKGPDRMKYEEQIKRLKLRRVAFRTMWLASEDYPLLLGSADLGVSLHTSSSGLDLPMKVVDMFGCGLPVCAASFSCIDELVKINNNGLLFSTSSELADELMMLFKGFPEECDDLKSLKVGALNTGSSSKWSTEWERYALPLVNQSPEYALPISFVRKFAVAGHRLKCMITFDR

SEQ ID NO: 68594 - protein, 281 aa, Zea mays
MESEGAGEHFVERADGSGHVVWTSAMSAYMLSNLASLVAEGIRTSTGFKKVHLNMCAKALNDYFKMKLTGEQVKNHLRTWKRRYAKINRLRKLSAASWNEDNYMITLDHEHYANYVQDHKSDAEFLNKPLENYKEMFIVFGNNMATGKYAKGSSEALGTEDRNSMAETEIDEGDGNAVPSPIDDIGASSSAPRPRKEAKVTGNEEAGLIGAFEDGAERLAMAIEKAGSDDLPPDLLQTLQSIPGFDDTHKAFYFAYLMKNPGLAMTYQISLLAWFVSETFP

SEQ ID NO: 68595 - protein, 320 aa, Triticum aestivum
  misc_feature (118)..(118): Xaa can be any naturally occurring amino acid
MVGGGRRGGAADEAKLNTGNVFAALETLKKKKKGDKAKGGSSKGGKQGDEPTPQQQKELFWAPAPLNTKSWADVEDDDDDDYFATTAPPAPIWGNDHAAAKTAKEEEEDEVDAVHAAXLPEEIESEDEEHDDEAEDGAEDEPEHEVEAADPDVKKVAAAPKETERQLSKKELKKKELAELDAVLAELGISENTSDAAQDGNNNAEKKGASQAGDGERKEDAPAPLESKNAKKKKNKKDKSAKEAKEAEVSEEAASAEPEEDTAVDVKERLKKMASMKKKKSGKETDTAAKIAAAEAAARTARLAAAKKKEKSHYNQQPVR

SEQ ID NO: 68596 - protein, 397 aa, Triticum aestivum
MSDNLMDKVNALGERLKISGAEVSRKMSTGVTSMSFKMKEFFQGQNMADKIVDEATLETMDGPDWATNLEICDMANTERVNSVELIRAIKRRIMLKSPRVQYLALVLLETIVKNCEKAFSEIAAERVLDEMVKLIDDPQTIVNNRNKALMLIEAWGESGEELRYLPVYEETYKSLRSRGIRFPGRDDESLAPIFTPPRSVPAAEPYSDAAQDGYQEIPDESFAPVRAAPSVQVDEAFEVARNSVELLSTVLSSSPQKEALEDDLTTTLVQQCQQCQYTIQRIVETAGDNEAQLFEALSIHDELQKVLSKYEDLKEPIVAEPEPEPAMIPVTVEPEESPRAVGKDTPSRKSAGSGGRSSGGDDLLQDLDDMIFGKKAGTASQQERTPRKEQKDDFIGL

SEQ ID NO: 68597 - protein, 488 aa, Geobacillus kaustophilus HTA426
MAVQTEIKTYLNYIDGSWVGSVSKNVEPSINPANRNDIVGYVPRSTLEDLNAAVAAAKQAQKSWWKRSGIERGEYLYKAALLLEQRLEDIAETMTREMGKTLAEAKAETMRGVHILRYYAGEGARKIGDVIPSSDSGGLMFTTRVPLGVVGVISPWNFPVAIPIWKMAPALVYGNTVVLKPASETAVTAAKVIECFHEAGFPKGVVNMVCGSGSVIGQGIANHPDVDGVTFTGSNTVGKQVGRAAFERGAKYQLEMGGKNPVIVAKDADLDLAVEGTISGGLRSTGQKCTATSRVFIEREVYEPFKEKLLERVKQLKIGNGMDAETWMGPCASESQLNTVLSYIEKGKAEGAKLIYGGNRCTEGELANGFYVEPTIFEEVDLQMTIAREEIFGPVLVLIPVDSIEEAIELANDTEYGLSASIYTKNIGNILDFIKDIEAGLVKVNAETAGVEYQAPFGGMKQSSSHSREQGQAAIEFFTTIKTVFVKA

SEQ ID NO: 68598 - protein, 480 aa, Zea mays
  misc_feature (344)..(344): Xaa can be any naturally occurring amino acid
LGDGRAIALGEVVNSRGERWELQLKGCGKTPYSRFADGLAVLRSSIREFLCSEAMHGLGIPTTRALCVVETGKSVVRDMFYEHSGFISLNDSLLHVFLLFDACTGGNVLLGNAKEEPGAIVCRVAPSFLRFGSYQIHASRGKEDIEIVRRLADYTIHHHFPHLENMKKSEAWAVEVAERTAYLIARWQGVGFTHGVLNTDNMSVLGLTIDYGPFGFLDAFDPSYTPNTTDLPGKRYCFANQPDVGLWNIAQFTGPLSSAELISQDEANYVMERYGTKFMDEYQSIMTKKLGLTKYNKQLISKLLSNMAVDKVDYTNFFRLLSNVNADPGIPENELLVPLKAALXDIGKERKEAWISWVQTYIEEVYHALPLLTRLLYCYIQYLNLKSNDVVHSVWKLVESGVPDEERKAAMNSVNPKYILRNYLCQSAIDVAEQGDYEEVRRVLRVMHNPYDEQPGMEKYARLPPAWAYRPGVCMLSCSS

SEQ ID NO: 68599 - protein, 349 aa, Robiginitalea biformata HTCC2501
MSDFHTLKVSRVRRLTPNAVAVSLEIPASQKERFKFTAGQYITVRSEATGSDVRRAYSISSRPGDAELTIGIKKVTDGTFSVFANESLREGDSLEVMPPEGRFTYEPGTPGRHLIAFAAGSGITPIMSILRTALEADAEARVVLVYGNQSRESTMFLEDLQALANEYPDRFIPYFTFSRGQYDDSLFGRIERSTVNYIVKNKHSDLEFDRYYICGPEPMIRTVEETLLDNGVPADRVLHELFETADQPDELREQLEGTTRLTVVLDEETHELNMDQKNVVLDAVLNEKIDAPYSCQGGICSTCIARIRSGTARMAQNQILTDSEIEEGLILTCQAHPTSPELTVDYDDV

SEQ ID NO: 68600 - protein, 327 aa, Vitis vinifera
MSSATHHLLKPFSIPNGSPISLPTIFSTKTPHSYLPIPPHKPIKLLLSCSQSSLFSPSLFLKSKTLSSSVVTFVAQTSDWAQQEEDNTVIIEEEQEEKVTWENEEVEGPDAQASDWESEGEGAVTEAISDDGVVDDGEDSYSEPPEEAKVFVGNLPYDVDSERLARLFEQAGVVEIAEVIYNRETDRSRGFGFVSMSTVEEAEKAVDMFHRYELDGRLLTVNKAAPRGSQPERPPRVFEPAFRMYVGNLPWDVDSARLEQVFSEHGKVVEARVVFDRETGRSRGFGFVTMSSQTELEDAIAATDGQTLDGRTIRVNVAEERPRRSAF

SEQ ID NO: 68601 - protein, 207 aa, Rhizobium leguminosarum bv. trifolii
MGMKGIILAGGTGTRLHPITQAVSKQLMPVYDKPMIYYPLTTLMLAGIRELLIITTPHDVEAFKRLLGDGSQWGISLTYAVQPSPDGLAQAFIIGADFVHGDSSALVLGDNIFYGHGLPEIMKSGTSRREGATVFAYHVTHPEGYRVVGFDEKMNALSIEEKPKKPKSNWAVTGLYFYDQQVVDIAANLKPSPRGELEITDVNRTYL

SEQ ID NO: 68602 - protein, 1498 aa, Emericella nidulans
MSFLGSISPNLPRSQSVVSHNLPQAHGLDENDDIYHNHSTTAQPGASEKDKSEDGETLHENEPDGEARVTLLARQLTRHSTRLTAKSTLENPFFLDDSDSTLNPNSPNFRVRDWMKMLLEIRSRDPERYPDRTAGIAFKNLSVHGFGSPTDYQKDVMNVLLEIGTIARRLAGMKMPKIQILRDFEGLVRSGEMLVVLGRPGSGCSTFLKTIAGEMNGIQVSDDAVLNYQGISSKNMQNSFRGEAIYTAENDIHFPQLSVGDTLMFSALARAPRNRLEGVSRKQYAEHMRDVVMAMLGLSHTINTRVGNDFIRGVSGGERKRVSIAEATLSQAPLQCWDNSTRGLDSANALEFCKNLALMSKYTGSTACVAIYQASQSAYDVFDKVTVLYEGRQIYFGNTKDAKKFFVDMGFECPERQTTADFLTSLTSPAERLVRPGYEGRVPCTPDEFAAAWKRSEERAKLMAEIEEYERQYPIGGPSYDAFVDARKAMQSKRQRVNSPYTISIWQQVSLCVVRGFQRLRGDFSLTTTSLIGNFMMALIIGSVFFDLPDDTSSFYYRGALLFFAVLLNAFSSALEILTLYSQRPIVEKQSRYAFYHPFAEAVASMICDTPYKLINSFTFNVPLYLMTNLRRDAAAFFTFWIFSVVTTFTMSMIFRTIASTSRSLSQALVPAAMLILGMVIYTGFTIPTQNMLGWSRWMNYINPIAYSFESFMVNEFDGRQFECVSIIPSGDEYNNVSMQYRICSTVGAESGSRIVDGGQYLELSYQYTKSHLWRNMGILIGFMVFFAFTYLLGTEYISEQKAKGEVLLFRRGRQPDLSTTEADPENPIQPSNAPKTEESAPQNTARIQRQTAIFHWEDVCYDIKIKGQPRRILDNVDGWVKPGTCTALMGVSGAGKTTLLDVLATRVTMGVVSGSMLVDGRLRDQSFQRKTGYVQQQDLHLATSTVREALRFSAILRQPAHLSRQEKLDYVEEVIKLLGMEAYADAIVGVPGQGLNVEQRKRLTIGVELAAKPQLLLFLDEPTSGLDSQTSWSILDLIDTLTQHGQAILCTIHQPSAMLFQRFDRLLLLASGGKTIYFGEIGPNSSTLSNYFVRNGSHGLPPGDNPAEWMLEVIGAAPGSNTEIDWVKTWRESPEYAKVREHLAELRATLSAKPADSSDPSALSEFAAPFSVQLWECLVRVFAQYYRTPTYIWSKAALCALTALYIGFSFFNAPTSIQGLQNQMFSVFMLMTIFGNLVQQIMPNFVTQRSLYEARERPSKAYSWKAFMAANIIVELPWNSLMAALIFFCWYYPIGLYNNAKPTDAVTERGGLMFLLIWTFLLFTSTFAHMIIAGIELAETGGNVAQLLFSLCLIFCGVLSTPDAMPGFWIFMYRVSPFTYLVSAMLSTGLSGTDVECEPVEYLTFAPPNNQTCGDYMRAYIDEVQSGYLLDPSATDQCSFCSMDKTDTFLLSVGSTFDEAWRNFGLMWAYILFNIVGAVFIYWLARVPKGKKMAGTA

SEQ ID NO: 68603 - protein, 332 aa, Gibberella zeae PH-1
MSNQPPYPLHESVVGRIDPEYAAFYNKHIIDKQQVHLQPIEASRASGVLIPGSGPLQPVASTVDYKVERRESQGPDVSVRCFTPNGEKPEAGWPVCIYYHGGGWVLGTIETENVIASHLCARGKCVVVSVDYRLAPENPFPAAVHDSWEAVLWVIGEGKDILGLDTSKLATGGSSAGANLAAVMCQRAADLGSPQFSLQLLSVPVMDNTADISNNESWKENQNSPALPAPKMLWYRNHYLPNKEDWSHPEASPLFWKGDFSKLPPACFVVGELDVLRTEGEQFAKKLVDAGVKAEVNMMKGQPHPFIAMDAVLEAGSRAITLFCDALYKTIK

SEQ ID NO: 68604 - protein, 181 aa, Glycine max
  misc_feature (23)..(23): Xaa can be any naturally occurring amino acid
  misc_feature (145)..(145): Xaa can be any naturally occurring amino acid
MATIVSIKARQIFDSRGNPTVEXAVPSGASTGIYEALELRDGGSDYLGKGVSKAVDNVNTVIGPALIGKDPTEQTAIDNLMVQQLDGTVNEWGWCKQKLGANAILAVSLAVCKAGASGLKMPLYKHIANIAGNKSLVCCSAFKVXNGGSHAGTNLCSYGLPGELVKEPEGEVTVWLKNAIL

SEQ ID NO: 68605 - protein, 237 aa, Zea mays
LGPSRPACRWPSRAASSRPPAARPPTSPAPSPSSAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVPGFKVDTVDTTGAGDAFVGSLLVNVAKDDSIFHNEEKLREALKFSNACGAICTTKKGAIPALPTVATAQDLIAKAN

SEQ ID NO: 68606 - protein, 345 aa, Magnetospirillum magnetotacticum MS-1
GLFAILDEVGALAGWNVTVGGGMGMTHGEADTFPRTADVMCFCEPEDALKVAEVVMTVQRDWGNRKSRKNARLKYTIERFGLDAFRAEVERRVGKAFAEPKPFRFENNGDRYGWTEGEDGRHHLTLFIQNGRVRDFKGGPQLLTGLRRIAEVHQGEFRLTANQNVLVANVPAEKRAEIEALVAEHGLTAHAGTLRRNSMACVALPTCGLALAESERYLPTLIDELEACLARHGLAEDEITIRMTGCPNGCARPYIAEIGLVGKGPKRYNLYLGAAFDGSRLGKLYAEDVADSAIVEVLDPLLAAYKVQRSYGERFGDFLVRTGYVAMTTNGPNFHEQTGCLRGLS

SEQ ID NO: 68607 - protein, 492 aa, Borrelia burgdorferi
NNKETKLKDLENQEFDLIIIGGGATGLGIAVDAITRGYKAILIEKFDYAKGTSSRSSKLIHGGVRYLAQWNISLVKEALREKAILEKNAPHLINECALITPIYNVLEIPYYYFGLSYYHNLMGKEKTTKYKTKLLSKKSTIEKAPNIKTEGLKCSVLYYDDSFDDARMAITLLRTFTEKGGIALNYTELKKFNKENGKLSGVLIQNKLSKEQISLKSKCIINATGIFSDEIRRLDDEKALNIIKPSQGSHLVVKKDKFPKNHAILIPKTSDNRILFAIPWYDSVVCGSTDIPIKEIEEEPKRFEEEIDFIINNLNNYLNIKIEKSDVKSVYTGIRPLIMDPKAQGNTSKISRNEKIFISDSNLITIAGGKYTTYRKMAEKTLLKAIEQNLIPNRAPTTEDLKLHGYLKKEEAMKIPEPFRAYGSDFEILKNMEGFDKKIHENLDLNEAQIDFSIKFEQAKTIEDVLARRTRSLPLNPQATIEAAPRVAEIMM

SEQ ID NO: 68608 - protein, 492 aa, Borrelia burgdorferi
NKETKLKDLENQEFDLIIIGGGATGLGIAVDAITRGYKAILIEKFDYAKGTSSRSSKLIHGGVRYLAQWNISLVKEALREKAILEKNAPHLINECALITPIYNVLEIPYYYFGLSYYHNLMGKEKTTKYKTKLLSKKSTIEKAPNIKTEGLKCSVLYYDDSFDDARMAITLLRTFTEKGGIALNYTELKKFNKENGKLSGVLIQNKLSKEQISLKSKCIINATGIFSDEIRRLDDEKALNIIKPSQGSHLVVKKDKFPKNHAILIPKTSDNRILFAIPWYDSVVCGSTDIPIKEIEEEPKRFEEEIDFIINNLNNYLNIKIEKSDVKSVYTGIRPLIMDPKAQGNTSKISRNEKIFISDSNLITIAGGKYTTYRKMAEKTLLKAIEQNLIPNRAPTTEDLKLHGYLKKEEAMKIPEPFRAYGSDFEILKNMEGFDKKIHENLDLNEAQIDFSIKFEQAKTIEDVLARRTRSLPLNPQATIEAAPRVAEIMME

SEQ ID NO: 68609 - protein, 519 aa, Helicobacter pylori J99
MQSLWIYPEDTEVLGAACKSLLKALKPRYQKIALFSPISGGCEGFGECESLSSLEVHSAIDKQKALELVSTAQEELLFETILKRYDELQSTHDFVINLGYAPKFFLNALLDLNTILAKHLNAPVVAVAQTSLDHLKAMHSHILKKEAPFAIGLFVGETLEKPHFLSASLCKQQCELEASAIENLLQTKSEIITPLAFQRSLEKKAKKQIKKVVLPESEDERILKAAHRLNLMGAVGLILLGDKEAINSQAKNLNLNLENVEIINPNTSHYREEFAKSLYELRKSKGLSEQEAERLALDKTYFATMLVHLGYAHAMVSGVNHTTAETIRPALQIIKTKPGVSLVSSVFLMCLDTQVFVFGDCAIIPNPSPKELAEIATTSAQTAKQFNIAPKVALLSYATGNSAQGEMIDKINEALTIVQKLDPQLEIDGPLQFDASIDKGVAKKKMPNSQVAGQASVFIFPDLNAGNIAYKAVQRSAKAVAIGPILQGLNKPINDLSRGALVEDIVNTVLISAIQAQDY

SEQ ID NO: 68610 - protein, 489 aa, Borrelia burgdorferi
RQLKDLENQEFDLIIIGGGATGLGIAVDAITRGYKAILIEKFDYAKGTSSRSSKLIHGGVRYLAQWNISLVKEALHEKAILEKNAPHLINECALITPIYNVLEIPYYYFGLSYYHNLMGKEKTTKYKTKLLSKKSTIEKAPNIKTEGLKCSVLYYDDSFDDARMAITLLRTFAEKGGIALNYTELKKFNKENGKLSGVLIQNKLSKEQISLKSKCIINATGIFSDEIRRLDDEKALNIIKPSQGSHLVVKKDKFPKNHAILIPKTSDNRILFAIPWYDSVVCGSTDIPIKEIEEEPKRFEEEIDFIINNLNNYLNIKIEKSDVKSVYTGIRPLIMDPKAQGNTSKISRNEKIFISDSNLITIAGGKYTTYRKMAEKTLLKAIEQNLIPNRAPTTEDLKLHGYLKKEEAMKIPEPFRAYGSDFEILKNMEGFDKKIHENLDLNEAQIDFSIKFEQAKTIEDVLARRTRSLPLNPQATIEAAPRVAEIMME

SEQ ID NO: 68611 - protein, 168 aa, Triticum aestivum
LLQSEHCRGKIVMELINANPVIHEKRERRTRQAPENIDENAPEAIDQLEIFDHIRDIKDPEHPYSLEDLNVVNEDSVEINDELSHVRVTFTPTVEHCSMATIIGLCLRVKLMRSLPPRYKVDIRLTPGSHATEAAVNKQLSDKERVAAALENSNLLDIVEECLSPTLG

SEQ ID NO: 68612 - protein, 491 aa, Borrelia burgdorferi
KETKLKDLENQEFDLIIIGGGATGLGIAVDAITRGYKAILIEKFDYAKGTSSRSSKLIHGGVRYLAQWNISLVKEALHEKAILEKNAPHLINECALITPIYNVLEIPYYYFGLSYYHNLMGKEKTTKYKTKLLSKKSTIEKAPNIKTEGLKCSVLYYDDSFDDARMAITLLRTFAEKGGIALNYTELKKFNKENGKLSGVLIQNKLSKEQISLKSKCIINATGIFSDEIRRLDDEKALNIIKPSQGSHLVVKKDKFPKNHAILIPKTSDNRILFAIPWYDSVVCGSTDIPIKEIEEEPKRFEEEIDFIINNLNNYLNIKIEKSDVKSVYTGIRPLIMDPKAQGNTSKISRNEKIFISDSNLITIAGGKYTTYRKMAEKTLLKAIEQNLIPNRAPTTEDLKLHGYLKKEEAMKIPEPFRAYGSDFEILKNMEGFDKKIHENLDLNEAQIDFSIKFEQAKTIEDVLARRTRSLPLNPQATIEAAPRVAEIMME

SEQ ID NO: 68613 - protein, 520 aa, Pyrus communis
DVQYLTGHVDERKPPQLADFLNWFLHDKKGTSTLSKPSSTGHRPHHVRVTGRLSTSCHLVDEDRELLLPRRHHNDDDHDNHVSSIFIDQSLTDGGEGGQIIKETSLLPGDQTRFGLESSLMRLELKGNSPHCLVQSDIPPCVQGDASEALDVTATAVASLEECARLSEENDVVQQAYRKEIVVSRNQVIRNSVEQPKVTLYNQSDLEGVHSELVKQGRITAVTNPRYLNLEPTLAMDWLEISWDELNIKERVGAGSFGTVHRAEWNGSDVAVKVLTVQDFHDDQLKDFLREVAIMKRVLHPNVVLFMGAVTKRPHLSIVTEYLPRGSLYRLIHRPASGELLDQRRRLRLALDVAKGINYLHCLNPPIVHWDLKSPNLLVDKNWTAKVCDFGLSRFKANTFISSKSVAGTPEWMAPEFLRGEPSNEKSDVYSFGVILWELATMQQPWGNLNPAQVVAAVGFKNKRLEIPRDLNPNVAAIIEACWANEPWKRPSFAVIMDSLTPLIKAPVTQPSRADMPLLT

SEQ ID NO: 68614 - protein, 465 aa, Clostridium perfringens SM101
MSNNIGKVVQVIGPVVDIKFANDELPNIFNAIHIKMDDGKILVCEVEQHVGDDIVRTIAMEATEGLRRGVEAVDTGAPISVPVGECVLGRIFNVLGKPLDSGAEVNNEEKYPIHRPAPSFEEQSVVPQMFETGIKVIDLLAPYQRGGKIGLFGGAGVGKTVLIQELINNIAKEHGGLSVFTGVGERSREGNDLYYEMMESGVIKNTALVFGQMNEPPGARMRVALTGLTMAEYFRDQGQDVLLFIDNIFRFSQAGSEVSALLGRIPSAVGYQPTLATEMGALQERITSTTHGSITSVQAVYVPADDLTDPAPATTFNHLDAKTVLSRSIAEIGIYPAVDPLDSSSRILDPRVVGEEHYEVASKVKHILERYKELQDIIAILGVDELADEDKLIVARARRIQKFLSQPFTVAEQFTGMQGRYVPIKETIRGFKEILEGKHDNVPESAFLFVGTIEEVLEKARTMAQ

SEQ ID NO: 68615 - protein, 567 aa, Shewanella sp. MR-4
MSITGIIVSSGIAFGQALHLTHAEHHLDYRPIPLSRLPQQQTKFVKALQALQQQLNHSQTKLDPQSENYQLIEADLLLLEDEELIAQVKEAIRTLQLSASVAVERVFAHQANELESLDDPYLANRAQDVRCLGQRLVSAINGRLDQGLAQLTEPTILLAQDLTPAEFALLPKEQISGIVLKTGGLTSHTAILARAAGIPAILNCQFDAEFIPNGTPLVLDALSGELFVNPAPEQQARLTVTLHHEQARRAALQTYRDVPAKTQDGHLVGLMANVGNLNDITHVSDVGADGIGLFRTEFMLMHTSTLPDEKAQYNLYCEALHALGGKTFTIRTLDIGADKELPCLCQEVEDNPALGLRGVRYTLAHPELFKTQLRAILRAANHGPIRLMFPMVNQVEELDQIFALIAECQDALEEEEKGFGELSYGIVVETPAAVMNLASMLPRLDFVSIGTNDLTQYAMAADRTNPQLTRDYPSLSPAILGLIKMTVEQAKAAGVKVSLCGELASSPQMVPLLIGMGLDELSVNLSALLEVKAAVCQGQLAKFSALAHTAMQQNRISELQQCITNYK

SEQ ID NO: 68616 - protein, 311 aa, Corynebacterium efficiens YS-314
MGNVYNNITETIGRTPLVKLNRLTEGLDATVLVKLESFNPANSVKDRIGLAIIDAAEASGELKPGGTIVEATSGNTGIALAMVGAARGYKVVLTMPETMSTERRVLLRAYGAEIVLTPGAAGMQGAKDKADEIVAERENAILARQFENPANPEIHRETTAKELMEDTDGNFDIFVAGFGTGGTITGVGGVLKEHNPEAQVYAVEPEASPLLTSGKAGPHKIQGIGANFIPENLDRKILDDVITISNEDAVTWSRKLATEEGILGGISTGANIKAALDLAAKPENAGKTIVTTVCDFGERYVSTVLYEDIRD

SEQ ID NO: 68617 - protein, 200 aa, Rhodococcus sp. RHA1
MEPASETAVPLLNIANILTILRILLVPVFLVVLFVGDGHSTMWRLIATGVFAVAAITDRIDGQLARKYGLVTDFGKLADPIADKALIGAALVGLSILGDLPWWVTAVIAVRELGITLLRFAVLRHAVIPAGRGGKLKTLVQTIAIGYYLLPLPDGFEVAGWILMGAAVLLTVVTGLDYVVQAVRLRAGVHKVEANASTGA

SEQ ID NO: 68618 - protein, 188 aa, Corynebacterium efficiens YS-314
MLLVVKMIREDLANARDHDPAARGDLENAIVYSGLHAIWAHRIAHAWWKAGFRGPARILSQLNRFFTGIEIHPGATIGRRFFIDHGMGVVIGETAEIGDGVMLYHGVTLGGQVLTQTKRHPTIEDNVTIGAGAKVLGPITVGAGSAIGSNAVVTKDVPANHIAVGIPAKARPRGKDETIKLVDPDYYI

SEQ ID NO: 68619 - protein, 350 aa, Novosphingobium aromaticivorans DSM 12444
MIFDGSSERRGSILVTGGAGYIGSHAVLALLDAGWPVIVLDNLTTGFRWAVDPRASFVEGDVTDSALVRSILTYHEVAAIMHFAGSVVVPESVVDPLKYYGNNTAATCSLLRNAVDCGVPHIVFSSTAATYGSPDVAQVCENTPTRPINPYGRSKLVVEAMLADAAAAYPINYCALRYFNVAGADPAGRTGQSTAGATHLIKVCVEAALGRRELVEVYGTDYDTHDGTGVRDYIHVSDLADAHVHALHLLMDDPEASHTMNCGYGTGFSVLDVLDAVERISGREIRRVMRPRRPGDPAALIADNNLILSRTRWRPRHARLGDIVRHALAWEDQLARRKPGQPVGQREIAA

SEQ ID NO: 68620 - protein, 425 aa, Corynebacterium efficiens YS-314
MQVWCPASAGPGWPHPPHTLSRTEDIMDLFEYQARDLFEAHGVPVVRGIVADTPEDARRAAEELGGPTVVKAQVKVGGRGKAGGVRLAGDPQKAQEAAGAILSMDIKGHTVEQVMVVEAVDIAEEYYFSILLDRANRSYLAMCSMEGGMEIEVLARERPEALARVEVNPLTGIDDTKAREIARAAGFDDTIAQKIVPVLQQLYRVYHDEDATLVEVNPLVLTAEGEVLALDGKITLDDNADFRHDNREELVGSAGTTDPLELRAKKNGLNYVRLDGTVGIIGNGAGLVMSTLDIVAEAGQRHGGQAPANFLDIGGGASSDSMVAGLEVIMCDPQVRSVLVNVFGGITACDEVARGIVGALEELGDGAAKPIVVRLDGHNVDKGREILEEFNHPLVTLVAGMDEAADRAAQLAAEQPTTEFATVTS

SEQ ID NO: 68621 - protein, 433 aa, Robiginitalea biformata HTCC2501
MKISVIGTGYVGLVTGTCLAETGNDVVCVDIDELKVKRMQEGEVPIYEPHLDVLFERNINAGRLTFTTSLAEGLEHGEIVFLALPTPEDEDGSADLKYVLGVADEIGKLITDYRVIVDKSTVPVGTSDKVREAIAKNAKCDFDVVSNPEFLREGFAVDDFLKPERIVVGSSSPRATELMEKLYKPFVRSGNPVIIMDERSAELTKYAANSFLATKITFMNEIANFCELVGADVDKVRIGMGTDSRIGKRFLFPGIGYGGSCFPKDVKALHKSGKDSGYDFQILESVIDVNQKQKTALIPKIRKYFGDDLKGKKIGLWGLAFKPETDDIREAPALYIIEELLAAGAEVTAFDPEAMENVKRKLGDAIAFAPGMYGAVEDMDALVICTEWSVFRNPNFSMVKDLLKAPVVFDGRNLYDVEEMKSRGFHYESIGRG

SEQ ID NO: 68622 - protein, 424 aa, Glycine max
  misc_feature (42)..(42): Xaa can be any naturally occurring amino acid
MVGEGEKPKAVIIGGSIAGISSAHALTLAGWDVLVLEKTTSXPPTGSPTGAGLGLNSLSQQIIHSWLPPHQKQLLHNTTLTLTIDQNHATDSEKKFSWTLTRDESFNFRAAHWADLHGLLYNALPPNVFLWGHLFLSVHVADDKGSVIVKAKVLETGKIIEIVGDFLVAADGCLSSLRQKYLPDFKLRYSGYCAWRGVLDFSKIENSETINGIRKAYPDLGKCLYFDLASGTHTVLYELQNKKLNWIWYVNQPEPEVKGTSVTMKVNNDMIQKMHQEAEQVWIPELVKVIKETKDPFLNFIYDSDPLEKIFWDNVVLVGDAAHPTTPHCLRSTNMSILDAAVLGKCIEKWGPEKLGSALEEYQFVRLPVTSKEVLYSRRLGRLKQGLVLPDREPFDPKLIRPEDCQELLLRNTPFFNDEPLSLL

SEQ ID NO: 68623 - protein, 1077 aa, Bdellovibrio bacteriovorus HD100
MTRTFFCLVFGLLLLSSCTTKNDLSLFFSSENTPQVTLKLNSGINYTGQSTIPVEIITSQELTEMSLSVSAMCSDVFETYVQQKTVNLPNVEGEHTISVRVKNKDGFTSDCTKAKIVFDKTAPVVSETMTLVNTRSLPDVSPKLNTPVTTDTLSGVAKYELKLVKTAGNTVIKDWTTKDKEALYFDGLTLPDSEVDTYFYMIRATDKVGNVSAEKQSPNFIVGPVVTITGALIYDQDSPMGSATIQLSRASPVSTTVAVKSVSRSAIAGLDFLYPDIIPTEVVIAAGATSADTYFSIMTSTLPGPDKAFDLQVTSTTNAITGSPSSFTVDLVNTNTAITAQAANGYRAVRGAKGHMCGLRTDNKMDCWGAISYANGSTSEQLTAKEVVGATNIVSVAEGYGDHTCYIDSLGDLYCFGNSGYKNLGHNSYTSSTTPIKVPSSNIKKAAVGIYFTCFIDSSDQVQCFGKNDDAELGQPISFSNGIPTVYASITKALDIAAGNKIACAIDEVSGTRSVKCWGKTESASSHVPVTITGLPSDIQSISVNGSITADVRHGCGLSEQGLVYCWGSNFRSRRGLASGAVTWTTANYVGLPVKAVKVQAGTDTSCALGEDKKLYCWGSGLPNATNSHQYQESYVPVQLDNFGDTITDFQLTELASCAVTTSSNIKCWGINSLGEMGNGQTASAMQGTALNVAGSFDKYKQLATGVFTTCALKSNNTVTCWGNNDYGQLGNGSHSTYSRPHYTLPISNVKKVVGQNIHFCALTTGGSVYCWGSNWSGRIGNNATALPTDVVLTPYLIPNTYPNSTAGLPSGIKDISVGYNHSCAVTSEGGVTCWGNNSAGELGHPSIGSAFSYPQMIPSLSTGVDSVALGINATCAVKNNATTKQVYCWGWNRNRVLGPSAVALNASTEVPQLIDTITTTKEVKVFISFETACYIHDGTTKCWGYRSTFKGMPANVPDGTYITTPTAIPELAGATDLHLNPYSGCALMSTGKAKCWGADYSRIFSTGISWIGTPVEPPALQNSQVTAIALGTTYSSAGPIHACAITSLGDLKCWGVSTYGEGHDRFFHQTPQLVLK

SEQ ID NO: 68624 - protein, 306 aa, Triticum aestivum
  misc_feature (143)..(143): Xaa can be any naturally occurring amino acid
  misc_feature (147)..(147): Xaa can be any naturally occurring amino acid
  misc_feature (149)..(149): Xaa can be any naturally occurring amino acid
  misc_feature (152)..(153): Xaa can be any naturally occurring amino acid
  misc_feature (203)..(203): Xaa can be any naturally occurring amino acid
  misc_feature (209)..(209): Xaa can be any naturally occurring amino acid
  misc_feature (220)..(220): Xaa can be any naturally occurring amino acid
  misc_feature (261)..(261): Xaa can be any naturally occurring amino acid
NKFVQKSRLVPVRNSRDIVDPRVREEQVIEASQHELAPVVAPRVIPDAAAKDEEMKEQSVEEVVQVHNKEEARREAGTDDQQEKLVPKDEPALEKSDDLNVSQEDSSNDKVDVQLPEKDTTLLGMPEDEARASMEFEEWEGIXRSEXWXKRXXAAAAFAASDAGAAALSKLNSDVQLQLQGLLKVAVDGPCYGPAQPLTLKPXSRGKWXSWQKLRNLHPXEIAMEKYLNLLPEFLPWNGWETPPRSPEETPKWMVILKGAXLTMDYSYMRTPRSLQGYEGSTSIDEGPLTVPPNPEKGQSSDVPTE

SEQ ID NO: 68625 - protein, 372 aa, Ostreococcus tauri
MRTAQHIRCSAKTMGASKRRAAAKPVRRDVRAHEYGASSTSMYTTTEKQESYPSLENILERHCKDEMLRKVIVEMLDCCADITEALRSALVTVEGSSNAFGDSQLSVDVIADNLMWDCVKSSDVVAYGASEEEPEIVACNPNGEYTVCWDPLDGSSIVDNNWAVGTIIGIWDSKSGTGADGLLGATGRDQRTSLVALYGPRTTVIVALDDGVFEFSYGCTPEGCQLPDGSFEPWICSRLDIKIKEDSKIFSPANMRAAQDTEGYKNLLDYYMDSRYTLRYSGGLVPDVYQQFTKNQGVFSNPTSAKSPAKLRLAFEAAPFGLLVEKAGGKTSDGVTGGSILDVQINAVDQRCALCIGSANEVDRFNKIVLGK

SEQ ID NO: 68626 - protein, 330 aa, Neisseria meningitidis FAM18
MYACLPLKTNTQRIIMNILSKISSFIGKTFSLWAALFAAAAFFAPDTFKWAGPYIPWLLGIIMFGMGLTLKPSDFDILFKHPKAVIIGVIAQFAIIPATAWLLSKLLNLPAEIAVGVILVGCCPGGTASNVMTYLARGNVALSVAVTSVSTLISPLLTPAIFLMLAGEMLEIQAAGMLMSIVKMVLLPIVLGLIVHKVLGSKTEKLTDALPLVSVAAIVLIIGAVVGASKGKIMESGLLIFAVVALHNGIGYLLGFFAAKWTGLPYDAQKTLAIEVGMQNSGLAAALAAAHFAAAPVVAVPGALFSVWHNISGSLLATYWAAKAGKHKKP

SEQ ID NO: 68627 - protein, 512 aa, Geobacter metallireducens GS-15
MDTTMNSRMEPTVMVVFGAAGDLTWRKLVPALYNLYLDGRLPERFAIVGVARQEMDDAGFRRKLREGVDLHSRRSVTDESTWSGFADRLSYLAGDFTTAETGALLSRRLEGLDREWNGRAVRVFYFAIPPGLMEAAARQLESLGVCRDCSRDRLVVEKPFGRDLASARQLNGLLTSLFAETQIYRIDHYLGKETVQNILAFRFANSLFEPVWNRRYIDHVQITVAEAVGVGKRGGYYDTSGALRDMVQNHLLQILCLIAMEPPVSFSADEVRNKKVDVLRAIRPIRPEEVHRVAVRGQYGRGMVACEGVTGYREEQGVPPDSVTETFAALKLWIDNWRWQGVPFYLRTGKRLRAKVSEVAILFRPAPHQLFPSAAVESWQPNRLVLRIQPEEGIASRIQVKQPGTRLLLGAVDMGFRYHDAFHAASPEAYETLLLDVICGDATLFMRADQVESAWGVISPILDTWESVPPADFPNYQAGGWGPETADLLIAKEGHSWVQPDLPTEEGETEAP

SEQ ID NO: 68628 - protein, 82 aa, Physcomitrella patens subsp. patens
KFRGVRMRQWGKWVSEIREPNKRSRIWLGSFPTAEMAARAYDAAVVCLRGPGATLNFPDSPPQLLPECNSPKDIQVAAAAAA

SEQ ID NO: 68629 - protein, 407 aa, Desulfovibrio desulfuricans G20
MPMCTAEEAIEEIRSGRMLILVDDEDRENEGDLTIAAEHVTPEIINFMAMHGRGLICLAMAPEWVDKLQLPLMARRNESKFGTNFTVSIEARQGVTTGISAKDRATTILTAVKDDVKPEDIVTPGHIFPLRAQKGGVMVRAGQTEGSVDLARLAGLKPAAVICEIIRDDGEMARMPDLVEFAEKHGLKIATIRDLIRYRMQPGQLSVQRVAEAKMPTKYGDFTVIAYENDHGDETHLAMVKGDIKNQDAVLVRVHSECLTGDVLGSLRCDCGDQLAAAMCTVAAEGAGVVLYMRQEGRGIGLANKIKAYALQDQGYDTVEANHKLGFKADLRDYGIGAQILVDLGVRKMRMMTNNPKKIVGIEGYGIQVVERVPIEMHACEFNENYLRTKKEKMGHMLHLSDEGQEQ

SEQ ID NO: 68630 - protein, 535 aa, Bordetella bronchiseptica RB50
MMKFDWNNPYPSTRIPVFARNVVATSHPLAAQAGLRILALGGNAADAAVASAATLALVEPASNGLGSDCFALVWDGARLHGLNASGTAPAAWSPGYFQRKHQGAIPLRGWDSVTIPGCVAGWASLHDKLGSLPFADVLAPAIEYAERGFAVPPTVQRRWADQVDPLRSLPGFAEHFLPHGRAPEVGEHFVLAGAAATLRRIAASGGRDFYEGETAQKLVAHAQAHEAALTLGDLRDYAPQWVEPISQAYRGHALHQLPPNGQGLAALIALGIVEHFDLASRPAEHPDTQHILIEAMKLAFADVHAHVADAAHMRIRVEQLLDPAYLAERARLIDLRRARVYNAAQAPQGGTVYLACADRNGMMVSFTQSNYMGFGSGIVVPGTGISLQNRGCCFSMDPDHPNVVGGGKRPFHTGIPAFLTQDGAPLMSFGIMGGNMQPQGHLQALVRMLDYRQQPQAACDAPRWKWNRGLSVDIEAAMPAQVTDALRARGHIVEVAAPAGKDFGSGQFIWRLGDPAVDGYVAASDSRRDGLAAGF

SEQ ID NO: 68631 - protein, 489 aa, Borrelia burgdorferi
KETKLKDLENQEFDLIIIGGGATGLGIAVDAITRGYKAILIEKFDYAKGTSSRSSKLIHGGVRYLAQWNISLVKEALHEKAILEKNAPHLINECALITPIYNVLEIPYYYFGLSYYHNLMGKEKTTKYKTKLLSKKSTIEKAPNIKTEGLKCSVLYYDDSFDDARMAITLLRTFTEKGGIALNYTELKKFNKENGKLSGVLIQNKLSKEQISLKSKCIINATGIFSDEIRRLDDEKALNIIKPSQGSHLIVKKDKFPKNHAILIPKTSDNRILFAIPWHDSVVCGSTDIPIKEIEEEPKRFEEEIDFIINNLNNYLNIKIEKSDVKSVYTGIRPLIMDPKAQGNTSKISRNEKIFISDSNLITIAGGKYTTYRKMAEKTLLKAIEQNLIPNCAPTTEDLKLHGYLKKEEAMKIPEPFRAYGSDFEILKNMEGFDKKIHENLDLNEAQIDFSIKFEQPKTIEDVLARRTRPLPLNPQATIEAAPRVAEIM

SEQ ID NO: 68632 - protein, 394 aa, Nocardia farcinica IFM 10152
MSSSKSLPPLVEPAAELSKDEIARYSRHLIIPDVGVDGQKRLKNAKVLVIGAGGLGSPALLYLAAAGVGTLGIVEFDEVDSSNLQRQIIHGESDIGRPKADSARDSILEINSGVDVRLHKIRLEPENAVELFGEYDLILDGTDNFATRYLVNDAAVLAGKPYVWGSIYRFEGQVSVFWEDAPDGRGINYRDLYPEAPPPGMVPSCAEGGVLGVLCASIGSIMVTEAIKLITGIGDPLLGRLMVYDALDMTYRTIKLRRDPDRQPITELIDYEAFCGVVSEEGQAAAAGSTITARELKELLDAGKEIELIDVREPVEWDIVHIEGAKLIPKDRILSGEALSELPQNRPIVLHCKTGIRSAEALAVLKNAGFTDATHVQGGIVAWANQIDPSLPVY

SEQ ID NO: 68633 - protein, 499 aa, Oryza sativa Japonica Group
MADAWAASPPSPTAPSPFAADDLVDARLAPWPPFAPWPAPGQLHHNRRGGGHPNPLFTILPASALAIGVVLLVAVVVILVMTRRWKPGTVDGAGGASCNGDKPGGAPASSCGSSVRGYNNSRYYAAAAAGCIYGGRLGFSVQPRNRGAQVFTYRELESATDGFSECNVVGRGAYGVVFRGRLGDGTTAAIKRLKMDGRREGEREFRIEMGVAITDQVDLLSRMHSPYLVGLLGYCADQSHRLLVFEFMPNGSLKSHLHRRALAPAEQPPPLDWQTRLGIALDCARALEFLHEHSSPAVIHRDFKCSNILLDHNYRARVSDFGMAKLGSNKANGQVTTRVLGTTGYLAPEYASTGKLTTKSDVYSYGVVLLELLTGRVPVDTKRPPGQHVLVSWALPRLTNREKLVQMVDPALIGQFSLKDLVQVAAITAMCIQTKADYRPLMTDVVQSLIPIVKSPLMSCTSTPLRPAHGHHHVVYMSPSRGSSNGGALETRCVMHGLD

SEQ ID NO: 68634 - protein, 493 aa, Borrelia burgdorferi
NKETKLKDLENQEFDLIIIGGGATGLGIAVDAITRGYKAILIEKFDYAKGTSSRSSKLIHGGVRYLAQWNISLVKEALHEKAILEKNAPHLINECALITPIYNVLEIPYYYFGLSYYHNLMGKEKTTKYKTKLLSKKSTIEKAPNIKTEGLKCSVLYYDDSFDDARMAITLLRTFTEKGGIALNYTELKKFNKENGKLSGVLIQNKLSKEQISLKSKCIINATGIFSDEIRRLDDEKALNIIKPSQGSHLVVKKDKFPKNHAILIPKTSDNRILFAIPWYDSVVCGSTDIPIKEIEEEPKRFEEEIDFIINNLNNYLNIKIEKSDVKSVYTGIRPLIMDPKAQGNTSKISRNEKIFISDSNLITIAGGKYTTYRKMAEKTLLKAIEQNLIPNRAPTTEDLKLHGYLKKEEAMKIPEPFRAYGSDFEILKNMEGFDKKIHENLDLNEAQIDFSIKFEQAKTIEDVLARRTRSLPLNPQATIEAAPRVAEIMMEK

SEQ ID NO: 68635 - protein, 506 aa, Pyrus communis
MSPPEIAILILVFLTFLWSLLRLINVSSRQSRTLPPGPAALPIIGNLHMLGDLPHRSLQNLAKKYGPIMSMRLGSVPTIVVSSPKTAKLFLKTHDTIFASRPKLQASEYMAYGTKAMAFTEYGPYWRHIRKLCTLQLLCPSKIESFAPLRREEVGLLVQSLKVAAEAGEVVDFSEKVGELVEGITYRMVLGRKNDDMFDLKGIIEEALFLTGAFNISDYVPFLSPLDLQGLTKRMKRVSKTVDQLFEKIIQDHEQVSRSEQGNHHKDFVDVLLSSIHQTLKPNDEEVYMLERTNAKATLLDMIAGAFDTSATAIIWTLAELLRHPKVMKRLQEELQSVIGMDRMVEESDLPKLDYLSMVVKESFRLHPVAPLLVPHQSMEDITVDGYHTPKKSRIFINIWTIGRDPKSWDNAEEFYPERFMNRNVDLRGHDFQLIPFGSGRRGCPAMQLGLTTVRLALGNLLHCSNWELPSGMLPKDLDMTEKFGLSLSKAKHLLATPTCRLYNES

SEQ ID NO: 68636 - protein, 477 aa, Neptuniibacter caesariensis
MHTVEKIGGTSMSRFEELMDTILVGKRTAPEELYNRIFVVSAYGGITNYLLEHKKTGEPGVYARFANAESEEAWVEELNNVQARMGEINAELFGDAEFERNAADSFVIERLNDVRDCMKSLQHLCTYGHFQLDEHLMKVREMLASIGEAHSAYNSVLALRKAGINARFVDLTGWHMDQPLPFEEMIQSQFEGVEIDKEMVIATGYTHCEEGLMKTFDRGYSEMTFSMIATVTGAGEAIIHKEYHLSSADPMLVGTDNVVTIGATNYDVADQLSNLGMEAIHPKAAKGLRRNGVKLRVKNAFEPEHEGTTISQDYHSEAPRVEIIAGRKDVFGIEIFDQEMLGDAKYDIEISKLLAQLKLYVINKDADANSITYYVGGSRKMVNRAANLMENMYPEGQIRLHNLAIVSAIGSHMKVKGILARTVSALAEADINVMALHQSIRQVEMQCVVSEEDYEKAIIALHAALIERGIDDIGSAA

SEQ ID NO: 68637 - protein, 494 aa, Borrelia burgdorferi
NKETKLKDLENQEFDLIIIGGGATGLGIAVDAITRGYKAILIEKFDYAKGTSSRSSKLIHGGVRYLAQWNISLVKEALHEKAILEKNAPHLINECALITPIYNVLEIPYYYFGLSYYHNLMGKEKTTKYKTKLLSKKSTIEKAPNIKTEGLKCSVLYYDDSFDDARMAITLLRTFAEKGGIALNYTELKKFNKENGKLSGVLIQNKLSKEQISLKSKCIINATGIFSDEIRRLDDEKALNIIKPSQGSHLVVKKDKFPKNHAILIPKTSDNRILFAIPWYDSVVCGSTDIPIKEIEEEPKRFEEEIDFIINNLNNYLNIKIEKSDVKSVYTGIRPLIMDPKAQGNTSKISRNEKIFISDSNLITIAGGKYTTYRKMAEKTLLKAIEQNLIPNRAPTTEDLKLHGYLKKEEAMKIPEPFRAYGSDFEILKNMEGFDKKIHENLDLNEAQIDFSIKFEQAKTIEDVLARRTRSLPLNPQATIEAAPRVAEIMMEKL

SEQ ID NO: 68638 - protein, 495 aa, Borrelia burgdorferi
NNKETKLKDLENQEFDLIIIGGGATGLGIAVDAITRGYKAILIEKFDYAKGTSSRSSKLIHGGVRYLAQWNISLVKEALHEKAILEKNAPHLINECALITPIYNVLEIPYYYFGLSYYHNLMGKEKTTKYKTKLLSKKSTIEKAPNIKTEGLKCSVLYYDDSFDDARMAITLLRTFTEKGGIALNYTELKKFNKENGKLSGVLIQNKLSKEQISLKSKCIINATGIFSDEIRRLDDEKALNIIKPSQGSHLVVKKDKFPKNHAILIPKTSDNRILFAIPWYDSVVCGSTDIPIKEIEEEPKRFEEEIDFIINNLNNYLNIKIEKSDVKSVYTGIRPLIMDPKAQGNTSKISRNEKIFISDSNLITIAGGKYTTYRKMAEKTLLKAIEQNLIPNRAPTTEDLKLHGYLKKEEAMKIPEPFRAYGSDFEILKNMEGFDKKIHENLDLNEAQIDFSIKFEQAKTIEDVLARRTRSLPLNPQATIEAAPRVAEIMMEKL

SEQ ID NO: 68639 - protein, 497 aa, Oceanobacillus iheyensis HTE831
MTALTLETDVLKNFIDGKWVDVNNTTAVTNPANGERIVQVPLSDQSHVEEAVQAAIKAQKEWALVPAPQRAEVLYRVGMIMKDKKERLSRLLTMENGKVLEEARGEVQEGIDMAFYMAGEGRRLFGQTTPAELKDKFAMSQRVPVGVVGIITPWNFPIAIATWKSFPAIVAGNAVVWKPATETPIMAYELAKIFEEAGLPSGVINVVFGKGSEVGDSMVQHKDIRVISFTGSNDTGRNIASDCGKQLKKVSLEMGGKNAVIVMDDADLDLAVEGILWSAFGTSGQRCTACSRVIVHHKVKKTLEERLLAAMDHLTIGNGLEDGIKVGPIINEAGLNKIKKYIEVGKQEGATLLAGGTEWETNNPGYYFTPTLFTDAKPDMRIAQEEIFGPVVSLIEVSSFEEAIEVNNQVTFGLSSSIFTKDVNRVFKAQRDLDTGIVYVNAGTTGAEIHLPFGGTKGTGNGHRDSGVQALDVFTEWKAIYVDYSGKLQRAQIDTEE

SEQ ID NO: 68640 - protein, 514 aa, Rhodococcus sp. RHA1
MNHPNTPPVSRSSALNAARRARELDQLSDGAVVDVLVIGGGVTGVGVALDAASRGLDVVLVEKRDLAFGTSRWSSKLAHGGLRYLASGNVGIARESAVERGILMTRTAPHLVRALPQLVPVLDSMTLFGKSLVRTGFLAGDLLRASARTPSSVLPRSRTVRADRVVELAPAVRREGLRGGLMAFDGQLIDDARLVVSLARTAALHGAKVLTRTGAYDVTGTSANLRDELTGSELPIRVRAVVNAAGVWSGEIDPGITLRPSRGTHLVLPAERLGNPTAALTVPIPGETNRFVFALPAQLGRVYLGLTDEAAPGPVPDVPVASEQEIDFLLDTVNTALEVPLQRSDVLGTFAGLRPLLDTGDGSTADLSRNHAILRSDTGLVSVVGGKLTTYRKMAEDAVDAAVEVAGLDAGPCRTRALPLVGAATPEALRKVSAPPALLARYGTEAALIAAADAELLAPIAEGVDVSRAEFEFAVTHEGALDVDDLLDRRTRIGLVPADRARAHGAAEAVFEKR

SEQ ID NO: 68641 - protein, 449 aa, Pseudomonas fluorescens Pf-5
MEIEEFGYKQELKRGLSLRDLVVYGMIFMIPIAPFGVYGYVNQEAPGMVPLAYIIGMVAMVFTALSYGAMARAFPIAGSVYSYAQRGLNPHVGFLAGWLMLLDYLLIPPLLYVYAAMALNHLYPEVPKVGFILAFLVSATFVNLRGITFTARMNILFLLAQLAVLGIFLFYAWNALHGGAGNGQLTLAPLYNPENFHFGMLMQGVSIAVLSFLGFDAISTLAEEVKGDPGRSVGRAALITLVVMGAIFVVQTWIATDLAAGMGFKSADTAFYEIAELAAGSWLATLTGVATALAWGVAVAITSQAAVSRLLFGMARDGKLPKVLAKVHPKHNTPHISIYLVAVLSLLICYLFINSVDTLTSLVNFGALSGFMLLHITVINFYWRRQKSGQVVRHLICPVIGFVIVSAIMYNMGVDAQKLGAIWILAGLVYLFLLNKLGSGAALPDPLKH

SEQ ID NO: 68642 - protein, 207 aa, Nocardia farcinica IFM 10152
MMEGMPTRENARLVLLRHGETEWSALGRHTGRTDLPLTERGEAQARAAGALLARLDLLDPFVLTSPRLRAVRTAELVGFGGSPVDDDLAEWDYGDYEGRTSAEIQRTDPGWTIWTGTVPGGETRAQVRARADRVLAAVDAVLPERDVLLIGHGHFSRSLIARWAEFDVVEGRRFAMNTAALSVLGFHHDARAVLAHNWIPTTEGAAP

SEQ ID NO: 68643 - protein, 418 aa, Geobacillus kaustophilus HTA426
MMKCCRRVALVLLGLWFVFCISVLGGRAEAAASRANDAPIVLLHGFTGWGREEMFGFKYWGGVRGDIEQWLNDNGYRTYTLAVGPLSSNWDRACEAYAQLVGGTVDYGAAHAAKHGHARFGRTYPGLLPELKRGGRIHIIAHSQGGQTARMLVSLLENGSQEEREYAKAHNVSLSPLFEGGHHFVLSVTTIATPHDGTTLVNMVDFTDRFFDLQKAVLEAAAVASNVPYTSQVYDFKLDQWGLRRQPGESFDHYFERLKRSPVWTSTDTARYDLSVPGAEKLNQWVKASPNTYYLSFATERTYRGALTGNYYPELGMNAFSAVVCAPFLGSYRNATLGIDDRWLENDGIVNTFSMNGPKRGSTDRIVPYDGTIKKGVWNYMGTYNVDHLEVIGVDPNPLFDIRAFYLRLAEQLASLQP

SEQ ID NO: 68644 - protein, 289 aa, Legionella pneumophila subsp. pneumophila str. Philadelphia 1
MSDYLDKTASLTPAIKRIVCDKATEYPHTGSYNQVATHGTYLCRRCGLALFRGVSQFSSGCGWPSFDDEIANAVARKPDADGQRTEILCARCDAHLGHVFTGEYMTYKNLRHCVNSASLDFVADNEVLDTEEAILAGGCFWGVEYYLKRTPGVLKVESGYTGGHVSEPSYEQVCSGTSGHYEAVRVVYDAAKTNYHDIVKRFFEIHDPTQTNGQGPDLGHQYLSAVFYFNQEQRQEAELLIQLLKKRGYQVVTQLLQAQPFWPAEDYHQDYYFKHHKIPYCHKSVDRFG

SEQ ID NO: 68645 - protein, 94 aa, Triticum aestivum
MASGQEKGRSELDSLAREGQTVVPGGTGGKSYEAQEKLAEGHSRGGQTRKEQMGEEGYSEMGRKGGLSTNDESGGEHAAREGIDIDESEFKTKS

SEQ ID NO: 68646 - protein, 509 aa, Phaseolus vulgaris
MCLQILTKIFLTHSSHQYQQQTLSFGSAIKTNPSHHHQGLGMEAHSIDGVSSQTDSKFYDDDGHVKRTGNLWTTSSHIITAVVGSGVLSLAWAMAQMGWVVGPAVMIFFSVVTLYTTALLADCYRSGDPISGKRNYTFMDAVQTILGRHYDTFCGVIQYSNLYGTAVGYTIAASISMMAIKKSNCFHSSGRDGPCQISSNPFMIGFGIIQIVFSQIPDFHKTWWLSIVAAVMSFAYSIIGLSLGIAKVAETGFKGSLTGIKIGAVTETQKVWGVFQGLGDIAFAYSYSQILIEIQDTIKSPPSEAKTMKKAAKLSIGVTTTFYMLCGFMGYAAFGDTAPGNLLTGFGFYDPYWLVDIANAAIVIHLVGAYQVYSQPLFAFVEKWVSKRWPNVDKEYKVPIPGFAPYNLSPFRLVWRTGFVIITTIVAMLIPFFNDILGLLGALGFWPLSVYFPVEMSIKQKKIPKWSQRWIGMQILSFVCLVVSVAAAIGSIASIVVDLQKYKPFHVDY

SEQ ID NO: 68647 - protein, 156 aa, Desulfovibrio desulfuricans G20
MMHLKTIEGQFDAKGLKFAIIATRFNDFVVDRLVGGAVDYLTRCGGSREDMTLIRLPGAFEMPVAAKKLAASGKYDGVIALGAVIRGATPHFDFVANEATKGLAQVALESGVPVGFGLLTTDTLEQAIERAGSKGGNKGVEAASAVLETIRVLEQL

SEQ ID NO: 68648 - protein, 545 aa, Geobacter metallireducens GS-15
MISASNVTLSYGKRVLFKDVNIKFTPGNCYGLIGANGAGKSTFLKILAGEVEADKGEISVGSGERIAVLRQDQFAFDEEVVFNTVIMGHERLYKVMAEREEIYSKGDFTEEDGIRSAELEGEFAEMNGYEAESEAAVLLNGLGIPEELRHKKMKELEPGEKVRVLLAQALFGNPDVLLLDEPTNNLDLKSITWLEDFLSRFQNTVIVVSHDRHFLNQICTHVADIDFGMIKVYVGNYDFWYQASQLTLRQKQEENRKSTEKANELKEFIQRFSSNASKAKQATSRKKLLEKLTLEEMPVSSRKYPYVVFKPERACGDIILEIQGLSKSVDGVQVLNNLDLIVRKGDKIAFVGANSQAKTTLFQILTGELEPDAGTFRWGVTITHSYFPKENSAFFEGDLNLIEWLGQYSPPTEGESFARGFLGRMLFSGDEATKKTSVLSGGERVRCMLSRMMLTGANVLMLDEPTNHLDLESITALNNGLIAYPEVILFASHDHEFVSTVSNRIVELTPGGVIDRVMSFDDFLEDEGVARERDELYHGHVEASL

SEQ ID NO: 68649 - protein, 296 aa, Saccharophagus degradans 2-40
MLELSPANQTDYSLGFGGDTLNTAIYFARLGGEVDFVTALGDDHLSENMIRAWDKENVGTSLVKRTPGALPGLYMIQTDDEGERSFHYWRKNAPARTLIEDWPEVLTNLNAFPAIYLSGITLSLYSPQSRTALFNFLDEYRAQNGQVIFDINYRPASWPDKTEALATFDEMLKRTDTALPSFDDEKLLHGEHSKTECLERYLTAGAKEVVIKDGVNGCLLHTNNQSVLLPVPAKVTPVDTTAAGDSFNGAYLAARLNGASAERAVAQGQACAALVIQHRGAIVPINAFRASDIKNN

SEQ ID NO: 68650 - protein, 380 aa, Staphylococcus aureus subsp. aureus MRSA252
MEIYADYAATTPVKPEVVDAMMTIYNSHYGNPSSIHAKGRDARKYLDESRRQIAQLLGADTHEIIFTSGATESNNTAIKGIVKANEQLGNHIITSKIEHHSVLHVFEQLEREGFDVTYLDVDDTGAIDLDQLEETITDKTILVSIMFVNNEVGTVQQIYDIQDIIAETNAYFHVDAVQAIGHLDVKFDEFEIDAMSITAHKFGGPKGVGALLVKDHVTLDYPQLGGEQELKRRAGTENLAQIVGMAKALQLAEKNRDDNNIHLMNLKEQFLVKLQERAIPFELNGSMTDATGHIVNLYFPFVEVETMLTLLDMAQIYVSSGSACTAGSTQPSHVLDAMFEDEERSNHSIRFSFNELTTENEINAIVAEIHKIYFKFKEES

SEQ ID NO: 68651 - protein, 784 aa, Debaryomyces hansenii CBS767
MTEETRSEVLDFGGANSSISKTPTSSHLSNNHSRHESSLRNDNKRKKPNIKQVNKSHLSAQKEKVKILVHQVIDLILQESKLEYSFDIYYRGVESLCRFKHIEQSILADHLKLKLEDHFHYHIKPDITRILEDNLLTLSESITKYLEIYEKWKHKLQLLSKLFLYLDRCYLMQHPSRKMILELGMTLFVEGLLADNNEGTNRLADITLRKHIQLLKKVGEFEDIRDLKLAKHLSTVLVKLNFNHQIRLHTDLINLIISHYNSLKDLWIEKPETYIHIALTKISREMTFFKDCGYEREFLIEFLLKLKWILIFQNFNTMIRSCIPFMVHDKNLKQFEIIYDYCGRSLDEYQLDAMSIFVYEWGQHIIHSIKEIIDSNKSNLKKIIPLLVESNLKYKSIAGDKFNKNELFEFEVRKSFTKSFNEKKINTLIIFQLCKYCDSFFKNINKKSNKDESINLSFNEFQQHVLIIFKALNNKNDFISHYKKELSKRLLLGKSPSYSLERKLVESFLKLIGEGEETVGLQIMFKDLELSKEKYSLMTLDDSTVDFTALVLEQKHWPEMPKLDSDIILLPQLTTILDSFTALYHNSDEKLKNRTLDWSHYPLHQLTIKANFDNGEKELDVNLLQAIVILLFNDKNSYTYDEIFALSNISDKLLKKVLGSLSSDKYRILLKDNATYSFNSKFTDKATKIKITLSKDREISTGLFDSDATKALERNRSVEFRSALVRVMKSAKRISYLDLLTQTLPLVEKNGPCTIADLKSNLEYLIENEFVKRELDGQSLSYIP

SEQ ID NO: 68652 - protein, 337 aa, Sulfolobus tokodaii str. 7
MRQVCMRCGMEREGLEVRCKRCGGPFKVEVEDIPFSKNLRENFPYIKNWISLGEWHTPMIRSNNVYFKLDFLNPTGSYKDRGSVTLISYLAERGIKQISEDSSGNAGASIAAYGSAAGMRVKIFVPSTARGNKLKQIEIYGAEVIKVEGSREDVSKAAENSSYYYASHVLQPQFRDGIRSLAYEIVSDLGWRSPDNVFLPTSAGTLLLGVFEGFRHMFNQGIISKIPRLIAVQTEQVMPLCSKIKGLKYTPPEKVTSIADALVSTSPFLLPEMEKIVKEYGDCIVVSDEEILNSWKELAKKGILVEYSSATVYSAYKKINPEGTSVLVLTGSGLKVL

SEQ ID NO: 68653 - protein, 123 aa, Debaryomyces hansenii CBS767
MFRSTLFRSLRTPLVRQPIAPAAISITKPSFVRFYAGFPALSRDLAKERIVELLEGYDKVDSAKEITEESAFVQDLGLDSLDVVEVVMEVEHEFNIQIPDHEADTLKTVGQTVDYILAQPDAC

SEQ ID NO: 68654 - protein, 272 aa, Sulfolobus tokodaii str. 7
MKLGVNKFLVEEFIPHEKEIYLSALIDRDVAEPIIVASPEGGIDIESSKNVKIFHIPIERGVRSYDVIKIEKYLNVKGLEPIIKGLYKLVTEYDAELAEINPLAVTVDGRLYALDSKVILEDNALFRHQDLLEKIGRSPSKDAYVELDGDIGIIGNGAGLTMATMDMVKLMGGSPADFYDVGGGADREKVKEAVLKIGSNPKVKKIIINIYGGITKCDEVALGIVDAYSLIKKPIYVRLVGTNEEQGRKILQDNGIKYYTDALSCIGDALRS

SEQ ID NO: 68655 - protein, 332 aa, Helicobacter pylori J99
MKIFINGFGRIGRCVLRAILERNDTNPQLEVIGINDPANWEILAYLLEHDSTHGLLNKEVRYSNGKLIIGSLEIPVFNSIKDLKGVGVIIECSGKFLEPKTLENYLLLGAKKVLLSAPFMGEYDEKQYPTLVYGVNHFLYQNQAIVSNASCTTNAIAPICAILDKAFSIKEGMLTTIHSYTSDQKLIDLAHPLDKRRSRAAASNIIPTTTKAALALHKVLPNLKNKMHGHSVRVPSLDVSMIDLSLFLEKKALKDPINDLLITASKGTLKGVLEIDLKERVSSDFISNPNSVIIAPDLTFTLENMVKIMGWYDNEWGYSNRLVDMAQFMYHY

SEQ ID NO: 68656 - protein, 529 aa, Borrelia garinii
MEEYLNFMNNNKETKLKDLENQEFDLIIIGGGATGLGIAVDAITRGYKAILIEKFDYAKGTSSRSSKLIHGGVRYLAQWNISLVKEALHEKAILEKNAPHLINECAFITPIYNILEIPYYYLGLTYYHNLMGKEKATKYKTKLLSKKSTIEKATNIKTKGLKCSVLYYDDSFDDARMAITLLRTFTEKGGIALNYTELVQFNKENGKLSGVLIQNKLSKEQISLKSKCIINATGIFSDEIRRLDDEKALNIIKPSQGSHLIIKKDKFPQNYAILIPKTSDNRILFAIPWYDGVVCGSTDIPIKEIEVEPKRLDEEIDFIINNLNNYLNIKIEKSDVKSVYTGIRPLIMDPKVEGNTSKISRNEKIFISDSNLITIAGGKYITYRKMAEKTLLKAIEKNLLPNYPPTTENLKLHGYLKKEEAVKIPESFRTYGSDFEILKNMEGFDKKIHESLDLNEAQIAFSIEFEQAKTIDDVLARRTRSLPLNPQAAIEAAPRVAEIMMKKLNKSEKWKNEQIKTFLEISKKYLIKN

SEQ ID NO: 68657 - protein, 527 aa, Borrelia bissettii
MEEYLNFMDNNKETKLKDLENQEFDLIIIGGGSTGLGIAVDAITRGYKTILIEKFDYAKGTSSRSSKLIHGGVRYLAQWNISLVKEALHEKAILEKNAPHLINECALITPIYNVLEIPYYYFGLIYYHNLMGKEKTAKYKTKLLSKTSTIEKAPNIKAEGLKCSVLYYDDSFDDARMAITLLRTFTEKGGIALNYTELKKFNKENGKLSGVLIQNKLSKEQISLKSKCIINATGIFSDEIRRLDDEKALNIIKPSQGSHLIIKKDKFPKNHAILIPKTSDNRILFAIPWYDSVVCGSTDIPIKEIEEEPKRFEEEIDFIINNLNSYLNIKIEKSDVKSVYTGIRPLIMDPKAKGNTSKISRNEKIFISDSNLITIAGGKYTTYRKMAEKTLLKAIEKNLIPNCAPTTEDLKLHGYLKKEEAMKIPEPFRAYGSDFEILKNMRGFDKKIHENLDLNEAQIAFSIDFEQAKTIEDVLARRTRSLPLNPQATIEAAPRVAEIMMKKLNKSEEWKNEQIKSFLEISKKYII

SEQ ID NO: 68658 - protein, 168 aa, Triticum aestivum
  misc_feature (45)..(45): Xaa can be any naturally occurring amino acid
  misc_feature (73)..(73): Xaa can be any naturally occurring amino acid
  misc_feature (92)..(92): Xaa can be any naturally occurring amino acid
  misc_feature (130)..(130): Xaa can be any naturally occurring amino acid
MLAMLWLRNLRLSRFGRALFRGIFVQNLQSCNFLLDDNDHAVLGXFGIPSLLFGLPLPNPDLIQRLGTPNYMXPEHWRPNIRGPISYETDSXWGFAWSILEMFSGVQTWCAKSPDEIYQSVVLKKEKPMXPVQLPTEVANVLSGCYEWEVTHELARIADIKYLQLRPL

SEQ ID NO: 68659 - protein, 500 aa, Glycine max
MGPLLYSSLLVLVLILRFVQRRRVKNLPPCPPSLPLIGNLHYIKSPLHRSLLSLSEKYGPIFSLWFGSRFVVVISSPTLLQECFTKHDIVLANRPRFLTGKYLFYNYSSMGSSPYGDHWRNLRRIITIDVLSTSRLNSFFEIRREETMRVIQKLARETCNGFALVHLRPRLTEMTFNNMMRMISGKRYYGDDIEAADAEEAKQFRDIMTEVMSLLGANNKGDFLPFLRWFDFDGLEKRLKVISTRADSFLQGLLEEHRSGKHKANTMIEHLLTMQESQPHYYSDHIIKGLIQGMLLAGTDTTAVAIEWAVSSLLNHPEILKKAKDEIDNMVGQDRLVDESDIPKLPYLQNIIYETLRLFAPAPLLLPHYSSEECTIGGFTIPRDTIVLINAWAIQRDPEHWSDATCFKPERFEQEGEANKLIPFGLGRRACPGIGLAHRSMGLTLGLLIQCFEWKRPTDEEIDMRENKGLALPKLIPLEAMFKTRPISEKVMQQLAIFGT

SEQ ID NO: 68660 - protein, 495 aa, Pyrus communis
MASSASENRLLLSRIATNEKHGENSPYFDGWKAYDQNPFHLTENPEGVIQMGLAENQLSFDLVEEWIRKNPKASICTAEGIEKFRSVANFQDYHGLPEFRQAIASFMWKARGGRVTFGPHRVVMSGGATGANELVMFCLANRGDAFLIPSPYYPAFYRDLGWRTGVQIVPVDCDSSNNFKITKEALEAAYGKAQNNNINVKGLIITNPSNPLGTTLDKDTLESLVTFINQKNIHLVCDEIYAATVFSSPKFTCITEVIQNMNCNPNLIHIVYSLSKDMGFPGLRVGIVYSYNDDVVNIGRKMSSFGLVSSQTQHMLASMLSDEDFVEKFLTTSAKRLAKRHGVFTDGLEEVGINCLKSNAGLFCWMDLRRLLRDQTFDGEMVLWRVIVNEVKLNVSPGSSFKCVEPGWFRVCFANMDDDTVEVALKRIRAFVGQAKKAQEQAQVKSPKKRWQSNLRLSFSSSSRRFEQEGVSVMSPRMMSPHSPMPHSPLLRATT

SEQ ID NO: 68661 - protein, 331 aa, Oceanobacillus iheyensis HTE831
MVQGSVNLNTERGKEWLQDYVDNWVNFYQKQTDEGKVASYIPRLEHADPNALGISIIGKNGTVIRSGDTDLEFSIQSISKVLSFIVACMERGLSYVLQRVDVEPTGESFNSIMHLEINQPKKPFNPLVNSGAITVSSLLNGRTSDQKLEPLYQLLEKILGHRPEIDVEVYVSERDTSMRNRAIGYYLLEEGYLESDLSITLETYFKHCSLNVTVDDLAMIGLVLSNDGVHPNTDEPLIPKQIARVAKSLMLTCGMYDASGKFASYVGIPAKSGVSGGILAVVPPRVRDQNLPFLEGCGIGVFGPALDKQGNSIAGIKLLRHIANQWDLSLF

SEQ ID NO: 68662 - protein, 442 aa, Bdellovibrio bacteriovorus HD100
MSEFELNLDKYSDVIQSVHLTKDSGKVTEVNGMLIKGYLPGASVGSIVSINPSGMEKSFLAEVVGFKDKHVLMMALNDMRGVALGSKIVLARQIATVRAGEELLGRVVDGLGRPLDDKGEVENFREVPLYSEVRNPLDRRPIREPIDLGIRAINGALTAGLGQRVAIMAGSGVGKSVLLGMMARNTNADVNVIAMIGERGREVREFIEHDLGPEGMKRSVVVCVTSDQSPLLRMRGAYVATALAEYFSSQGKNVLLMMDSVTRFAMAQREIGLSTGEPPSQKGYTPSVFATLPKLLERAGSFEGEGSITGFYTTLVEGDDMNDPIGDSVRSIVDGHIVLSRSLAQKGHFPAIDIMQSASRVMRAVSSPEHSKLAQKLRETLAVYKDAEDLINIGAYKPGSNPKIDRAVKVIDQVNDFLKQRVEDPTNFTQTVRQMQQILINA

SEQ ID NO: 68663 - protein, 253 aa, Arabidopsis thaliana; identical to SEQ ID NO: 851

SEQ ID NO: 68664 - protein, 379 aa, Shewanella sp. MR-4
MSNEKPQFIKSKAAVAWGPGQPLKIEEVDVMLPKAGEVLVRIVATGVCHTDAFTLSGDDPEGVFPAILGHEGGGIVEQVGEGVTSVQVGDHVIPLYTPECGECKFCLSGKTNLCQKIRATQGKGLMPDGTTRFYKDGQPIFHYMGCSTFSEYTVLPEISLAKVNKTAPLEEICLLGCGVTTGMGAVMNTAKVEEGATVAIFGLGGIGLSAIIGATMAKASRIIAIDINESKFELARKLGATDCINPKHFDKPIQEVIVEMTDGGVDYSFECIGNVNVMRSALECCHKGWGESVIIGVAGAGQEISTRPFQLVTGRVWRGSAFGGVKGRSQLPKIVEQYLAGEFKLDDFITHTMGLEQVNEAFDLMHEGKSIRSVIHFDK

SEQ ID NO: 68665 - protein, 340 aa, Shewanella oneidensis MR-1
MTRYEQIKQELLNSPKTWLITGVAGFIGSNLLEQLLKLNQTVIGLDNFATGRQHNLDEVQSLVTSEQWMRFSFINGDIRDYAICEAVVNGVDYVLHQAALGSVPRSIADPITTNAANITGFLNMLQAAKEAEVKSFTYAASSSTYGDHPALPKVEQNIGNPLSPYAVTKYVNELYASVYARTYGFETIGLRYFNVFGRRQDPNGAYAAVIPKWTSSMIKGEDVFINGDGETSRDFCYIDNVVQMNILAATAASEAKNEVYNVAVGDRTTLNDLYFAIKDSLNANGINVNQNPNYRDFRAGDVRHSQADVSKAVTRLGYQYTHKILEGISEAMPWYKEFLA

SEQ ID NO: 68666 - protein, 198 aa, Shigella boydii
RRELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVA

SEQ ID NO: 68667 - protein, 426 aa, Shewanella oneidensis MR-1
MMFDVVNAKIGIIGLGYVGLPLAVEFGKQRLTIGFDINQARINELSAGHDSTLECSDTELAEAKKLVYTTSLEALKECNVFIVTVPTPIDEHKQPDLTPLIKASETLGKVIKHGDVIIYESTVYPGATEEECIPVVEQVSGLKFNQDFFAGYSPERINPGDKEHRVTNILKVTSGSTPEVAEYVDQLYKSIIVAGTHKASSIKVAEAAKVIENTQRDVNIALINELSIIFNKLGIDTLEVLEAAGTKWNFLPFRPGLVGGHCIGVDPYYLTHKAQSVGYHPEMILAGRRLNDGMGQYVVSQLVKKMLKKRIHVEGANVLVMGLTFKENCPDLRNTKVVDIVRELKEYNINVDIVDPWCESHEAEQEYGLTLCGQPKVNHYDAIIIAVSHNEFRAMGAEAIRALGKPEHVLYDLKYVLNKESVDMRL

SEQ ID NO: 68668 - protein, 483 aa, Arabidopsis thaliana
MIARRIWRSHRFLRPFSSSSVCSPPFRVPEYLSQSSSSPASRPFFVHPPTLMKWGGGSRSWFSNEAMRTDSNSGLIDVPLAQTGEGIAECELLKWFVKEGDSVEEFQPLCEVQSDKATIEITSRFKGKVALISHSPGDIIKVGETLVRLAVEDSQDSLLTTDSSEIVTLGGSKQGTENLLGALSTPAVRNLAKDLGIDINVITGTGKDGRVLKEDVLRFSDQKGFVTDSVSSEHAVIGGDSVSTKASSNFEDKTVPLRGFSRAMVKTMTMATSVPHFHFVEEINCDSLVELKQFFKENNTDSTIKHTFLPTLIKSLSMALTKYPFVNSCFNAESLEIILKGSHNIGVAMATEHGLVVPNIKNVQSLSLLEITKELSRLQHLAANNKLNPEDVTGGTITLSNIGAIGGKFGSPLLNLPEVAIIALGRIEKVPKFSKEGTVYPASIMMVNIAADHRVLDGATVARFCCQWKEYVEKPELLMLQMR

SEQ ID NO: 68669 - protein, 397 aa, Yarrowia lipolytica CLIB122
MASPEKETPDIGAEYETWKRNCPYMYSFVSETTMTWPSLTFDWCGYREDEAAGMGVHQALAGTFSQDKEEKEKIVLMESTIPLDLGDLGKLGPNGRPADLRFKTVKEWSHDGEPNKIKSCGDLMASINGEGTIFVRSVTGSVDETPVTLKEHTTNAFGLAWSVGRGGAGDPEALVSGGEDGKVILWNLESKKSTWNITTSSVNDVECHKTFPYIIGAALEEGFIALYDTRAPETAGGTLTRPPSGDKPTPYNCLAFSPHSEYLFAAGSSESTVNLYDIRNTGYRLHSLSGHNGAVTGIEFDPFHGQYLATGGQDRRVIIWNMNTIGCEQSQDDAEDASPELFFMHGGHTAPVSAFAYNPEMEWCLGSVSEDNIAQIWGVSDKIYSPTELEVIEDTLE

SEQ ID NO: 68670 - protein, 493 aa, Geobacillus kaustophilus HTA426
MRIKQHYPLFINGQYVESSNGEVFETVNPATEEVIATVAKATKEDVDHAVEAARTAFESGKWPKMTGAKRARLLNQIANLMRERFDDLVYAEVLNSGKTVDAAKGQIMQAIEDFEFYAAAAITLQGDVNQVPNGFFNYTVKEPVGVCGQIIPWNYPLMMAAWKLAPALAAGCTVVLKPASYTPITAYMLAEICQEAGVPDGVVNVIAGSGSEIGPYMTEHPGIDKVAFTGETETGKDIMRRASETLKRVTLELGGKSPNIVFDDCDIEAAVNGSLYGIFYNTGQSCEARSRLFVHENIYDEFMEKLIEKASRIRVGNPFEKGVHMGAVISRSHQQVIDSYVKLAVEEGGEILYGGKIPEGEEFAKGYWYMPTIIGNVRNDMRVAQEEIFGPVVVVMKFHDEEEVIELANDTIFGLGSAVWTKDHGKAHRVAACIRAGIVMINSPISAFPGTPFGGYKQSGFGRELALETLNLYTETKSVVSYIGAKPLNLFGI

SEQ ID NO: 68671 - protein, 257 aa, Staphylococcus aureus subsp. aureus MRSA252
MKHQFSRNELAIGHQGLDLLKQQTVVILGVGGVGSFAAEALARTNIGHIILIDKDDVDITNVNRQLHALTTTVGQSKVSLMEERIKLINPDCKVTPLHMFYTEETYEEIFDNYDIDYFVDASDTIMYKVHLMKECLDRGIKVISSMGAANKTDPTRFTISDISKTHTDPMAKIIRQKLKKLGIRKGIPVVFSDESPIVIREDVKDIVGDKNAINRKGQMPPSSNAFVPSVVGLICASYVVNDVLKDIPVRRIKDKGQ

SEQ ID NO: 68672 - protein, 396 aa, Robiginitalea biformata HTCC2501
MTIDKFDFKDKKALVRVDFNVPLNEDFQVTDTNRIEAAKPTIIKILEDGGSAVLMSHLGRPKGSPNPDLSLSHIVDTVSDIIGVEVKFASDCIGDSAAAEVEALQSGEILLLENLRFHGEEEAGDREFARKLSQWGDIYVNDAFGTAHRPHASTTVVAEFFPEKKCFGYLLAREIEAIDKVMETGEKPVTAILGGAKVSSKITIIENILDKIDHLIIGGGMTYTFVKARGGSVGDSICEPDKTDLALSILEKAKAKGVAVHLPVDVVAADAFDNDAESRIMAVDAIEDGWQGLDAGPETLERFRKVILESRTILWNGPVGVFEMPNFAKGTIAVGNYVAEATRNGAFSLVGGGDSVAAVKQFGFDEKVSYVSTGGGAMLESLEGRTLPGIAAIRGS

SEQ ID NO: 68673 - protein, 681 aa, Debaryomyces hansenii CBS767
MSDANDTSGNLSPGFENLNIRTPKAVNTESTQSPQRVSHSQINGDIQARILAFQQKRTKPVNGGHGALNPISKSTSHLSEAPDKPLPPLPPLPTLPTMLLQQRSYSLGDTSDPGLIPSPMETENIQNTNHSVNRSMGQSMSQVMGQGISRTSSLKKQEPQQLPFELLKKPSLSQRRGMKLNLSEMSSPTSASSPDDTSPIGDGKESLVFLNAPKGSVLDNNAMNTTGDLTRRVSERKNKPNFKLNLANTGGPGVSGMNPQSTSNSNSNSTISSLNSSGSSSTMATNNETNQSKKPQLQGLFANYSKYVDIKSGSLNFAGKASLHSKGIDFLSGLLFRISLEELEFLEELGHGNYGVVLKVLHKPTGVLMAMKEVRLELDETKFTQILMELEILHKCDSPYIVDFYGAFFVEGAVYMCMEYMDGGSLDKIYGKDDGVNDEACLAYITECVIRGLKELKDEHNIIHRDVKPTNILVNSLGKVKLCDFGVSGNLVASLAKTNIGCQSYMAPERIKSLSPTDNTYSVQSDIWSLGLSILEIAAGHYPYPSETYGNIFSQLSAIVDGDPPRLDPKAFSKDAQLFIKSCLNKNPDLRPSYATLLKHPWLVNHRDIDPHMDKFVTKKLEELEEQKNKKNLSRSNSVNSSTTTAKPPKESVRSLLKGKVQAPALHRGGLMNSNRNSVNR

SEQ ID NO: 68674 - protein, 322 aa, Saccharophagus degradans 2-40
MQNLQGMLRDQRVAQDLQEVIFSIELACKDIAKKVQLGALAGVLGATESENVQGETQKKLDVISNDILKASLAANSNVLALASEEEDNVVAANAGGRYVVAFDPLDGSSNIDINGQIGTIFTIFEALDGVAANSGKHFLQQGNKQVCAGYVLYGASTLMVITVDGPTSCLTLDPATQTFSLTNTALQVPDQTQEFAVNLANERFWLPKFKSYVADLKLGEEGVRGKRFNMRWNASMVGDVHRVLMRGGIFMYPSDTRNPKQPAKLRLLYEANPMALLIERAGGKAFNETQRILDVTPCALHERIAVILGSEQEVATCLEYLN

SEQ ID NO: 68675 - protein, 448 aa, Chlamydomonas reinhardtii
MALREVSQKRVLPLLAQFTRGLSASAMPEQVSLDANAPISQPAPFSYVPPGRNHLFVPGPVNIHERVLRAMHVPGQNHRDPWFAEFYKECLEDTKHMYGTKAATPFIFPGTGTGGWEAALCNTLSPGDKVICFRYGLFSHLWIDMMQRLGLDVTVVDRPWGEGADEGALEELLRKDTGKKIKAVCVVHNETTTGVTSDIAGCRKAMDAAGHPALLLVDGVSSIGALEFKMDDWRVDVAVTGSQKAMSLPTGLAFVAASPKALEAMKSAKLKRVYYDFADMLRTNPSGNVPYTPCLSLLYGLRESIKMWKEEGGMEAVAARHHRLAEGVRQAVDGWGLKLLCKNPRWRSDSLTVVEVPEGVDSNKIVKNAYAKYDLSLGIGLASINGKVFRIGHLGNMNELMLAGALVGAEMAMIDSGISIKPGSGVARATEYWHKTGSVIKTRESLLK

SEQ ID NO: 68676 - protein, 437 aa, Chlamydomonas reinhardtii
MALREVSQKRVLPLLAQFTRGLSASAMPEQPAPFSYVPPGRNHLFVPGPVNIHERVLRAMHVPGQNHRDPWFAEFYKECLEDTKHMYGTKAATPFIFPGTGTGGWEAALCNTLSPGDKVICFRYGLFSHLWIDMMQRLGLDVTVVDRPWGEGADEGALEELLRKDTGKKIKAVCVVHNETTTGVTSDIAGCRKAMDAAGHPALLLVDGVSSIGALEFKMDDWRVDVAVTGSQKAMSLPTGLAFVAASPKALEAMKSAKLKRVYYDFADMLRTNPSGNVPYTPCLSLLYGLRESIKMWKEEGGMEAVAARHHRLAEGVRQAVDGWGLKLLCKNPRWRSDSLTVVEVPEGVDSNKIVKNAYAKYDLSLGIGLASINGKVFRIGHLGNMNELMLAGALVGAEMAMIDSGISIKPGSGVARATEYWHKTGSVIKTRESLLK

SEQ ID NO: 68677 - protein, 535 aa, Lotus japonicus
MGLMPDFLSLCHEFPWTFLLVVIFSFMIFKVTKTHLVNKSKKYKLPPGPKPWPIVGNLPEMLANRPATIWIHKLMKEMNTEIACIRLANTIVIPVTCPTIACEFLKKHDASFASRPKIMSTDIASDGFITTVLVPYGEQWKKMKRVLVNNLLSPQKHQWLLGKRNEEADNLMFYIYNKCCKDVNDGPGLVNIRIAAQHYGGNVFRKLIFNSRYFGKVMEDGGPGFEEVEHINATFTILKYVYAFSISDFVPFLRRLDLDGHRSKIMKAMRIMRKYHDPIIDDRIKQWNDGLKTVEEDLLDVLIKLKDANNKPLLTLKELKAQIIELAIEMVDNPSNAFEWALAEMINQPELLKRATEELDNVVGKERLVQESDIPKLQFVKACAREALRLHPMEYFNVPHLCMNDTMVGDYLFPKGTQVLLSRVALGRNPKFWTDPLKFNPERHLKEGIDVVLTEPDLRFISFTTGRRSCPGVALGTTMTVMLFARMLHGFSWSPPPDVSSIDLVPSKDDLFLAKPLLLVAKPRLAAELYRTNEI

SEQ ID NO: 68678 - protein, 303 aa, Helicobacter pylori J99
MSNPNLSFYCNECERFESFLKNHYLHLEGFHPYLEKAFFEMVLNGGKRFRPKLFLAVLCSLVGKKDYSNQQTEYFKIALSIECLHTYSLIHDDLPCMDNAILRRNHPTLHAKYDETTAVLIGDALNTYSFELLSNSLLESRIIVELVKILSANGGIKGMILGQALDCYFENTPLNLEQLTFLHEHKTAKLISASLIMGLVASGINDEELLKWLQAFGLKMGLCFQVLDDIIDVTQDEKESGKTTHLDSAKNSFVNLLGLKKASGYAQTLKTEILNDLNALEPTYLSLQENLNALLNTLFKGKT

SEQ ID NO: 68679 - protein, 444 aa, Aspergillus nidulans FGSC A4
MPLWRTKSHHSQAESDSASVQNKADTTPADPKNDPVASASQAASDAWLVGHLNHLTEEQEAKLTEFKAFCEKEGYYKPGGEGEKPSHDDATMLRFLRARRFDVNGAWGQFKDTEDWRKENAIEALYENIDVDSYEAARRMYPQWTGRRDRRGIPVYVFEIKHLNSKNMAAYNATMADPEATAETHKSSAVPQRLLRLFALYENLLNFVMPLCSELPRPHPETPIVSSNNIVDVSGVGLKQFWNLKGHMQDASVLATAHYPETLDRIFIIGAPAFFPTVWGWIKRWFDPVTTSKIFILSASEVLPTLTSFMEPSSIPKQYGGELDWQWGDMPNLDEPARELIGALETAPADGQTKPGFIKGPVLFKGDKVEVLGKENGKSRATTVPVPESKLAQTNGVSATNQSEKEQELQPAAEKEQEVSEKVFGNDTAAKTNGDVAPPTQLSA

SEQ ID NO: 68680 - protein, 121 aa, Oryza sativa Japonica Group
MAAASATAQAEGTVIAIHSLDEWTIQIEEANSAKKLVVIDFTASWCGPCRIIAPVFADLAKKHTNAVFLKVDVDELKPIAEQFSVEAMPTFLFMKEGDVKDRVVGAMKDELASKLELHMAM

SEQ ID NO: 68681 - protein, 121 aa, Arabidopsis thaliana
  misc_feature (83)..(83): Xaa can be any naturally occurring amino acid
MASFMVFFTGGGTFPAQATMVASFTGLESFASFPGTRKGHHHLTFITSHGRRSSCVKGGPPIGKKKVETFFYLPDLNDLELAXKEVTTLFRTRGFPGVKSKWNPELGSRNPGTLPGSYNGQ

SEQ ID NO: 68682 - protein, 386 aa, Thermoplasma volcanium GSS1
MKQSTIGRNIVDEISFGAIVKIRDQLLEMQRQGKKVYRLESGDPSFSLPPHVKEAIKQAIENNKTHYTDSTGIPELRKAIAEKLVRKNKIKDATPENVIVSNGGMNALYVTFRSLLSPGDEVIIPDPMWTEIAEIIKLAEGVPIRLPVENYIEEMQKYEDDDKVKAVFVNSPHNPTGLVFTPKQIDGIISFAESKGIFIVSDEAYEDVIFDGREHVSPGSKYDNTISLFSMSKTYAMSGLRIGYAHTNSEILYDRMKKLLRCTINGVNSATQYGAVAALTGPQEFVGQMRSEYQKRRDIIFNAVSKSRYLEPVKPGGTFYLWAKIKEYPKEVKDSWDMTYYLLDKTGVGSSPGPVFGPAGDGYIRFAFSADTEHVREASELIEKFE

SEQ ID NO: 68683 - protein, 433 aa, Neisseria meningitidis FAM18
MPSEHQHTSSLLDFDRTHLLHPYTSMTDPLPVYPVKRAEGVFIELADGTRLVDGMSSWWCAIHGYNHPVLNQAVETQIKQMSHVMFGGLTHEPAVELGKLLVGILPQGLDRIFYADSGSVSVEVALKMAVQYRQVRGLTAKQNIATVRRGYHGDTWNAMSVCDPETGMHHIFGSALPQRYFVDNPTSRFDDEWDEADLQPVRALFEVHHADIAAFILEPVVQGAGGMYFYHPQYLRGLRDLCDEFDIVLIFDEIATGFGRTGKMFACEHAEVVPDIMCIGKGLSGGYMTLAAAITSQKVTETISRGEAGVFMHGPTFMANPLACAVACASVKLLLSQDWQANIRRIESILKGRLKAAWDIRGVKDVRVLGAIGVIELDKGVDMARFQADCVAQGIWVRPFGRLVYLMPPYIISDGVLTKLADKTVQILKEHSK

SEQ ID NO: 68684 - protein, 257 aa, Sulfolobus tokodaii str. 7
MKEYSGRVLNIFRKLYGKEIYAKVESWSNFPKSTGLASSAAGIAALVYATNEALELGLSQKELSKIARIGSGSACRSTAGGFVLWEKGERDDGEDSYCYSLFPENHWKELVDIIAIVSEKSKKISSREGMIITAKTSNLMKCRLKFIEETLPKVIKSIEERNEKEFYYWLMRHSNSMHAVILDSWPSFFYLNDTSLKIMEWIQEFGKAGYTFDAGPNPHIFTTEKYKDEVIRFLNSIGVNKIIISKVGSGPKVNKLL

SEQ ID NO: 68685 - protein, 694 aa, Magnaporthe grisea 70-15
MDPESRARDEREELLAADDPDHDVPSKEDEEGLLPRRPAPPGRRLGSSIAMLLLVAFSLVLLGGAALSGMVVMQTEPAAPPSPPAADDPAKAKTPEESGKSGILPAADAFDLRKTNFFVTDQDAQMREYEFNITRVEVEGPDGVKKSMVLVNGQSPGPLIEANSGDLVKVVVHNSMPGDERTTIHWHGIDQRDSVQMDGVWGVTQCGIPPGESYTYVFGVPQQRGTFWYHAHVSVQYTDGLYGPMIIHDPTEKVPRVEEDRIIMIGDMHHMDGRQAVKEYLSPSSSWSPGMSGMEPYPDNIIINGRNVFNCSQPEEGEEIVGKRHEGEEMKCASGTRFNSRIKSNTAARLRIISHSSNTPMWFTVDNHTLEIVEMDGVEVEPVATTKIFINPGQRYSAILRANQTAGNYLMRAIATCAMLDPNPHSNFASVNSQGTAILSYDDVDAAAALIGKPWDLGAFVASKDVGTEPWHNRCSDLPFDLTKPMRPIDAYEVGDKNRHYFMFRFVDDGKGVQHTSINETIFTRLDNEATIWQVPDFDETSAAASSANSTIPLGGVFQPSQHVLYSADETKGAEIAISAGNMMSHPWHLHGQQFQIVGWGRGEFGRSKTTWNLANPTRRDTVTVPGHSHVVIRYKADNPGVWALHCHIQWHAEGGMFMQTAQRVSALKKLIDGMGAQGTDDVRHKFCKQPGKS

SEQ ID NO: 68686 - protein, 528 aa, Nocardia farcinica IFM 10152
MGCRSHPSAPARAPTGQRTRQEESPHVTTTETAPAAPDTTLKSVNPATGEVIATYPIADEDAVRAAVAKAREAAEVWGALSFDERRKHLLRWSSRLVADAEEFTELIHKENGKPRDDAFLELMLALEHIAWAAKNAKKVLGPKKIAPGALMSNFAARLESRPLGVVGVIGPWNYPVYTPNGSIGYALAAGNTVVFKPSEYSTGIGNFLAEAFKKANPELPEGVFETINGYGATGAALVKSGVDKIAFTGSTATGKRIMAAAAENLTPVLLECGGKDAVIVAPDADVKAAADAIAWGATGNSGQTCAGVERVYVHNSVKDQLVSEVTRILRDVKPGSDDKAAYGPMTMPSQIDIVRRHIEDALQKGGKAVLGGPDSIKGPFIEPVVLVDVDENSEAVTEETFGPTITITGVNSVDEAVELANKSKYGLSSSVYSKKQGLEIARKLKVGATSVNSVLGFAAIPGLPFGGVGDSGIGRIHGEPGLREFARPHSIAIQKFTIPGMALLSYSRTDSTMKLLRKMVPFLHGRNK

SEQ ID NO: 68687 - protein, 204 aa, Shigella boydii
RELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGFSF

SEQ ID NO: 68688 - protein, 384 aa, Mycobacterium sp. MCS
MARDYYGLLGVSKGASDQEIKRAYRKLARELHPDVNPDEEAQARFKEISAAYEVLSDPEKRRIVDLGGDPLESAGASGGNGFGAGFGGLGDVFEAFFGGGGGSRGPIGRVRPGSDSLLRMRLDLAECATGVTKQVTVDTAVLCDLCHGKGTHGTSTPATCDTCGGRGEIQTVQRSLLGQVMTTRPCPVCGGVGEVIPDPCHRCGGDGRVRARREISVKIPAGVGDGMRVRLAAQGEVGPGGGPAGDLYVEVHEKPHDVYVRDGDDLHCTVSVPMVDAALGTTVSVDDILGGPLELTIAAGTQPGAVSTLRGHGMPHLRSGVRGDLHAHIDVVVPAKLDHTDIELLRQLKEHRSRDVAEVRTSSSPAASNAGGLFSRLRETFTGR

SEQ ID NO: 68689 - protein, 403 aa, Hordeum vulgare
QVLFQGFNWESWKHNGGWYNFLMGKVDDIAAAGITHVWLPPASQSVAEQGYMPGRLYDLDASKYGNKAQLKSLIGALHGKGVKAIADIVINHRTAEHKDGRGIYCIFEGGTPDARLDWGPHMICRDDRPYADGTGNPDTGADFGAAPDIDHLNLRVQKELVEWLNWLKADIGFDGWRFDFAKGYSADVAKIYIDRSEPSFAVAEIWTSLAYGGDGKPNLNQDQHRQELVNWVDKVGGKGPATTFDFTTKGILNVAVEGELWRLRGTDGKAPGMIGWWPAKAVTFVDNHDTGSTQHMWPFPSDRVMQGYAYILTHPGTPCIFYDHFFDWGLKEEIDRLVSVRTRHGIHNESKLQIIEADADLYLAEIDGKVIVKLGPRYDVGNLIPGGFKVAAHGNDYAVWEKI

SEQ ID NO: 68690 - protein, 491 aa, Escherichia coli
MMSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 68691 - protein, 91 aa, Lentisphaera araneosa HTCC2155
MGRKIEGLLTGEGKKFAIVTARFNELITFKLEEGAIDCFRRHGVSEDNIDTVIIPGAFEIPVVADKLAATGKYDAVICLGAVIRGETPHFD

SEQ ID NO: 68692 - protein, 200 aa, Shigella boydii
RELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIV

SEQ ID NO: 68693 - protein, 199 aa, Nitrosomonas europaea ATCC 19718
MLLMIDNYDSFTYNLVQYLGELGEEVMVVRNDEITLEAVQQLNPASVVISPGPCTPDEAGISVELINRFSGKIPILGVCLGHQSIGQAFGGRIVRAGKVMHGKTSLVFHDGKGVFQGMPDPFVATRYHSLVIERSSIPDCLEISAWTEDGEIMGVRHRALPVEGVQFHPESVLSEHGHLLLDNFLHGNSVQKHSSMCEA

SEQ ID NO: 68694 - protein, 200 aa, Lentisphaera araneosa HTCC2155
MLDSIQSAIDDLKQGKMIVVVDDENRENEGDLLMVAEFADPEAVNFMATYGRGLICAPMTQARADELHLSLMADYNDCPYGTAFTVSVDAKNDTTTGISASDRSITLKRLADPSFSSDDFMRPGHMFPLIAKAGGVLEREGHTEAAVDLAKLAGSQAVGVICEILNGDGSMARLPELKVFVQKHDLKLISIEDLVQFLKK

SEQ ID NO: 68695 - protein, 537 aa, Novosphingobium aromaticivorans DSM 12444
MSAPVLSSNVDLNSEQAQARAAHNRALAGELRERVAKAALGGDERSRERHVSRGKLLPRERVERLLDPGAPFLEIGQLAANGMYNDEVPGAGIIAGIGRVSGRQCMVFANDATVKGGTYFPMTVKKHLRAQEIAGENRLPCIYLVDSGGANLPNQADVFPDRDHFGRFFYNQANMSARGIPQIASVMGSCTAGGAYVPAMSDETVIVREQGTIFLAGPPLVKAATGEEITAEALGGGDLHARKSGVVDHLADNDEHALTIVRDIVSHLDGVGRLENPAMAAVREVKEPIYPAEDLYSIIPEDVRAPYDVHEVIARIVDGSEFHEFKAHYGATLVCGFAHIHGLPVAILANNGVLFSESAQKGAHFIELACQRRIPLLFLQNISGFMVGGKYEAEGIAKHGAKLVTAVATAQVPKITVLIGGSFGAGNYGMCGRAYQPRFLFTWPNARISVMGGEQAASVLATVHRDADKWTPEEAEAFKAPIRQKYEDEGNPYHATARLWDDGVIDPVQTRDVLGLALEACLEAPIAEAPRFGVFRM

SEQ ID NO: 68696 - protein, 458 aa, Nocardia farcinica IFM 10152
MEAGRKIARMAVLDEKLHEVYEEILRRNPGEIEFHQAAFEVLESLGPVVAKHPEYTDGAVLRRLCEPERQIIFRVPWVDDQGRVQINRGFRVEFNSALGPYKGGLRFHPSVYLGIVKFLGFEQIFKNSLTGMPIGGGKGGSDFDPKGRSDGEVMRFCQSFMTELYRHIGEYTDVPAGDIGVGGREIGYLFGQYKRITNRYESGVLTGKGLTWGGSQVRPEATGYGTVFFVDEILRSRGDSFEGKKVVVSGSGNVAVFAIEKVEQLGGTVVACSDSGGYVVDDKGIDLDLLKDLKQVRRGRMCDYVEERGGTARYVENQSVWDVPCDIALPCATQNELDGEAAATLIRNGVRIVAEGANMPCTPEAARAFTEAGVTFAPGKAVNAGGVATSALEMQQNASRDSWSFEHTEERLAEIMRGIHDRCLETADEYGSPGSYTAGANIAGFTRVADAMLALGII

SEQ ID NO: 68697 - protein, 202 aa, Shigella boydii
RELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGF

SEQ ID NO: 68698 - protein, 439 aa, Pseudomonas fluorescens Pf-5
MKFSLPKIATAPFCPPEVAGSVAVDPGASLWRRLLRFAGPGLLISIGYMDPGNWATAIEAGSRYGYNLLFVVLLASLAGMAVQCLCSRLGIATGRDLAQLCRERYSTRSARTQWLLAEVSIIATDLAEVLGCALAFHLLLGVSLSTGIVITAFDTLLVLALQNRGFRRLEAIMLALVATIGVCFFIELLLIKPYWPDVARGFVPSLSAIGDAAPLYLAIGILGATVMPHNLYLHTSVVQTRLVGNDRASRADAIKLARIDTIGSLALALLVNAAILILAAAAFHNTGHSDVVEIQDAYHLLDPLVGGALASVLFGVALLASGQSSTFTGTIAGQVIMEGYLNLRIPCWQRRLITRGLALIPAFIGVWLLGDGAVGQLLVLSQVVLSLQLPFALYPLIRMTNDRRLMGEFVNRWPTRILAWSLFAIIGAANAWLILQMAL

SEQ ID NO: 68699 - protein, 561 aa, Bacillus anthracis str. Ames
MIHLKTQYTVSTYLLDRLSELGIEHIFGIPGDYNLAFLDYVLAHKNLEWIGNCNELNAAYAADGYARIKGIAALITTFGVGELSAINGIAGSYAENVPVIKITGTPPTTVMENGELVHHTLGDGKFNHFSKMYREITIAQTNLTPEHAVEEIDRVLRACWNEKRPVHINLPIDVYNKPINRPAEPILHKPILSNKETLDKMLLHAISKINSAKKPIILADFEVDRFHAKEYLYQFVEKTGFPIATLSMGKGIFPEKHPQFIGVYVGDVSPPYLRKRIDESDCIISIGVKLTDTITGGFTQGFTKEQVIEIHPYTVKITDKKYGPVVMKDVLQQLSDVIEHRNEETLDIKPFISESLSMTEEFNPKAHMVTQKRFWQQIYHFLQENDVLLAEQGIPFFGSAAIPLPNNTTYVAQPLWGSIGYTLPALLGTQLANLSRRNILIIGDGSFQLIVQELSTILRQNLNPIIFLINNNGYTVERAIHGQNEPYNDIQMWEYTKLAKVFGTEEKSQTFKVQNETELQEVLTKISIDKNQLTFVEIVMSQGDQPELLAKLGKRFGQQNS

SEQ ID NO: 68700 - protein, 530 aa, Ostreococcus tauri
MSKRARDDDSDSDVVDVGYVGRGRGTSIEGRVNAYAEHARALNVQFLKHVERKIAQEPTALLLSAVRDYARYAREIRDEFQDVLAREGAMEARAETVRERASGTVFAWGNGDSGQLGMGGDVDEKRRPASVEYGVMENVKVLSVACGGTHTIALTSGGTCFSWGNNDGGALGRRVDKDKNPEAEYEPGKVELPLDVKVLAISTGDSHGLALAENGSVYAWGAFRTANGEWAFNPKTLDAKKTMFPFQIYTPKTQKERVKAIASGVDHALALTQEGGVYSWGSSEKGRLGRFAESEAENNEEAGDELKRRLLTPGRVSFPTSGGAAIGSAFGGEPVMTAIVAGDFHSFAISANEDGSKSTVYGWGLSNCNQLGIFDTNPDLRGDQQVTYFPKRVDCLSGRRIVSGDAGTHHSIFLTGDGKVISVGRWTDGRSACDPGEIEDLPGRVVKITCGGTNGGAILEDGHAYVWGSQYMGQLGLGPREEDAHLPEKLQYTKPMAGKVFSEIGFGGQHAAAVLVDETEAGRGSKRARA

SEQ ID NO: 68701 - protein, 556 aa, Rhodococcus sp. RHA1
MTENREIVRGTPVVPGIAYAPVIWPAPRPEVASGSARIDEVSRDAEKVRFEEAAAVVSQRLRDRAASVSGAAAEVLQANAAMAADRGWLGAAQKLIAGGTPAEEAAAEATEQFATLFTKMGGLMAERVTDLRDIRDRVVSELLGLSEPGIPVPSTPSILCAQDLAPADTAGLDPELIVGLVTVLGGPTSHTAIISRQLGIPCVVAVRDLESVVAGTPVLLDGSAGELVVEPDPVEARAAVEHGRAERIRIQSWEGPGRTSDGHSVSILANVQDGAGARSAATTAAEGVGLFRTELCFLDRDSEPGVDEQAEIYGEVLDAFAGRKVVIRTLDAGSDKPLRFANHAEEANPALGVRGIRIAEQNPGILSRQLDAVAAAAKQTQSQPWVMAPMISTPAEAESFAAEVRARGLVPGVMVEVPAAALLADRLLRHVDFLSIGTNDLAQYTMAADRMSSDLASLTDPWQPAVLALVARTAEAGIAAGKPVGVCGEAAADPLLACVLIGLGVTSLSCAGAAVSGVGAKVGSVSLDDCRRAAEDVLATSDPAEARAAAVRVLGA

SEQ ID NO: 68702 - protein, 245 aa, Bacillus anthracis str. Ames
MIKLVLIRHGQSLWNLENRFTGWTDVDLSENGLSEAREAGAILKKNGYTFDVAYTSVLKRAIRTLWIVLHEMDLAWVPVHKCWKLNERHYGALQGLNKDETAKKYGEEQVHIWRRSIDVRPPALTEDDPRYEMNDLRYKALKKGEFPLTECLVDTEKRVLDYWHSEIAPKLKNGNKVIISSHGNTIRSLVKYLDNLSSDGVVSLNIPTSIPLVYELDENLRPIRHYYLSMDGEVPEGEIPKHITF

SEQ ID NO: 68703 - protein, 536 aa, Triticum aestivum
  misc_feature (251)..(251): Xaa can be any naturally occurring amino acid
  misc_feature (258)..(258): Xaa can be any naturally occurring amino acid
  misc_feature (530)..(530): Xaa can be any naturally occurring amino acid
WIPRAACAPRSESNLRKAFEEAEKNAPSIIFIDEIDSIAPKREKTNGEVERRIVSQLLTLMDGLKSRAHVIVMGATNRPNSIDPALRRFGRFDREIDIGVPDEVGRLEVLRIHTKNMKLAEDVELEHISRDTHGYVGADLAALCTEAALQCIREKMDIIDLEDETIDAEILNSMAVTNDHFKTALTTSNPSALRETVVEVPNVSWEDIGGLENVKRELQETVQYPVEHPEKFEKFGMSPSKGVLFYGPPGXCGKTLLXAKAIANECQANFISIKGPELLTMWFGESEANVREIFDKARGSAPCVLFFDELDSIATQRGSSVGDAGGAADRVLNQLLTEMDGMNAKKTVFIIGATNRPDIIDPALLRPGRLDQLIYIPLPDVESRHQIFKACLRKSPLAKDIDLSALAKYTQGFSGADITEICQRACKYAIRENIEKDIERDRRRKDNPEAMEEDDVDEVAEIRAAHFEESMKYARRSVSDADIRKYQAFAQTLQQSRGFGSEFRFPDQPAAGASSAAAADPFASAAAAAXDDDLYS

SEQ ID NO: 68704 - protein, 316 aa, Triticum aestivum
  misc_feature (76)..(76): Xaa can be any naturally occurring amino acid
  misc_feature (89)..(89): Xaa can be any naturally occurring amino acid
  misc_feature (178)..(178): Xaa can be any naturally occurring amino acid
TTSAALSEHRDLLQRFMSYVLFAGCPVDLHTLADALILRVCHPLPKRRCFSPKPEAGSVHVPSEPFGPLPESGVRXQTDAKKCRSFSCXLPPSLGFDFLRTEAGKFLRALGPLDLTVPQLLRLASMSRPGPIRLGLDVGGGTGTLSARLKRAENATLLTTTMDLGAPYSEAGAERGVXVPLHAPIDQGFPRGGRDDCTLVRGCQADEPGVFPGAGAGSSWWYEPEPCCCGRVGLLWVGPPLCAGRGNLNGGYASHCSEAGLKKQLKWAFAQQYLHWRPKGETVLITGPSAGRHSMQGCRFWKMFILLLQVLGTFCI

SEQ ID NO: 68705 - protein, 375 aa, Glycine max
MSKTSEIITCKAAICWGIGKPVTVEEIQVDPPKATEVRVKMLCASICSTDISSTKGFPHTNFPIALGHEGVGIIESVGDQVTNLKEGDVVIPTYIGECQECENCVSEKTNLCMTYPVRWTGLMPDNTSRMSIRGERIYHIFSCATWSEYMVSDANYVLKVDPTIDRAHASFISCGFSTGFGAAWKEAKVESGSTVAVFGLGAVGLGAVIGSKMQGASRIIGIDTNENKRAKGEAFGITDFINPGDSNKSASELVKELSGGMGADYSFECTGVSTLLSESLEATKIGTGKAIVIGVGIEITLPLGLFAILLGRTLKGSVFGGLRAISDLSILADKGHKKEFPLQELFTHEVTLADINKAFELLKQPNCVKVVINMP

SEQ ID NO: 68706 - protein, 536 aa, Lotus japonicus
MGLTPDFLSFCLEFSWTFLLVVIFFFIIFKVTKSHSVNKSKKYKLPPGPKPWPIVGNLPEMLANRPATIWIHKLMKEMNTEIACIRLANTIVIPVTCPTIACEFLKKHDASFASRPKIMSTDIASDGFLTTVLVPYGEQWKKMKRVLVNNLLSPQKHQWLLGKRNEEADNLMFYIYNKCCKDVNDGPGLVNIRIAAQHYGGNVFRKLIFNTRYFGKVMEDGGPGFEEVEHINATFTILKYVYAFSISDFIPFLRRLDLDGHRSKIMKAMGIMKKYHDPIIHDRIKQWNDGLKTVEEDLLDVLIKLKDASNKPLLTLKEIKAQITELAIEMVDNPSNAFEWALAEMLNQPELLKRATEELDNVVGKERLVQESDIPKLQFVKACAREALRLHPMEYFNVPHLCMNDTMVGDYLFPKGTQVLLSRVALGRNPKFWTDPLKFNPERHLKEGIDVVLTEPDLRFISFTTGRRSCPGVTLGTTMTIMLFARMLHGFSWSAPPNVSSIDLTQSSDDLFMAKPLCVVAKPRLAAELYSTNEFK

SEQ ID NO: 68707 - protein, 180 aa, Triticum aestivum
MDSEHWISRLAAAKRFYAAQLGHIDDMAGMGMEEVDMDMEDDGEMDMEMEMQLEEARWPEVACPYCYEDYDLGSLCVHLEEDHPYEPHPAPCPICSEKITRDMLNHITMHHGYLFKNGSRLRRFVIPERCALSLLSRDLRDAHLQALLGGGHSHRSRNTTTATTNIYADPLLSSFGLGLA

SEQ ID NO: 68708 - protein, 532 aa, Burkholderia sp. 383
MKSSIQRNIGPFALMLTGLGSIIGSGWLFGAWKAAKIAGPAAICAWIIGAVVILAIALTYAELGAMFPESGGMVRYARYSHGSLVGFISAWANWIAIVSVIPIEAEASIQYMSTWPYPWAHALFVNGELTVPGLLLSAVLVVIYFLLNYWGVKAFARANTTITIFKFLIPGLTILGLMLTSYHPENLGTASNASFAPYGWSAVLTAVATSGIVFAFNGFQSPVNLAGEARNPSRSVPFAVITSILIALVIYVLLQMAYIGSVNPADVAQGWSHFNFKSPFAELAIALNLNWLAILLYVDAFVSPSGTGTTYMATTTRMIYAMERNNTMPKMFGNVHPLYGVPRQAMWFNLFVSFLFLFFFRGWSSLAAVISVATVISYLTGPISLMALRRAATDIKRPLSIPLMKLIAPFAFVCASLILYWAKWPLTGEIILLMIVALPVYFYFQAKSGWTGWGDDLKAAWWLVAYLPTMAVLSLIGSKEFGGHGVLPYGWDMLVVAAIALVFYFWGVNTGYRTKYLDERESHDEILEGIGA

SEQ ID NO: 68709 - protein, 500 aa, Xylella fastidiosa Dixon
MLLTQTKTPPHQPTLTSESETRSMHNTLLLFGATGDLAQRYLFPSLLQLFTDGLLPQDFRIRALALSPHNTTQFRDILRPRLEQALPIANTAHIQALLQRVDYLSVDLNDPTSIAEAVRDLTEHPCISYLAIPPGLYTNTALGLAQGGALQTPHRLMLEKPIGRDSINAREILNTIGTLIDEDRIFRVDHYLGKAAVQNLVALRFGNTLLEAVWNRNHIESVHILIAETEGVDGRNAYYARAGALRDMMQSHILQLLCLVAMEPPASLEADRIRDEKVKVLRALRPLNAQNAAMHSVRGRYSAGTINSQPVPAYQPPEGSNVETFVGVTAYIDNWRWAGVPFHLCTGKRLAERSTQIVVTLKPVTHWLFERPDRNNAAPNRLCFKLQPQENIELNLMSSLAGPEWGTLELQPLELELSVPTGKHRHIAYERLFLDAFNGNPALFVRHDEVTAAWAWIDSVSNAWELSDLPLQPYPAGGWGPPQAHQFLPPLGIDGHGNNA

SEQ ID NO: 68710 - protein, 269 aa, Chlamydomonas reinhardtii
MLAQKNGVVCKQQARLLSTPAVSARSAARAFKPCDSASAGPAAVCASRPAHSGRRGQSIQTEAVARPSVYFFGFGGDDEDYEENYTVMKVQVGMFGDVKKWQKDLERLSEQFDTEDEEGLHYILQDTVTKLLRNMEYISYAATAGKVYDNLDECEQKFNQVSLEERSKFKEETFSNVDGRRRTRALDVSSSPDVGLDTWLCCTLVVAVEGKFKLPKVNSAADLKKALTLLGSASPDTLLAFELLWTPQAEGDSYSKDELLGDFPTLALL

SEQ ID NO: 68711 - protein, 218 aa, Thermoplasma volcanium GSS1
MFKVDRYFDLTAPIYPYMPVWPSNPPVELKPIVTVPKDGYLAEIIEASTHTGTHIDAPAHMIEGGTTVDDLDLASLIGTGYCLKVLPDGHTIRSTHLAEKWQGIYNNSILLIETGWYKKRGYTREFQYDFPGLSEDAADFLIQKHVKAVGIDTLGIEPYENTDFRVHKKLLRSGIPIIEDLYGLDSLEEGRPYLIIALPLRLKGTSGSMARVVAAETE

SEQ ID NO: 68712 - protein, 270 aa, Zea mays; identical to SEQ ID NO: 1031

SEQ ID NO: 68713 - protein, 202 aa, Shigella boydii
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGF

SEQ ID NO: 68714 - protein, 141 aa, Triticum aestivum
IRPDHLALPISSHSHPRSTYTLATSLPSDLVSPISPAKMSTVTRAYLDQRLAAAKRCSKEAAMAGVKAAAVATVAAAVPTLASVRMLPWVRAHLNPTGQALIISTVAGMAYFIVADKTILSMARKHSHEMAPEHLKNTSFH

SEQ ID NO: 68715 - protein, 101 aa, Zea mays
MAAAAGAGGGAGGKVSFKIILTSDPKLPFKVFSVPEAAPFTAVLKYAAEEFKVPPQTSAIITNDGVGINPQQSAGNVFLKHGSELRLFPRDRVGAAVVPSY

SEQ ID NO: 68716 - protein, 255 aa, Mannheimia succiniciproducens MBEL55E
MARRPLVMGNWKLNGSKAFTKELIEGLKAELAGVEGCDVAIAPPVMYLAEAEAALAGSKIVLGSQNVDVNVKGAFTGDISTEMLKDFGAKYIIIGHSERRTYHKESDEFVAQKFGALKEAGLTPVLCIGESEAENEAGKTEEVCARQIDAVINALGVEAFNGAVIAYEPIWAIGTGKSATPAQAQAVHAFIRGHIAAKSQAVADQVIIQYGGSVNDANAAELFTQPDIDGALVGGASLKAPAFAVIVKAAAKAKA

SEQ ID NO: 68717 - protein, 201 aa, Shigella boydii
ELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGF

SEQ ID NO: 68718 - protein, 565 aa, Lentisphaera araneosa HTCC2155
MQEITHHQIMIFFFSLAILIGLARIFGELCKKIGQPSILGEIAAGIILGPTVFAYIAPDLQATLFPSSGPLYVTFEFIGMLAITLFMLIAGMEVDLKCLKKQAKPATVVGISSMILPFAGGFALVYLFPKTFDTQEKTFVTALFMATALAISALPVITKILMDLKLIKTDLGVTIIAAAIFNDLTGWMIFAIVLSLMSDTSGGFPWGTIVGIVAAGAFMLTIGRKIVLALIPRVQAHASWPGGVMGFILTGALLAAAVAEWIGVHGIFGSFLFGVALGDSPHLRHQTEEYMEKFISFILTPIFFATIGLKVNFLTHFDLFAVVILLVVGSITKIVGSYVGAKICGMSQRESMALGWGMNARGVMEIILAIIALEAKVINDTVFVAIVILALFTSMTSGALMKISLKRRSKTSALTSFGRGAFVADLKHPAPAHVIKDMVLQLNIDHEVQADIIQSTISREQLMSTGLEKGLAVPHCRTDLVKKPILLIGLHESGADFDCFDDGKAHVIALIITPLSDPESQLELISVLASHFSSKEEMVKAMTCKSKVDMQAILNAADEMSEKHS

SEQ ID NO: 68719 - protein, 436 aa, Nitrosomonas europaea ATCC 19718
MNDKKSAMRSHRVVWHPCTQMKHHEEFPPVLITRGEGVWLYDADGQRYLDTISSWWVNLFGHCNPRINAAIIDQLGRLEHTMLAGLTHEPVVELSERLSTITPGSLSHCFYASDGASANEIALKMSFHYWQQSGFPEKTQFINLQNGYHGETLGALSVTDVPIFRQVYAPLLRPAHPVLTPDWRFAEAGETPEAHALKAAAALESYLTQHHASTAALILEPLVQGAAGMGMYHPVYLQKAREICDTYRIHLITDEIAVGFGRTGTLFACEQAAITPDIMCLAKGLSGGYLPLSVVLTNDTIYRAFYSDQTSQAFLHSHSHSGNALACRAALATLDIIEQDNVIETNRHKTKFLNQCLQSVRTHPNVRHFRNCGMIWAFEVDNPRPDFTNRFAQMGLERQLLIRPMGNSVYIMPPYIINEEEMEFMAQAILNILNEI

SEQ ID NO: 68720 - protein, 197 aa, Shigella boydii
ELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAM

SEQ ID NO: 68721 - protein, 199 aa, Shigella boydii
ELKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIV

SEQ ID NO: 68722 - protein, 419 aa, Novosphingobium aromaticivorans DSM 12444
MRDTYSQPLARDAMAYVLAGGRGSRLKELTDNRAKPAVYFGGKSRIIDFALSNAINSGIRRIGVATQYKAHSLIRHMQRAWNFMRPERNESFDILPASQRVSEHQWYEGTADAVYQNLDIIASYAPKYMVILAGDHIYKMDYELMLRQHVESGADVTIGCLVVPRIEATGFGVMAVDTSDTITAFVEKPANPPGIPGNEDMALASMGIYVFDTKFLFDILREDAADPSSSRDFGNDIIPKIVRNGKAVAHRFTASCIRAAEEIEEYWRDVGTLDAYFEANLDLTDVVPKLNMYDRDWPIWTDQIIAAPAKFVHDEDGRRGMAISSLISQDCIVSGAIARRSLLFTGVKMGSFSSCEEAVILPYCNIGRGARLSRVILDSGVRIPEGLVVGEDPELDARRFQRTESGVCLITKRMIDQLA

SEQ ID NO: 68723 - protein, 137 aa, Brassica napus
LQKSISSEEGYKLGLIDALVPPGDLLTTSRNWALDIAAGRKPFLRSLHRTDKIGSLSEARAILRNARQLAKRIAPNMPQHHACIEVIEDGIIHGGYSGVLKVSFSLGFNVYCIYHLFEFLYIDHCAVSRMILEACID

SEQ ID NO: 68724 - protein, 390 aa, Corynebacterium efficiens YS-314
MVMNPSPLSNRSNVPPFRVMQMLDQVHRRRREGHSIIMLCAGQPATGAPEAVLAEAEIVLRSGPLGYTEVVGDREFREAVAAWHSATYGVQTSADNVIITTGSSGGFMAAFLATLDHGDRVALSVPGYPAYRNILQTLGAEILDLRCTAETRFQPTAQMLEELPEVPKAVIVTSPGNPTGTIIDVEELERIARWCDANGTVLISDEDYHGMSFGRPLATARQFSDNAIVVGTLSKYFSMTGWRVGWIIVPDELVTPIENIQASVSLCAPAIGQAAGKAAFTLEAAAELDAHVEVYREARDIFVDKLPEIGLDTFADPDGGLYLWVDVSKYTDDSEAWAHELLEQAGVAVAPGVDFDPTEGHKWVRLSLCASPADTLEGVRRIGEFLNRVV

SEQ ID NO: 68725 - protein, 410 aa, Rhodococcus sp. RHA1
MSMASALWHGFADMGAVEQKGAFVVSRGEGAYIWDDRGNRYLDATAGLWFTNVGHGRAEIADAVAQQLRTVAHFSNFGDFVPETTAALADRLATIAPVPGSKIFFTSGGSDSVDTAAKLARRYWHELGKPSKTIVVGRQKAYHGMHVAGTALAGIPANREGYGELMADAATVAWNDAKSLLELIEKIGADTIAAFFCEPVIGAGGVYLPPEGYLAEVRDICREHDILFVVDEVVTGFGRIGGEWFASTRFDLQPDMMTTAKGLTSGYVPMGAVFIAPRVAEPFFAGGVWWRHGYTYGGHAGAAAAALANLDIIERENLLAESKRLESSLHEHLAPLADHPRVEEVRSGLGAVAAVQLADPAEALPFVNTLREHGISGRAAGQGAMQISPAFVMTDEQVAQLADGIRRALG

SEQ ID NO: 68726 - protein, 927 aa, Burkholderia mallei ATCC 23344
MHRFETIRQLESSARTYASSFEAVFESGAGALLRDQSGREIIDCLSCAGALPLGHNHPEVNDAIRRFFQSGHVQQALDLSTPAKFEFVKTLFETLPDDWARRAKIQFCSPSGSDAVEAAMKLTRFATGRQTIVAFSGAYHGMTRGALAAMGNLGVKSGLGLGAGDVHFAPYPYRFRCPFGTDGTETDALSIQYLRNLLADPESGVSKPAAVVVEVVQGEGGCIPVSDAWLRALRQLTRAHEIALIIDEVQTGFGRTGSMFAFERAGIRPDVLVLSKAIGGGFPLAVVVYDEVLDVWPRGKHAGTFRGNQIAMVAGKATIEILRRDRLDAHAAQMGALLVDGLREIARAHPEFGDVRGRGLMVGVEIVDPSSDGAPQDGELARAIKLEAFRNGLLVETGGRHGAVLRLLPPLIVNRADISAILERLDASIAQAKRGRGPRGGANHRSDERDGEAARPVAQGQSALPQAEPVKREAERRRGLLKPAFLLLWLGETALDFGSALMSFALAAWIFQKTGSAERFSFAVLSAAIPALLLTPVAGALADRFDRRWVIAGCDVAMAIMIGALAWLLFRGALAPGHLYFFNATSAAIGCIRMPAYRAAVTAIVPRERLTQASGFTGTSQALLRIAAPLIAGYVLADYGLKGIVGLDMLMIAAGSAAIFAALLRAAHAIRGVVGAVDASLIEGVSASFAAAVRYFKSVPMFQGLAAYNMLQESLLLLSSVMLTPLVLSTHSSSTLGLILTYGALGGLAGSLLLLVLRIEARLMSLALFADAVLAMLIALVGFSRSPAAWCAFVFLAYFASSASSACTSALWARKTPREMRGSIFALNTSMNLAAMSIVVLVGGVLCQRLFEPALADGGAWAPTVGAWLGTGKGRGIGLLLVLCGAAGCVASLLALTCTRLRHLDALVPDQTHDDARDLLRNGVAVT

SEQ ID NO: 68727 - protein, 173 aa, Geobacillus kaustophilus HTA426
MLYPYNGKRPNVHETAFIAPGAYLIGDVTVGPESTIWFNAVLRGDEGPITIGARTSIQDNTTCHLYEGSPLVVEDEVTVGHNVILHGCTIRRRSIIGMGSTILDGAEIGEECIIGANTLIPSGKKIPPRSLVIGSPGKVVRELTDKDLELIQLSIDTYVQKGKEYREQLANHR

SEQ ID NO: 68728 - protein, 432 aa, Burkholderia sp. 383
MQLLTIGINHHTAPVALRERVAFPLEQIKPALVTFKNVFLGPQAPNTPEAAILSTCNRTELYCATDDRAAREGAVRWLSEYHRIPVDELAPHVYALPQSEAVRHAFRVASGLDSMVLGETQILGQMKDAVRTATEAGALGTYLNQLFQRTFAVAKEVRGTTEIGTQSVSMAAAAVRLAQRIFEKVSDQRVLFIGAGEMIELCATHFAAQGPRELVVANRTAERGQRLAERFNGRAMPLADLPTRMHEFDIIVSCTASTLPIIGLGAVERAVKARRHRPIFMVDLAVPRDIEPEVGKLKDVFLYTVDDLGAIVREGNASRQAAVAQAEAIIETRVQNFMQWLDTRSVVPVIRHMHTQADALRRAEVDKAQKLLARGDDPAAVLEALSQALTNKLIHGPTSALNRVNGADRDSLIDLMRGFYQHAPRSNDQSGH

SEQ ID NO: 68729 - protein, 120 aa, Robiginitalea biformata HTCC2501
MLGKIRLENVRLYGFHGCLKEEEMIGSDYRVDLEVTADLSRAAASDRLSDTVDYVHLQTIIREEMAKRTKLIETVAGRILDRVLEELGEVVEAEIAVSKINPPIGGDVQQVTVCLHKKRG

SEQ ID NO: 68730 - protein, 245 aa, Neisseria meningitidis FAM18
MGGQKTHFGFSTVNEDEKAGKVAEVFHSVAKNYDIMNDVMSAGLHRVWKHFTINTAHLKKGDKVLDIAGGTGDLSRGWAKRVGKEGEVWLTDINSSMLTVGRDRLLNEGMILPVSLADAEKLPFPDNYFNLVSVAFGLRNMTHKDAALKEMYRVLKPGGTLLVLEFSKIYKPLEGAYDFYSFKLLPVMGKLIAKDADSYQYLAESIRMHPDQETLKQMMLDAGFDSVDYHNMSAGIVALHKGVKF

SEQ ID NO: 68731 - protein, 198 aa, Zea mays
RLGGLSYFAGAEKKDDRVLVPDLGSLTSIHDRARELFYYLKGGQVDYGEEHNKTCGHNRFGRIYHTGHYPMWDEHNPVHFVGHSAGAQVVRVLHQMLADKAEEVVVEKTKTMIKSLYILSKVPLDSCKSACTCSSSWTGSCNARSMGCRLIVYHYCLSVLVPTNASDNFFGFKYGGNGYKRPGIVTLCHPRLMRLSTW

SEQ ID NO: 68732 - protein, 268 aa, Thermoplasma volcanium GSS1
MSTGYLGPKMSYSFLATSKMGYNDGVPFKTIFDLFDAVEKGGIDRAVVPVENSLEGQVGQTLDLLFSKDVSIIEEYYLRVVHCIAATDNADVKIVHSHPQALMQCSNYIEKHGYAVIEETSTTAGIEKLFNEQNKGHAVICSEEAASACKLTILDRDIGNEHDNFTRFFVITKKGLAKPQGDKISIAFTLLNKPGSLASIVDVLAKYGIDMTKIESRPIKFNPFSYIFYIDFIDNGFSKQAMDEISQKTVSLKILGKYRKAIGPVMKQ

SEQ ID NO: 68733 - protein, 856 aa, Oryza sativa Japonica Group
MAEAVDGGSWEDMLRRILPPGSPIPEAPPNLDYSIALEYDGPPVAYDLPRVDPVEIPTAEPVSGPQRLGNGGGLPVVEPIPLPVSRIARCAEPVSAQVGGGSSDSVNSVLQNEEFDDDDDDSRSLSHDSAQSSPGPQDRSRRTQEGRRGATVTFGFTPDSKCESKEFEEMSEQYVVVTKKEKRRRACYRCGKRKWESKEACIVCDARYCGYCVLRMMGSMPEGRKCVTCIGQPIDESKRSKLGKNSRTLSRLLSPLEVRQILKAEKECQANQLRPEQLIVNGCPLGPDELTDLLSCSRPPQKLKPGKYWYDKESGLWGKEGEKPERIISSNLSFTGKLQANASNGNTQVYINGREITKIELKILKVANVQCPRDTHFWVYDDGRYEEEGQNNIKGKIWESALTRFACALFSLPVPPGNSNETRDEVHYSARTVPDYLDQKRIQKLLLLGPDGAGTSTIFKQAKYLYGTRFTQEELENIKLIIQSNMFKYLGILLEGRERFEEEALSRSNCTISEDEETQQDENKANGSNSCIYSINPRLKKFSDWLLDIIAMGDLDAFFPAATREYAPFVDEMWKDPAIQATYKRKDELHFLPDVAEYFLSRAIEVSSNEYEPSEKDVIFAEGVTQGNGLAFIEFALDDRSPMSEPYIENPEAHSQPLTKYQLIRVSAKGMNDGCKWVEMFEDVRMVIFSVALSDYDQVGPPVYGSSRPLLNKMMQSKELFEATIRQPCFCDTPFVLVLNKYDLFEEKINRAPLTTCEWFNDFSPVRTHHNNQSLAQQAYYYVAVKFKDLYYEHTGRKLFVWQARARDRQTVDEAFKYVREILRWEDEKEENLYGGGEDSFYSTTEMSSSPFIRAE

SEQ ID NO: 68734 - protein, 478 aa, Aspergillus oryzae
ATPADWRSQSIYFLLTDRFARTDGSTTATCNTADQKYCGGTWQGIIDKLDYIQGMGFTAIWITPVTAQLPQTTAYGDAYHGYWQQDIYSLNENYGTADDLKALSSALHERGMYLMVDVVANHMGYDGAGSSVDYSVFKPFSSQDYFHPFCFIQNYEDQTQVEDCWLGDNTVSLPDLDTTKDVVKNEWYDWVGSLVSNYSIDGLRIDTVKHVQKDFWPGYNKAAGVYCIGEVLDGDPAYTCPYQNVMDGVLNYPIYYPLLNAFKSTSGSMDDLYNMINTVKSDCPDSTLLGTFVENHDNPRFASYTNDIALAKNVAAFIILNDGIPIIYAGQEQHYAGGNDPANREATWLSGYPTDSELYKLIASANAIRNYAISKDTGFVTYKNWPIYKDDTTIAMRKGTDGSQIVTILSNKGASGDSYTLSLSGAGYTAGQQLTEVIGCTTVTVGSDGNVPVPMAGGLPRVLYPTEKLAGSKICSSS

SEQ ID NO: 68735 - protein, 408 aa, Saccharophagus degradans 2-40
MSLFVQKFGGTSVGTVERIKAVAKKVAGFRDQGHDIVVAVSAMSGETNRLIALAKEMQATPDPREMDVLVSTGEQVTIALMCMALKDLGYDARSYTGTQVKILTDSSHMKARIQDIDVAPMKADLAAGRVVVVAGFQGVDENGNITTLGRGGSDTTGVALAAALKADECQIYTDVDGVYTTDPRVVSSAKRLERITFEEMLEMASLGSKVLQIRSVEFAGKYNVPLRVLSTFDDGPGTLITLDEEYSTMEQPVVSGIAFNRDEAKVSILGIPDAPGVASKILAPIGDANIEIDVIVQNVAADNTNDLTFTVNRADVDKARAVVERVATELGAREVVTDDKIAKISIVGVGMRSHAGVASTMFKSLAADAINIQMITTSEIKISVIIDERYLELAVRGLHTAFGLDKDQ

SEQ ID NO: 68736 - protein, 458 aa, Rhodococcus rhodochrous
LQIVHQATADDVDEAVAAGRVAAADPAWRRMLPHERARYLHRIADAIEHEASRLALLQSYNTGKTLTETTALVGSAAGTFRYFAAVLETSDDDLTTQRGNYLTMSIHEPIGVIGAIAPWNSPIASDAQKIAPALAAGNAVVLKPAEWTPLVSMALARAIHDSGLPPGLLSVLPGKGSIVGDAIVQHPHVGKVTFTGGTRTGRAVAHAGAEKLMPVSLELGGKSPTIVLDDADIEAAVAGVMYGIFSSTGQSCIAGSRLFVDRSLYEAFMERLVERTRALRIGNGRDPRTQVGPLVHHTHRASVARYVDLARCEGGRVLCGGTAPDDPELADGAYYLPTVIDGLSNDAAVCQDEIFGPVLIALPFDGESDLLAQANDSVFGLASGIWTRDYRRAWRLARQLEAGTVWVNTYKRFSISTPFGGIKESGLGTEKGRAGIAAYSRQKSIYLGLDDEPDRWVD

SEQ ID NO: 68737 - protein, 203 aa, Shewanella sp. MR-4
MLLMIDNYDSFTFNLVQYFQQLGQEIVVKRNDEISLAEIEALAPSHLVISPGPCSPNEAGISLAAIEHFATRLPILGVCLGHQAMAQVFGAKVVRAQRVMHGKVSAIGHTGERLFKGLNQPLTVTRYHSLLVDAVPEGFVLDAWFDDPTHGREIMAMSHKQLPLFGVQFHPESILTEQGHELLANFLSQSALTCGHKSSSSFE

SEQ ID NO: 68738 - protein, 332 aa, Saccharomyces cerevisiae; identical to SEQ ID NO: 1011

SEQ ID NO: 68739 - protein, 405 aa, Shewanella sp. MR-4
MSVDMKLNRAQFDAVMVPNYAPAAVIPVRGEGSRVWDQEGNEFIDFAGGIAVNCLGHCHPALVNALKTQGEKLWHLSNVMTNEPALELATKLVNSTFAERVYFANSGAEANEAALKLARRYALEKFGVEKDEIIAFDKAFHGRTFFTVSVGGQAAYSDGFGPKPQSITHLPYNDVAALEAAVSDKTCAIMLEPLQGEGGIIDADPAFLKAVRELANKHNALVIFDEVQTGVGRTGELYAYMGTDIVPDILTTAKALGGGFPIAAMLTTAEIAEHLKVGTHGSTYGGNPLACAIGNAVLDVVNTPEVLNGVKHREQLLRDGLNKINEKYHVFSEIRGKGLLLGAVLNEQYQGRSRDFLVASVAEGLMSLMAGANVVRFAPSLVIPEADIAEGLARFERAVASIAAA

SEQ ID NO: 68740 - protein, 267 aa, Shewanella sp. MR-4
MHTDINALFAALWQDYIQMTPSAAKVHELLGHGKPIINDHIALRTFNIAKVNLAVLAEHFTSLGYVACGDYKFEQKKLVAKHFEHPDATQPKVFISELLVEEFSPSLQSTIQGLIAQVDEQATKADNFIYSGRHWSLDAKTYETLLEESEYAAWVAAFGYRANHFTVSINHLEGFETLESVNDALKQAGFVLNSSGGEIKGSPEVLLEQSSTMADKIAVEFSDATVEIPSCFYEFALRYPKANGELYTGFVAASADKIFESTNAKKA

SEQ ID NO: 68741 - protein, 262 aa, Zea mays
  misc_feature (228)..(228): Xaa can be any naturally occurring amino acid
  misc_feature (242)..(242): Xaa can be any naturally occurring amino acid
MASPALISDTDQWKALQAHVSAIHKTHLRDLMTDADRCKAMTAEFEGVFLDYSRQQATTETVDKLFKLAETAKLKEKIDKMFKGEKINTTENRSVLHVALRAPRDAVINSDGVNVVPEVWAVKDKIKQFSETFRSGSWVGATGKPLTNVVSVGIGGSFLGPLFVHTALQTDPEAAECAKGRQLRFLANVDPVDVARSIKDLDPATTLVVVVSKTFTTAETMLNARTIXEGIVSALGPQAVSXKHMIAGRTNLRLGQEFRNLT

SEQ ID NO: 68742 - protein, 407 aa, Physcomitrella patens subsp. patens
MTPLSIISLLLVAGVAWFTGTDPMKLSMGRDISEFDPQYIEPPPASLLKDFPRDNENKLKNGEIKWQGELLGPESLTFDAQGRGPYTGVSDGRILRYDGPELGWTTFAYTSTNRSYACAPKSPLAFNLALEHVCGRPLGIRFHKETGDLWIADAYLGIMKVGPEGGQAELVLNEIDGVPMKFMNDLDFDDEGNMYFTDSSTRWQRRQFLLSLLEGDDTGRFIKYNLATKQTTVLIDHLRFSNGVTVSKDGTFVLIAECRMGRLWRYWLKGSKAGTHELFADLPGLPDNVRRNEAGDFWVALHCRRRSAEEFLSKNPWIRTLIIRLPIPLKLVYVLLAGKPHGVILRYGPDGTMREILEDQTGKVAKMVSEVEEHDGKLYLGSVLLPQIVVYTLPQTESPATPATATE

SEQ ID NO: 68743 - protein, 214 aa, Nitrosomonas europaea ATCC 19718
MQPMFDRERNGLDTTGLGLIPMVIETSGRGERAYDIYSRLLRERIIFLVGPVTETSANLVIAQLLFLESENSEKDIFLYINSPGGLVTAGLAVYDTIQFIKPDVSTLCVGQAASMGAFLLTAGAKGKRYCLPNSRVMIHQPLGGFQGQASDIEIHAKEILALKSRLNEIMAKHTGQTVKAIERDTDRDNFLGAEAAVKYGLVDAVLTSREVKQE

SEQ ID NO: 68744 - protein, 405 aa, Nitrosomonas europaea ATCC 19718
MTTESFRPEKKITTFYPPQRTLMGPGPSDTHPRVLSAMARPTLGHLDPVFTEMMEELKGLLRYVFQTTNLMTFPVSGPGSVGMEMCFVNMIVPGDKVVVCRNGVFGGRMIENVERCGGIPLVVEDKWGDPVDPQKVEDMLKKNPDAKIVAFVHAETSTGVQSDARTIAQIARKHDCLTIMDTVTSLGGTPVYMDAWDIDAIYSGSQKCLSCPPGLSPVSFSERVVDLVRNRTEKVHSWFMDISLLLGYWGASRTYHHTAPTNSLYGLHESLVILYEEGLERSWARHRRNHEALKAGLKTLGIEYVVAEPYRLPQLNSVYVPAGVDEKEVRRRLLDSYNLEIGAGLGDFAGKIWRFGLMGNSSKLENVVFCLDALEHVLIDMGVKVNRGTASSAAHQYYATNPVLA

SEQ ID NO: 68745 - protein, 536 aa, Oryza sativa Japonica Group
MASTTSATAAGGAFAAAKTRAGSSAAGGGACARVAAGGRRRSGVVVRCDAGVEAQAQAQAVAKAASVAALEQFKISADRYMKERSSIAVIGLSVHTAPVEMREKLAVAEELWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRSGQNSGGLGKNIDRMFKDAITAGKRVRCETNISSGAVSVSSAAVELALMKLPKSECLSARMLLIGAGKMGKLVVKHLIAKGCKKVVVVNRSVERVDAIREEMKDIEIVYRPLTEMYEAAAEADVVFTSTASETPLFTKEHAEALPAISDAMGGVRLFVDISVPRNVSACVSEVGHARVYNVDDLKEVVEANKEDRLRKAMEAQTIITQELKRFEAWRDSLETVPTIKKLRSYADRIRASELEKCLQKIGEDALTKKMRRSIEELSTGIVNKLLHGPLQHLRCDGSDSRTLDETLENMHALNRMFSLDTEKAIIEQKIKAKVEKSQN

SEQ ID NO: 68746 - protein, 520 aa, Arabidopsis thaliana
MASVSAIGVLKVPPASTSNSTGKATEAVPTRTLSFSSSVTSSDDKISLKSTVSRLCKSVVRRNPIIVSPKAVSDSQNSQTCLDPDASSSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYEKFIQAHRETDADITVAALPMDEQRATAFGLMKIDEEGRIIEFAEKPKGEHLKAMKVDTTILGLDDQRAKEMPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDKNARIGDNVKIINSDNVQEAARETDGYFIKSGIVTVIKDALIPTGTVI

SEQ ID NO: 68747 - protein, 439 aa, Clostridium difficile 630
MYKTDIYIDFDKINKKIENLELTISEGRVKKIIGLTVEVEGIKAFVGELCVIYNQVNKPVNCEVVGFKDKEVILMALGELTLIAPGCKVISNGIPLSVMCSDNLLGKVLDGLGNPIDNSDAVLGDRYNLNNEPPDPMKRKKIRNIMETGVRAIDAFTTCGEGQRIGIFAGSGVGKSTTLGMIARNAKADVNVIALIGERGREVLDFIDKDLGEEGMKKSVVVCATSDKAPLVRLKGALTATAIAEYFRDQGKKVILMMDSVTRFAMAQREVGVAIGEPPAQKGYTPSVFAMLPKLMERTGTSDKGSITAFYTVLVDGDDFNEPIADTTRGILDGHIVLSRDLANKNHYPSIDVLNSLSRLMNEIASKEDIKIASFARDMLAEYREAEDLINIGAYASGTNKKIDEAIYYHEHIINFLKQGINEKSSFNETISSLRRVFE

SEQ ID NO: 68748 - protein, 156 aa, Arabidopsis thaliana
MVSREHKRGSSLREKFHLLRSITDSHAESETSIIVDASKYIKKLKQKVEKINNATTSEQSFRESSDPNPMVTVETLEKGFMIKVMSRKNEAGMLVCVLETFEDLGLDVVEARVSCTDTFSLHAIGSSNNDDGDCIDAEAVKQAVAEAIRTWSDSHA

SEQ ID NO: 68749 - protein, 466 aa, Novosphingobium aromaticivorans DSM 12444
MQFERINPMTGAVASQAEAMKASDIPSIAARAGQAFPAWAAMGPNARRGVLMKAAAALEARADAFVEAMMGEIGATRGWALFNLGLAASMVREAAALTTQISGEVIPSDKPGCISMALREPVGVILGIAPWNAPIILGVRAIAVPLACGNAVILKASETCPRTHALIIEAFAEAGFPEGVVNVVTNAPADAAEVVGALIDAPEVRRINFTGSTNVGRIIAKRAAEHLKPCLLELGGKAPLIVLDDADLDEAVKAAAFGAFMNQGQICMSTERIIVVDAVADAFADKFKAKVASMAVGDPREGTTPLGAVVDAKTVAHCRSLIDDALAKGARLLTGGETTHNVLMPAHVVDGVTQDMKLFRDESFGPVVGVIRARDEAHAIELANDSEYGLSAAVFTRDTARGLRVARQIRSGICHVNGPTVHDEAQMPFGGVGASGYGRFGGKAGIDSFTELRWITMETQPGHYPI

SEQ ID NO: 68750 - protein, 520 aa, Oryza sativa Japonica Group
MSSSSSPAAPAAAAGAAVPGPCIVHKRGTDILHDPWFNKDTAFPMTERDRLGLRGLLPPRVMSFEQQYDRFINSFRSLEHNTRGEPDTIVALAKWRILNRLHDRNETLYYRVLIDNIKDFAPIIYTPTVGLVCENYSGLFRRPRGMYFSAKDKGEMMSMIYNWPAEKVDMIVVTDGSRILGLGDLGVQGIGIPIGKLDVYVAAAGINPQKVLPIMLDVGTNNTKLLEDKLYLGLRQPRLEGEEYLSVVDEFMEAVHARWPKAVVQFEDFQMKWAFETLQRYRNRFCMFNDDVQGTAGVALAGLLGAVRAQGRPLSDFTKQKIVVVGAGSAGIGVLNMAKQAMLRMPGINRSGEGHNQFWVLDKDGLITKSRKGLDPAVARYARGFGPEEVQDLHEGASLVEVVRKVKPHVLLGLSGVGGIFNEEVLKAMKESDSPRPAIFAMSNPTTKAECTPEDVFKYVGDNAVFASGSPFSNVTLGNGRQGYANQANNMYLFPGIGLGALLSGARHITDGMLQSAAEW

SEQ ID NO: 68751 - protein, 300 aa, Glycine max
LVQIFQSISRDPLGAIIVIFLEVQIVCFIFLVEFRSCNIHSNDNFACVTSFGNGSFQQFQTFLVFLNVGDEGGFAPNIQENKEGLELLKTAIAKAGYTGKVVIGMDVAASEFYKEDKTYDLNFKEDNNDGSQRISGDALKDLYKSFVSEYPIVSIEDPFDQDDWEHYAKLTAEVGANVQIVGDDLLVTNPKRVQKAIDTKACNALLLKVNQIGSVTESIEAVRMSKKAGWGVMASHRSGETEDTFIADLSVGLATGQIKTGAPCRSERLAKYNQLLRIEEELGAEAVYAGANFRTPVEPY

SEQ ID NO: 68752 - protein, 445 aa, Shewanella oneidensis MR-1
MHNRRHQLQNKLNHYIDKVPPFRAVASGQLVRVVGLTLEASGCRAPVGSLCSIETMVGELIAEVVGFDDELLYLMPIEELRGVLPGARVVPLGEQAGLNVGLSLLGRVLDGNGVPLDGLGALSTEQQAPRHSNAINPLSRRAITEPLDVGVRAINAMLTVGKGQRMGLFAGSGVGKSVLLGMMTRGTTADIIVVGLVGERGREVKEFIEEILGEKGRARSVVVAAPADTSPLMRLRACETSTRIAEYFRDLGYNVLLLMDSLTRYAQAQREIALAVGEPPATKGYPPSVFAKLPRLVERAGNGGPGQGSITAFYTVLTEGDDQQDPIADASRAILDGHIVLSRSLADSGHYPAIDIEASISRVAPMVISNEHLEAMRRVKQTYSLYQQNKDLISIGAYAQGSDPRIDNAIRLQPAMNAFLRQTMRDAFSFADSQVMLGQLAAQCK

SEQ ID NO: 68753 - protein, 607 aa, Parvularcula bermudensis HTCC2503
MLQTVLGTGATLGASSLLPAWAKSSSNGNLGVPSLSGTRFDLEIGQFPVRLNGKVGMATGINGTLPGPLLRLREGDDVTMNVTNRLAEDTSIHWHGLLVPFHMDGVPGVSFPGIKPGETFKYQFKVPQNGTYWYHSHSGLQEQLGHYGPIVIDPAGTDPVAYDREYVLVLSDWSFTHPHRIFDKLKKNAESLNFNRPTLSNPTGLGGMWGQMRMSPRDLADVTGETYTYLINGHSTADNFNMVFQPGERVRLRIINASAMTLFNVRLPGLPMTVVQADGLNVQPVETDEFQMGVAETYDVIIAPTEARAYAFVAESIDRSGQAVATLGPRAGMRVDAPALRAVPMLTMRDMGMAHGDMAGMSGMGRMDHGPDTATAGDDMKGHDMGAMSMMPDPHGPAVQPVKIEADIERGPGVAKVSGMTMSRLGEPGLGLDDVPHRTLTYNQLRALDMNEDHRPPGREIVIHLTSNMERYMWSFDGVKFSEVTESIKFYEGERVRLTLVNDTMMPHPIHLHGMFFDLVNGGGHHMPRKHTVTVKPADRVSVDITAEHVGDWAFHCHLLYHMHAGMMQVVSVIPPADDTTPAEKMPAGQMNMPMDHHGMNHGEGKS

SEQ ID NO: 68754 - protein, 330 aa, Rhodococcus sp. RHA1
MKLLVTGGAGYVGSVCSTVLLERGHEVVIIDDLSTGNADAVPLGAEFVEGDVAEVVSDVLGTSGTPRFDGVLHFAAQSLVGESVQYPEKYWRGNVVTTLELLEAMRHSGTRKLVFSSTAATYGEPEHSPITEADPTRPTNPYGATKLAIDHAITSYSVAHSLAATSLRYFNVAGAYKSAGENRVVETHLIPLVLQVALGQREKISIFGTDWPTPDGTAIRDYIHVLDLAEAHVLALESSIEGRHRIYNLGSGAGFSVREVISACARVTGLPIAVEDAPRRAGDPAVLVASSDRAIAELGWRPEHTDLDEIVADAWAYLQELGDRSHAARR

SEQ ID NO: 68755 - protein, 316 aa, Legionella pneumophila subsp. pneumophila str. Philadelphia 1
MIYPNILATIGHTPVVKINRLGKDLECELYAKCEFFNPGGSVKDRIGYEMVVKAEKEGRIKPGDTLIEPTSGNTGIGIALAGAVLGYKVIITMPEKMSQEKQSVLERLGAIIYRTPTEAAYNDPDSHISLAKKLQAEIPNSHILDQYANPNNPNAHYFGTAQEIIDDFGKDLHMVVAGVGTGGTITGIAKRLKEFNPAIKIIGADPEGSILGGGTEIKSYHVEGIGYDFFPDVLDNTLIDAYIKTNDADSFRTARRLIKEEGLLIGGSCGAAMWAALQAAKSLSKGQKCLVILPDSIRNYMSKFANDEWMKEMGFL

SEQ ID NO: 68756 - protein, 359 aa, Aspergillus fumigatus
MSAFDPSNVDLNTASKEDVICFLSLSENEYNGHLGARISSIFVIFITSTVFTLFPVVAQRLPQWRIPHHVYLFGRYFGTGVIVATAFIHLLDPAYQSIGPGTCIGMSGAWGEYSWCAAIVLSSVILVFLLDVGAEVYVEWKYSVPREANATATFITQPACSSPHESSDRLTATEPSSPTGGKDLYPHADELSVASEQAFRQDIAAFLILEFGIIFHSVIIGLNLGVAGDEFATLYPVLVFHQSFEGLGIGARMSALHFGRRRWLPWILCLAYGLTTPVAIAIGLGVRTSYSPGSRTALTVQGVLDALSAGILIYSGLVELLARDFLFDPCRTKRRGQILYMLGCTLLGAGMMALIGKWA

SEQ ID NO: 68757 - protein, 642 aa, Xanthomonas campestris pv. campestris str. 8004
MTQESSAPLLFADLGLSDAVMKAVAAVGYETPSPIQAATIPALLAGRDVLGQAQTGTGKTAAFALPVLSNADLNQVKPQALVLAPTRELAIQVAEAFQKYAEAIPGFRVLPVYGGQPYAQQLSALKRGVHVVVGTPGRVIDHLDRGTLDLSQLKTLVLDEADEMLRMGFIDDVEAVLKKLPEKRQVALFSATMPPAIRRIAQTYLKDPAEVTIAAKTTTSANIRQRYWWVSGLHKLDALTRILEVEPFDGMIIFARTKAATEELAQKLQARGLAAAAINGDMQQAAREKTIAQLKDGKLDILVATDVAARGLDVERVSHVLNYDIPYDTESYVHRIGRTGRAGRNGDAILFVTPREKGMLRAIERATRQPIEEMQLPSVDAVNDTRVARFMTRITETLAGGQIEMYRDLLQRYESENNVPAIDIAAAMAKLLQGDAPFLLTPPVRGAREDFAPRERNDRADRGERPRFEPKFERGPRAPDGERGARPPRPDRPAYGEDAGAERPRREPSAPRGEPEFGMESYRIEVGHTHGVKPANIVGAIANEAGLESRYIGRIDIQDDYSILDLPADMPRELLTHLKKVWVSGQQLNMRKLEEGEAAAAAASKPKFPRGPRPAGRPNRPMDRAGAPHRKGPPKPRGPRSE

SEQ ID NO: 68758 - protein, 463 aa, Burkholderia sp. 383
MSGSNTGLGTGLKQRHVTMMSIAGVIGAGLFVGSGHAIAEAGPASILAYAIAGVLVVLVMRMLGEMAVAHPDSGSFSTYADRAIGHWAGFSIGWLYWWFWVLVIPIEATAAATILNAWFPGVATWAFALGITLVLTVTNLFSVKNYGEFEFWFALIKVVAIVVFLCIGGAAIVGIIPAPAVSGVSNLFVHDGFMPHGAGAVLAAMLTTMFSFLGTEIVTIAAAESDNPQRQIVRATNSVIWRITLFYLGSILVVAAIVPWNDPLLPKHGSYQRAMELIGIPNAKAIIDVIVLVSVASCLNSALYTASRMLFSLSKRKDAPAFLHRTDSTGTPRAAVLASTAFGFVTVIANYLMPEQVFGFLLATSGAIALLVYLVIAISQLRMRKTLESTGADLTLRMWLFPWLTWLVIVFICGTLTVMLVSEDHRMEVGATAVLALIVLLASWLNKRGRDAQASEGRRASAM

SEQ ID NO: 68759 - protein, 587 aa, Saccharophagus degradans 2-40
MFQVTNKKSITILALLLFLCAACQPQGDVSGVKAPDASSPKVVEPANSSYSPTYASVSANGYGAIASVNPLATQAGLLAYEQGGNAIDAAIATALTLGVVDSHNSGIGGGCFILIRWADGSVSAIDGREMAPAKAHPQLFIRDGKAQPQLSKVGALASGIPGSLKAYEALVARGGKLTLADALQAGIRHADQGFPVDRVFASRLKVTAEKLQKFPASAGIFLKPDGAPYQEGELLVQKDLASTYRKIAAEGSAYFYGGDFAKAVEGWMADNGGIISAEDFANYRLTERQPVKSEYRGYTVYGFPPPSSGGAHVAQILNILAHFDLAAVSEVERYHLLAEAMKLAFADRAYWLGDPDYTKVPKGLVSAEYAADLAATISNQRATPVAGHGTPPLSDSDFFEQLNKHTTHIAAADKDGNWVAITTTLNTSFGSKVVIPSTGVLLNNQMDDFSIKAGEPNAFNLIGAEANKVEAGKRPLSSMSPTLVLKGDVPVLTLGAAGGPTIINQVVQALVNTLDMGMPLDQAVAAPRVHHQWMPNRLIVEGSLSEPTQQALQGMGHEVKVWGNFGATQAIGVDGDDFKAVAEPRVQ

SEQ ID NO: 68760 - protein, 316 aa, Nostoc sp. PCC 7120
MAKIIVTGAAGFIASHLVETLLKQGEEVIGIDEVNDYYDPLLKRKNIAHLQSFPNFTFIEGDIQFLDWPSLLQDVTVVYHQAAQAGVRASWGNGFRAYTERNINATQVLLEAAKDAQQLTRLVFASTSSVYGDAETLPTHEGIPPQPVSPYGITKLAAERLCGLYHKNFGVPFVALRYFTVYGPRQRPDMAFHKFFKSVLQDEAIPVYGDGQQTRDFTFVSDAVAANLAAASVPAAVGEIFNIGGGSRVVLAEVLDTMEQIVGQPIKRNHIEKAMGDARHTAADVSKARKILGYEPKVSLREGLSLEWQWVKALYT

SEQ ID NO: 68761 - protein, 429 aa, Burkholderia mallei ATCC 23344
MAARLAIEPAVGMTGKVLEVIGTLVRVVGLEATLGELCELRGASGALIQHAEVVGFTRNVALLSPFGTLGEINRGTRVIGLRRPLSVKVGNGILGRVIDSFGEPIDGRGELDYDALRPVIAAPPNPMSRRMVDASLATGVRIVDGLITLGEGQRMGIFAPAGVGKSTLLGMFARGASCDVNVIALIGERGREVREFVELIMGEDGMARSVVVCATSDRSSIERAKAAYAATAIAEYFRDQGKRVLLMMDSLTRFARAGREIGLAAGEPPARRGFPPSVFAELPRLLERTGMGEHGSITALYTVLAEDDSGSDPIAEEVRGILDGHIILSREIAARNQYPAIDVLGSLSRIMPQVATREHVGAAGRLRQLLAKHREIETLLQLGEYQAGSDPAADEAVAKIDRIRAFLNQRTDEYSPPDATLAALHELVR

SEQ ID NO: 68762 - protein, 447 aa, Parvularcula bermudensis HTCC2503
MSEDDYKQGSLTLAGTVAMGTGVMIGAGIFALTGQVAEFAGDLFPLAFLTAAIISGFSAYSYIKVSNKYPSAGGIAMILQRAYGPSTVTGSAALLMAFSMIINESLVARTFGTYTLQLFGVEGGIFVPLLAIGLIILAFVINIAGNQVIGGVSKVTAILKIGGILIFALIAIWAAGFSFQPAADGFADSASAGGFLAGVALAILAYKGFTTITNSGDEVKQPTRNVGRAIMISLAICTFIYLLVCFAVGSTLTVSEIVAAKDYALAEAARPALGNYGLWFTVTIAIIATASGLLASLFAVSRMLAMLTDMNLIPHRHFGMPGTVQRHTLVYTVVAAGLLAAFFDLSRIASLGAIFYLVMDIIIHWGVFRHLRKDVGAAPAILICAIALDAVVLIAFLLLKWQADPVIILIAAFGMVVVFSFEHFFLKRLRDNPPGEESGNDQHKAHS

SEQ ID NO: 68763 - protein, 353 aa, Aspergillus fumigatus
MQGLHTLLVRDPETGATPSCDTGNEYDGRMGLRISSIFVIMVGSMLGAVFPVFARSFSTSKFLRRAFFVAKYFGSGVIIATAFIHLLGPAEEALTNECLTGPITEYSWVEGIILMTIVVLFFVELMVMRYARFGHGHLDDLGHDDHTHPSLDAPPATVESKSHMPEEDHLGHSREHRDTESGRKASLIEEYSAQLTSVFILEFGIIFHSIFIGLTLAVSGEEFITLYIVLVFHQTFEGLGLGSRLATIPWPNSKRFTPYLLGIAYGLSTPLAIAIGLGVRNSYPPEGYTTLVVNGVFDSISAGILIYTALVELMAHEFMFSPSMRKAPIRTVLAAFGLLCLGALLMALLGKWA

SEQ ID NO: 68764 - protein, 364 aa, Burkholderia sp. 383
MSLKCGIVGLPNVGKSTLFNALTKAGIAAENYPFCTIEPNVGIVEVPDTRLKALSEIVKPERVVPAVVEFVDIAGLVAGASKGEGLGNQFLANIRETDAITHVVRCFEDENVIHVAGKVSPIDDIEVINTELALADLGTVEKALTRYSKAAKSGNDKEAGKLVAVLEKVRAQLDQGKAVRGLTLSDDEEALLKPFCLITAKPTMYVANVKDDGFENNPHLDAVRKYAESENAPVVAVCAAIEAEIADLDDADKEAFLADMGMQEPGLDRVIRAGFKLLGLQTYFTAGVKEVRAWTIHIGDTAPQAAGVIHTDFERGFIRAQTIAFDDYVTFKGEQGAKEAGKMRAEGKEYVVHDGDVMNFLFNV

SEQ ID NO: 68765 - protein, 428 aa, Oryza sativa Japonica Group
MAMSSSRSAAAIRGRRVGALARARRHATRAMASLFGHVEPASKDPILGVTEAFLADPSPDKVNVGVGAYRDDNGKPVVLECVREAERRIAGNLNMEYLPMGGSIKMIEESLKLAYGEDSDFIKDKRIAAVQALSGTGACRLFADFQRRFLPNSQIYIPTPTWSNHHNIWRDAQVPQRTFTYYHPESRGLDFAGLMDDIKNAPNGSFFLLHACAHNPTGVDPTEEQWREISYQFKIKNHFPFFDMAYQGFASGDPERDAKAIRIFLEDGHQIGCAQSYAKNMGLYGQRAGCLSILCEDEMQAVSVKSQLQQIARPMYSNPPVHGALVVSIILNDPELKSLWLKEVKGMADRIIGMRKALRENLEGLGSPLSWDHITNQLIRGMTPEQVDRLTNEYHIYMTRNGRISMAGVTTGNVAYLANAIHEVTKTK

SEQ ID NO: 68766 - protein, 121 aa, Nostoc sp. PCC 7120
MDCIHLTEIRCYGYTGYLPEEQVLGQWFEVDVKLWLDLSAAAKSDEITDTLDYRSVISLVKDLVKNSKFALIERLAGAIADSIIQQCHQVTQVQVKLTKPAAPIPDFGGKISIDVTKSRTM

SEQ ID NO: 68767 - protein, 291 aa, Robiginitalea biformata HTCC2501
MASVSLHEALASQLGKRILSVTPVRGGDIASAYRVKTPGEMFFAKTMEGESGLQQLRAEAEGLRALSRTGTIRVPEIACVFPLVTGGCLVLEFIESRPGTPGEYRAFGIQLAELHSEPQEHFGWPGDNFIGSLPQSNTPGPDWADFYATRRLAPQYERAVSSGLLAPSEIPKPAAVARWLRTSAGEVQPALLHGDLWGGNHLIDRAGRAVLIDPAVYAGHSEVDLAMSRLFGGYPPDFYQGYHSVLPPAEGESRRRAIYQLYYLLVHLNLFGSSYAGGVREIGRDLFGTGH

SEQ ID NO: 68768 - protein, 480 aa, Saccharophagus degradans 2-40
MFRRTKIVSTLGPATDEPGILEKLILAGVNVVRLNFSHGSPEDHKRRADEVRSLAAKHGKFVAVLGDLQGPKIRIARFADGPISLAVGDKFLLDASLERDAGNQHQVGIDYKELPNDVNPGDSLLLDDGRVVLKVLSVEGTKVHTEVTVAGKLSNNKGINRQGGGLTAPALTDKDRADIKTAVAIDVDYLAVSFPRSAEDMNLARQLVVEAGGNIHLVAKIERAESVENQEVLDDLIRASDAVMVARGDLGVEIGDAALIGMQKLIIERARALNRCVITATQMMESMISSPLPTRAEVFDVANAVLDGTDAVMLSAETAAGQFPVQTVEAMVRVILGAEKHPRAETRPVRADGDYSAIDESIALAAMYTAHQLKGVKCIASMTESGSTPMLMSRFGARLPIFAFSRDIRTLRRAALFRGVQTILFDNNAIPPGEMYDRALEIMREQKIIEDGDLVILSKGDTSEHGGTNTMKILQVGSTN

SEQ ID NO: 68769 - protein, 1438 aa, Debaryomyces hansenii CBS767
MVNSSNGSNPLSASSTDLNSAQQQYTNVNNPVSNANHSHRHTAGPKGRRPSLLRNDSSSNSVYTPSNTAGDGSTPMHSSHLKWGSSGTGNNNASSTAINDSHNSTNANSTSLLTPSSNKRQTSHNNSGNNTLSSTGGRARSRSITQTLSHNLQNNNKQYLSQEKAYLKKMKNQFVDDYYTKGITGAEMKEVNNNDEDEDEDEDETNPNGHSDLLADMDDDKYQIDYNLAFTLLKNGKNAININPNRNITQLNADSADDPAVIERLEWQSMLTSVLTGDVVRSEKTKIINNNSPENEQSSFLHATYKENLWFGIHAKLFNRTEDDQRKIIEYRRTLADALFDEVLNFEVNHDDPESNPPRNQVAYILDKYDKCCDLWRTLEDMKNEKPVCRTAEFQDRIDALTAWLSITDAMQRESDSLKVWIGNDEMDITKSRSESGSAPSSEATTPTNTKKIFNEDNKSLAERLMKEKDVYSIFQKRIFFPLAPWMIKSKDTYLRLGHIFETLKLPDYIHDLIQLCLIPMKLIKEIINVRLVYAKKLENPTLMMIDQMIDDFKSYITIALEVKLGIVEYCRPDVGQIWVLSDLFDSENQEFDKVVLKCVKYFFALLNKKLLDSSRSPTNFRTFKEPEELEETWNYLKWLGNLIDGGSVVVAEHITVLTLKLIHRLLAYFNNQIGTPPAKSAGSSDLIRWYSSTTENFGQLRRKLARFTGEISRDFTNSLVFDLSSTPSNRTKNILEVLKSTNHFLVYTGTIETQGTYFFASAELMGNEQEILRIINGSYIGSDPNEANLDFSDLLKMLQLHEDGETDQHPDLVDHLIPNESSDFGYVLALCPPKPIVWEGHIVTIHLENVPITDIKVGQILMITKLPYGSLHMVKEKFLDTVNDFILVGGMMKQVEQRCSLAKVHHELTKINRVFFKMSLSVLDSVKKVRANCKELAAESSCQELINSYFIYARDFGKNSVKNLDSSRKSTVIMKLIQLSIEWVSFVCDDCIPTDRRTFRSCVLALEFAMDMTRGFNVLVLNDEQFYKLKLKVARCMSLLISHFDIMGARSSEAEKKKLLKWSSQRHRIENSADDACIIQAYREDVMREIEEIENYRKDLQEQLLSIGRVLDVTDLEYQFVTLLASSFSSVSIRWQKGRFIGGGTFGHVYAAVNLDTGGVMAVKEIRFHDSQSVKNIVPSIKDEMTILEMLNHPNVVQYFGVEVHRHKVYIFMEFCEGGSLAGLLTHGRIEDEMVIQVYTLQMLEGLAYLHQSGVARRDIKPENILLDHNGVIKFVDFGAAKVIATSGRTLGGGSGGANQGRSMNGTNLNSMTGTPMYMSPEVITGASGSGNGVVDIWSLGCCVLEMATGRRPWTNLDNEWAIMYHIAAGHKPQLPSADQLSEPGRKFISRCLEHDPSNRPGAVELLNDPWIVAIRQAAFVSSDSVSTPSSEVGSDM

SEQ ID NO: 68770 - protein, 270 aa, Aspergillus nidulans FGSC A4
MVCKKAGLIQNLGLFDLKKAQTWLPISLLLVGMIYTGNKALQFLSVPVYTIFKNLTIIVIAYGEVFMVGGSVKPLALLSFGLMVLSSVVAAWADIQIATAATAKASSDSAVATLSALNAGYAWMGTNVVFSASYALGMRRVIKKTNFDNWDVMFYNNLLSVPILLLSSLLVEDWSSENLQRNFPAESRQSLVIGIFYSGVAAIFISYCTAWCVRATSSTTYAMVGALNKLPLAVAGIVFFAAPVTFGSVSAIVLGFISGLVYTWAKSTGA

SEQ ID NO: 68771 - protein, 132 aa, Marinobacter sp. ELB17
MLLQIQMDFPNTKPEKVDTVPDSLMSGLSIPPAEVFRNSQAYFVIYRSESDVLSVLRNNESLAQLKPLDIVVTCQSERQDYDFISRYFWPANGGDEDPVTGSIHTGLAPFWAERLGKTDLVAYQASKGRITV

SEQ ID NO: 68772 - protein, 262 aa, Polaromonas sp. JS666
MTSDNSSMSVAVITGGARGIGLAIGQWFLKHGHRVALLDIDGDTLAQTAARLNDDHVLAVHCDVSDPQQVQAAVDKVRAAFGRIDALVNNAGVAVFKPIAETTFAEWRHVMATNLDGAFLCTQACAPVMQKTGGGSVVNIASISGLRASTLRVAYGTSKAALIHLTKQQAVELGNVGIRVNAIAPGPVETEMAKLVHSVAIRSDYYDAIPLNRYGTTEEIASVAGFLCSAAASYVNGQVVAADGGFDAAGVGLPTLRKRAAA

SEQ ID NO: 68773 - protein, 328 aa, Neisseria meningitidis FAM18
MPMGIAPYCRNLIIQEQKMKIANSITELIGNTPLVKLNRLTEGLKAEVAVKLEFFNPGSSVKDRIAEAMIEGAEKAGKINKNTVIVEATSGNTGVGLAMVCAARGYKLAITMPESMSKERKMLLRAFGAELILTPAAEGMAGAIAKAKSLVDAHPDTYFMPRQFDNEANPEVHRKTTAEEIWRDTDGKVDVFVAGVGTGGTITGVGEVLKKYKPEVKVVAVEPEASPVLSGGEKGPHPIQGIGAGFIPTVLNTKIYDSITKVSNEAAFETARAIAEKEGILVGISSGAAVWSALQLAKQPENEGKLIVVLLPSYGERYLSTPLFADLA

SEQ ID NO: 68774 - protein, 614 aa, Aspergillus nidulans FGSC A4
MNGHVEPAALPAHRASTDSETEQPPRFDEQQALSTLDVACLIINKMIGGGIFVSPRIVAHLTGNKLIALSLWIFGGVYSFCSIYIYLEYGLAWPYNGGEFIYISKIFPVPPLLFASAFAWVFIASATPTSNSVTFARYINPTKDGQPDVWFTKFFACVIVVGICAVHYRLVNIGIWANDCLAVYKVLFLLVLVLAGFVETCRQGADGGLLGLGDYATTHGSPSPTNVALAILQVLYSYQGWENANYVTSEIKGAGEHKKRRLKRGAFIAISIVMFLYISFNMFVFFIMDFASVTNPRNNVAADYAISVFRTSHTKMASHAIYVNIALAAAGNIIGVTFSNARVNRDIAKHRIIPFYKFFSKSSKYGSTQWDNLGTPTGGLILQALVTCITIASYEPYRTNLTMYTYGHAVVCCALGIGVFFIRKRMNQYETSSTDPADKTYGNHWKYQVMKSSQLRYTATIFFIVVNLFLVVVPFIPSDNPDGTPRDTPSWVQPVIVTALYALGASVSLYIITFVEDLKFRGSRYNVHDPSDLSGFINYNERRWIVRYPGYPEWPWGWKSAFRLLPTLFTPLSWERIKERLFTNGEAEAAKELRRKAQQPLEPAYRLEQYLVLP

SEQ ID NO: 68775 - protein, 417 aa, Marinobacter sp. ELB17
MEFSHVSSALGILHPVCIAKGRNAEVWDEAGQRYIDFIGGIGVLNLGHCHPAIVEAVKTQVDTLMHSAFNALPHRTYLSVVDRLNQFVPVSYPLSCMLTNSGAEATENALKVARGVTGRQAVIAFDDAFHGRTLAALNLNGKVKPYKAGLGALPGPVYHIPFPSRDSGISAEQSLAALDRIFEVEIAPSEVACIIFEPIQGEGGFRLLCPEFAKTLRAICNKHGILLICDEIQSGFGRTGKRFGFSHLGIEPDLMLLGKSIACGLPLAALVGRKEFMDALPKGALGGTYSGNAVACAAALAVMDIMQEDALTAWATEQEEAIVHSYQAWKECGHFPMIGALTGIGAMRGIVFEDTENATGAEHLANLLVAARNAGVLLIASGRKRNVLRLLPPLTTEPEVMAEGLDMIKQALGTLQV

SEQ ID NO: 68776 - protein, 933 aa, Lentisphaera araneosa HTCC2155
MKTQVQTEVDTAAETDVNPFMVYHFGKIKNDGNASMRNLLGGKGANLAEMSSIGIPVPPGFTIPTTMCTYYNEKGQVLPNELKDEVNEAIKLMEEQTGTEFGSESNPLLVSVRSGARVSMPGMMDTVLNLGLTDIAVQGLATKTNNERMAYDSYRRFIVMYADVVKGFNGEDFEHIIDAAKAKAGVEQDTELNIEQLKEICLELKELYAKLSGEDFPQEPREQLYSAINAVFDSWNTERAMLYRKIQNIPSDWGTAVNVQAMAFGNKGVTSATGVAFTRNPSTGEKTYFGEYLINAQGEDVVAGIRTPLPISAESAKAKGLEKQSMEEVMPETFAELTAVFETLEQHYTDMQDVEFTVEEEKLYILQTRNGKRSGFAQVKIAVDMVEEGLVDEKTALGRVEPGSIEQMLSPIFKAEDKANAKDQLIGRGLNAGPGAASGVVALTAKKAEWYKEQGFPCVLVRTDTSPSDFGGMMAAEGVLTVRGGATSHAAVVARQFGKPCVCGLTGLLVNEENKTITFGNQVIKEGDNISIDGCTGEVFFCKIETSPSEISQAFIEKCIDPKDSEVCGHYEKIMTWADKFRTLKIRTNADTARDLNVALSLGAEGVGLTRVEHMFSDEQRLLLLRQVMLAKDEEIKTLALNHIEHFLKDDFSALFQTLDGRPATVRLLDPPMHEFMPHSDGDTAKTAKAIKVTEAELKSSLGDMAEHNPMLGFRGCRLGILKPELTRVQVRAILTAALELNNALIPCKPEIMVPIIMHENELIHQRNLIDKVAEELFAELNIKVAYSVGTMIELPRAALQADEIAKHADFFSFGTNDLTQTTLGISRDDANHFLPTYKNGVSDPLTGTGNFEVYPDDPFQTLDQSGVGKLVQVGVKGGRSTSENLKIGICGEHGGDPASIDFFHRTGLDYVSCSPYRVPVARLSAALSAIRN

SEQ ID NO: 68777 - protein, 484 aa, Coccidioides immitis RS
MKGYTSMLRSMSPRLQFSPAISRTSNQLLRQRTCQQQSRQIRLLSYSRVYSNSGKASHLSQSGLWRSSQCLRRNILRPIPSQLNSCQLRFYADTIVKVPQMAESISDGTLKQFSKQIGDFVERDEELATIETDKIDVTVNAPESGIIKEFLAKEEDTVTVGQDLVKLQPSTENPSSGKDKLQENTQSAELKVREEQPQEQPNRRERGESAQVTQQQPSPKEEKPAPKVERESPKESQLMANAAHGSVGNRDERRVKMNRMRLRIAERLKQSQNTAASLTTFNEVDMSSLMEFRKLYKEDILKKTGIKLGFMSAFARACVLAMKEVPAVNASIEGPNGGDTIVYRDYVDISVAVATEKGLVTPVVRNVENMDLTTIEKAIADLGQKARDNKLTIEDMAGGTFTISNGGVFGSLMGTPIINLPQTGVLGLHAIKNRPVAVNGKVEIRPMMYLALTYDHRLLDGREAVTFLVRVKEFIEDPRRMLLG

SEQ ID NO: 68778 - protein, 133 aa, Coccidioides immitis RS
MTGGKSGGKASGSKSSQSRSSKAGLAFPVGRVHRLLRKGNYAQRVGAGAPVYLAAVLEYLAAEILELAGNAARDNKKTRIIPRHLQLAIRNDEELNKLLGHVTIAQGGVMPYIHQNLLPKKTPKTGKNPSQEL

SEQ ID NO: 68779 - protein, 438 aa, Novosphingobium aromaticivorans DSM 12444
MNKVRGSKVRGLGFWMTLALVVGNMIGSGIYILPATLAPLGFNQLIGWAVTLAGALCLAAAFARMGARLPLAGGPYAYAQAAFGPIPGFVTAWSYWTMLWAGNGAVAVALVSNLSLIAPWIGATPAVPALLSVGFVWLLTLVNIRGVRAAGDVSVVTTALKLVPLAGLIGLAIWLLITGAPTVVQPEVPLSGGVIATAAGLTFWGFLGLESATVPADKVENARTVVPRATLIGVAITGLVYMGISGAFALYMPMADAAASPAPVADFLARFFGSGMGQVVALFAAISAFGTLNGFILLQGEVPWAMARGGVFPRWFAAEGPRGTPVRSHVVSSILLSIVTLLNYGRGMGDLFAFIASVSLAAGMLSYFVAMLAAVRLLPDERPMVIAALVGAAFIAWAAWGLGAEALTYGAGFVALGLPVYLWIRRDGAASTTANDPG

SEQ ID NO: 68780 - protein, 446 aa, Shewanella oneidensis MR-1
MSEAKLLLVEDDASLREALLDTLMLAQYDCIDVASGEEAILALKQHQFDLVISDVQMPGIGGLGLLNYLQQHHPKLPVLLMTAYATIGSAVSAIKLGAVDYLAKPFAPEVLLNQVSRYLPLKQNRDQPVVADEKSLSLLSLAQRVAASDASVMILGPSGSGKEVLARYIHQHSSRAEEAFVAINCAAIPENMLEATLFGYEKGAFTGAYQACPGKFEQAQGGTLLLDEISEMDLGLQAKLLRVLQEREVERLGGRKTIKLDVRVLATSNRDLKAVVAAGQFREDLYYRINVFPLTWPALNQRPADILPLARHLLTKHAKALNVVDLPEFDDAACRRLLSHRWPGNVRELDNVVQRALILRAGALITANDIIIDAQDVPLTSDDAEYMSEPEGLGEELKAQEHVIILETLVQCQGSRKLVAEKLGISARTLRYKMARMRDMGIQLPS

SEQ ID NO: 68781 - protein, 514 aa, Shigella flexneri 2a str. 2457T
MSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLAGAVHKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVAGGKLSDIAPTMLSLMGMEIPQEMTGKPLFIVE

SEQ ID NO: 68782 - protein, 488 aa, Glycine max
MSGEETQRNVFGAETASSLVKELRDNFGKGTTRSYEWRVSQVKALLKAVVENEDQIVGALCSDLAKPPLETVVYEIGMFKNSCEVILKELKHWMTPEKVKTSIRTFPSSAEIVPEPLGVVLVISAWNYPILLSLDPVVGAIAAGNAVVLKPSEIAPATSSVLAKLIEKYMDNSFVRVVEGAVDETTALLQQKWNKIFYTGNGRVGKIVMTAAAKHLTPVVLELGGKSPVVVDSNNNLLVAARRIIAGKWGLNNGQACISPDYVITTKDYAPKLVDTLKTELESFYGRNPLESEDLSRIVSSNHFARLSKLLNDDKVSGKIVYGGEKDEKKLRIAPTILLDVPQDSSIMGEEIFGPLLPIITVNKLEESIDVINSGAKPLAAYVFTTDNKFKEQFVKNVSAGGLLVNDTALHLVVDTLPFGGVGESGMGAYHGKFSFDAFTHKKAVLYRSFAGDSAIRYPPYTDTKLRLMKALVGGRILGIIRALFGWS

SEQ ID NO: 68783 - protein, 505 aa, Geobacillus kaustophilus HTA426
MATVKQKKMEPMPTKRDFYHLIVNGERVESASGETFVVTNPATGEPVARVAKGTREDAERAVQAARQAFDRGKWRHFPVQKRARILYQIAAIMRERFNELVELEILNTGKALSAAQGQVMQAIEDFEFFAGAIIGHRGAVNPMPGAFHNYTEKEPVGVCAQIIPWNYPLMMAAWKIAPAIAAGCSVVVKPASLTPLTCLVLAEICHEAGVPEGVVNVVTGAGAEVGDYLVEHPLVDKVAFTGSTPVGKEIMEKASKTLKRVTLELGGKSPSLVFADADLEAAVAGSLFGIFYNSGQSCEARSRLYVHESIYDAFMEAFVAKTKQLKLGDPFDAGTHVGAIISRGQLEVIDEYVQSAVADGATVAAGGKEAVVAGFENGYWYEPTILTNVNHQMKAVREEIFGPVVVVMKFRDEAEAIELANDSDYGLAAAIWTKDHGRAVRVAKQLRSGIVMVNSPFSAFPGTPFGGYKQSGFGRELSVEALDLYTETKSVLSYYGPRPLNPFGV

SEQ ID NO: 68784 - protein, 480 aa, Arabidopsis thaliana
MVKICCIGAGYVGGPTMAVIALKCPDIEVAVVDISVPRINAWNSDQLPIYEPGLDDIVKQCRGKNLFFSTDVEKHVREADIVFVSVNTPTKTTGLGAGKAADLTYWESAARMIADVSVSDKIVVEKSTVPVKTAEAIEKILMHNSKGIKFQILSNPEFLAEGTAIADLFNPDRVLIGGRETPEGFKAVQTLKEVYANWVPEGQIITTNLWSAELSKLAANAFLAQRISSVNAMSALCESTGADVTQVSYAVGTDSRIGSKFLNASVGFGGSCFQKDILNLVYICQCNGLPEVAEYWKQVIKINDYQKNRFVNRIVSSMFNTVSNKKVAILGFAFKKDTGDTRETPAIDVCKGLLGDKAQISIYDPQVTEEQIQRDLSMKKFDWDHPLHLQPMSPTTVKQVSVTWDAYEATKDAHAVCVLTEWDEFKSLDYQKIFDNMQKPAFIFDGRNIMNVNKLREIGFIVYSIGKPLDPWLKDMPAFV

SEQ ID NO: 68785 - protein, 196 aa, Burkholderia sp. 383
MLLMIDNYDSFTYNLVQYFGELGEDVRTYRNDEITLDEIASLNPDAICLSPGPSNPQHAGITLDVLKEFAGKKPILGVCLGHQAIGEAFGGRVVRAKTIMHGKVSKIETDCSGVFADLPKHFDVTRYHSLAIERESLPDCLEVSAWTDDGEIMGVRHKTLPIEGVQFHPESILSEHGHALLENFLKQARAAAAQAA

SEQ ID NO: 68786 - protein, 442 aa, Oryza sativa Japonica Group
MAMAAASAMRPLAPLFLFFFFSLAASASDNILANSSLADGQKLVSAGGVFELGFFTPPGSTTAARFLGIWYRDIDPPTVVWVANRDAPVSGTAGSLAVVVNGGGGGGGGRLVLGDGSGRVVWSSAPSNVTASDPVAARLLDSGNFVLAGGGGSGDVIWQSFDYPSDTLLPGMKFGWDLTTGLDRYLTTWRSAGDPSPGDYTFKIDPRGAPEGFIWYNGTSPVYRNGPWDGLQFSGEPGDGAQQHQLPLRVRRQPHRRLLHLRRRRRRRRRSPLEAGGWSLYWSLPRDQCDQYAHCGAYGVCDVGAASMCGCPAGFAPASPRNWELRDSSAGCARRTRLNCTGDGFLPLRGVKLPDTTNATVDAAIAVDQCRARCLANCSCVAYAASDVRGGGSGCIMWSSPLVDIRKFSYGGEDLFMRLAASDLRMILLSSLVRMPYTFLRF

SEQ ID NO: 68787 - protein, 547 aa, Oryza sativa Japonica Group
MSPATAAADDLRAEEEGKGGRSSSRQEEANVLLAVDAAEGGGAWSPVGWFRMLGRELHWSFVAGVVATYGASQGLGGGVMRVASDYYWKDVQRVQPSAAQVYQGVTSIPWMVKPLWGLLTDVLPIAGYRRRPYFVIAGGFMGVVAMLVLSLHSKLHVLFALLALMAGSASVAIADVTIDACVAENSIVHPHLAADMISLNGFCASVGGLIGFSISGFLVHAIGSQINLVFLKGALGMLAIPSALVILAGMMIKDVHMPNFPYELAHMKFVEASRTMMATLKCPEVWRPCVYMYMSLALSVDIQEGMFYWYTDRNAGLSFSEGLIGFIFAVGSVGSLIGVILYQNILKDHSFRSVLCLSQLLLSLSGMLDLILVLRLNLKLGIPDYYFAVIDEGVSKMINRIKWMPLLVLSSKLCPPGIEGTFYALLMSIDNVGLLSGSWAGGLILHVLNITRTEFKNLWAAILIRNAMRLLPLALLFLVPRSDQNSNLLPADLLPEDDAAQYQMDNVELTSLTVDGKSSTGSLHQECKNQDVVENDDDEASLLANRS

SEQ ID NO: 68788 - protein, 201 aa, Legionella pneumophila subsp. pneumophila str. Philadelphia 1
MSVLVGRKAPDFTVAAVMGNGEIVDKFNLHEHLKGKYGLVFFYPLDFTFVCPSELIALDHRIEEFKRRNVEVVAVSIDSHFTHNAYRNTPVKNGGIGPVRFTLAADMTHSICQSYGVEHPVAGVAFRGAFVIDTNGMVRSQIVNDLPIGRNIDEILRIIDAVQFFEENGEVCPAGWQKGQAGMKASPKGVAEYLSEHSESL

SEQ ID NO: 68789 - protein, 638 aa, Robiginitalea biformata HTCC2501
MIELAGIVILGIVAQWVAWRLKLPAILPLILIGLLVGPISTLFTEDGAKLIEPIWNGSKGLFPGEGLYYFVSLAISIILFEGGLTLRRSEVANVGPVITKLITLGTLVTFFGAGIAAHFIFGLSWQISFLFSGLIIVTGPTVITPILRNIPLKKDVSAVLKWEGILIDPIGALVAVLVYEFISVGAEGGAYTKTALIEFGKILLFGLTFGFTFAHALAFVIKKNFIPHYLLNVVALSTVLGVFVMSDIFAKESGLLGVVVMGMVMGNTELPNLKELLYFKESLSVLLISILFIVLAANIDLVDLQLIYNWNTALLFAIIVFLIRPLGVFLSSLGSHLSINERLFIGWVGPRGIVAAGIASLFGSKLIDQEVPGAEFITPLVFVIVLGTVLLNATTARLFAQLVGVFLKKSEGILIIGAAKPSRLIGQYLMKNNRHVVLIDSNQTNVEKSRNLGLEALTADIYSDTLSDNIELSDIGYLMSLTPSSVVNKYAIEKFRNQFGEHGSFRLVDADEMNDPENNPKEGLFSHTDDFIKLMEATRHYPAIHEIDLKDRQHYEGLIEITKAEDDIIPLFLKDPEGDLIIIPSYSKDFTDITEGFKLVYLGKVFDLDKEEDEPVGKENGKQHAQADKNGSPGEQDA

SEQ ID NO: 68790 - protein, 228 aa, Burkholderia sp. 383
MTQFRIAPSILSADFARLGEEVRNVVAAGADWIHFDVMDNHYVPNLTIGPLVCEAIRPHVQVPIDVHLMVRPVDRIVPDFAKAGANLISFHPEGSDHIDRTLSLIRDHGCKAGLVFNPATPLNYLDHVMDRLDFVLLMSVNPGFGGQSFIPETLNKLREARARIDAYTERTGREILLEVDGGVKTDNIAEIAAAGADTFVAGSAIFGKPDYRTVIDEMRAALATVERS

SEQ ID NO: 68791 - protein, 458 aa, Xylella fastidiosa Dixon
MFRPSLIHRSMSSLQPMSPVSDSPSLGEMHASVAVSRRGHWGFRFLAFLGPGYMVSVGYMDPGNWATGLAGGSRFGYMLLSVILLSNVMAIVLQALAARLGIASDMDLAQVCRARYSRGTTLALWVVCELAIIACDLAEVIGTAIALNLLLGIPIIFGVLITAVDVVLVLLLMHRGFRALEAFVIALLLVIFGCFVVQIVLAAPPLQEVLCGFVPRWQVVADPQALYLAIGIVGATVMPHNLYLHSSIVQTRAYPRTPVGRRSALRWAVADSTLALMLALFINASILILAAAVFHAQHHFDVEEIEQAYQLLAPVLGVGVAATLFATALLASGINSTITATLAGQIVMEGFLRLRLRPWLRRVLTRGLAIVPVIVVVALYGEQGTGRLLLLSQVILSMQLPFAVIPLLRCVADRKVMGALVAPRWLMVVAWLIAGVIVVLNVKLLGDYAVHLMVGVSN

SEQ ID NO: 68792 - protein, 466 aa, Debaryomyces hansenii CBS767
MLRNIPRSLRKDGGKRIPGLISRVANQFSTTSSLLNKKSIPDAPEDSHTGQYINTITKPFTVTTYARPNVVMTHGKGSYLYDLENRQYLDFSAGIAVTCLGHSHSKITEIISDQAATLMHCSNLYHNLYAGELANKLVTNTINSGGMKEAQRVFLCNSGTEANEAALKFARKYGKSFSDDKYEMITFKNSFHGRTMGALSVTPNEKYQKPFAPLVPGVKIAEPNDISSVEKLISKEKTCAVIIEPIQGEGGVNAIDAEFLVSLKKLCVDNEVVLIYDEIQCGLGRSGKLWAHCNLPEEAHPDILTMAKALGNGFPIGAVMVSDKIEKVLKVGDHGTTYGGNPLGSKIGSYVVDQVSDKEFLLEVEEKSEKFTKGLSKIANKHPDHIGEVKGKGLLLGLQLKGNLDVGDVVAKCRENGLLVISAGMNVLRIVPALNIPNEAIEEGLDVLDKCIDELSKDPKSSFSQS

SEQ ID NO: 68793 - protein, 257 aa, uncultured archaeon GZfos27G5
MGLEIVNDVRTDYVCDMVRNGKREDGRGFHEYRDISVERDVIKRAEGSARVKIGDTEVLVGVKVELGTPFPDTPDKGVIITNAELVPLASPKFESGPPNENSIQLARVVDRGIRGSETIDLDKLCIEEGEKVWMVFIDIHVLDDNGNLVDAAALGAITSLLNLRIPNERYGLTGENTLPMRDTPVAATMVEIEGNILVDPSFDEGNAAASSVTVISNADGTLSGMQKSGSSGLKEAQIAEMVEIGIEKAGEIRKKYL

SEQ ID NO: 68794 - protein, 491 aa, Helicobacter pylori J99
MAQKTLLIITDGIGYRKDSDHNAFFHAKKPTYDLMFKTLPYSLIDTHGLSVGLPKGQMGNSEVGHMCIGAGRVLYQDLVRISLSLQNDELKNNPAFLNTIQKSHVVHLMGLMSDGGVHSHIEHFIALALECEKSHKKVCLHLITDGRDVAPKSALTYLKQMQNICNENIQIATISGRFYAMDRDNRFERIELAYNSLMGLNHTPLSPSEYIQSQYDKNITDEFIIPACFKNYCGMQDDESFIFINFRNDRAREIVSALGQKEFNSFKRQAFKKLHIATMTPYDNSFPYPVLFPKESVQNTLAEVVSQHNLTQSHIAETEKYAHVTFFINGGVETPFKNENRVLIQSPKVTTYDLKPEMSAKGVTLAVLEQMRLGTDLIIVNFANGDMVGHTGNFEASIKAVEAVDACLGEILSLAKELDYAMLLTSDHGNCERMKDENQNPLTNHTAGSVYCFVLGNGVKSIKNGALNNIASSVLKLMGIKAPATMDEPLF

SEQ ID NO: 68795 - protein, 247 aa, uncultured archaeon GZfos27G5
MKEEIELIKEGKRSDGRGFDELRPIKIEVGVLKRADGSCYLELGNNKVIAAVYGPREMHPRHAQDAKMAVIKFRYNMAPFSTDDRKRPGPDRRSVEISKVCREAFDPVIMRELYPKMGIEVYVELLQSDAGTRTAGINAASIALADAGIPMKDLVSSIAVGKINGEVVLDLNAAEDNNGEADMPIAMIARTNTITALQMDGRMTQEEFGRGLKLAMGACHQIYELQRAALVTRYNQNYEGKSKKEEE

SEQ ID NO: 68796 - protein, 393 aa, Gluconobacter oxydans 621H
MKALTWQKKGKITCESVRDPEIIEGRDVIIKVTACAICGSDLHLMDGLMPTMKCGDILGHETMGEVVEVGKDNKRLSVGDRIVVPFTISCGECRQCKWGNWSCCERTNPNRRQQAETFGYPLAGLFGYSHITGGFSGGQAEYLRVPYADVGPIIVPEGLEDEQVLFLSDIFPTGYQAAENCEITPESEKTIAVWGCGPVGQMAIRSCFLLGAKRVIAIDEVPERLAMARAAGAETIDFRTQNIQETLVEMTDGLGPDAVIEAVGMEAHGADTMMQKVGSALLSATTLERPFALNQAILGCRPGGILSMPGVYAGALGPVMIGILMNKGLTLRTGQTNTQKYLKPLLERIQKGEIDPSFVISHRSSNLEDGPALYEKFRDKKDRCTKVVFRPHG

SEQ ID NO: 68797 - protein, 439 aa, Helicobacter pylori J99
MNFQENLAALDLEYLWHPCSQMQEHQNFPIIPIKKAQGIYLYDFNDNAYMDLISSWWVNLFGHNNAYISQQLKNQIDNLEHVLLASFSHKPIITLSQRLCQLTGMDKCFYADNGSSCIEIALKMSYHAHFLKNQTRRKKLFLSLSNSYHGETLGALSVGDVKLYKDTYTPLLLKNLITPVPKNDSEIENSLNALKRLLDKHGEEICAFIAEPLLQCAGNMHIYSAKYLKQAVLWCKQKNIHIIFDEIATGFGRTGSMFAYEQCGIKPDFLCLSKGISGGYLPLSALLTHNEIYNQFYAPYEENKAFLHSHSYTGNALACACANATLDIFEKENVIEKNKALSEFIFSALQNALKPLIERQVVSDLRHLGMVFAFEVFLQTKERLSLAVFKKALKKGLLLRPLNNTIYLMPPYIITHEEIKKAIAGLVEAIDELKKAENK

SEQ ID NO: 68798 - protein, 397 aa, Nitrosomonas europaea ATCC 19718
MKIHEYQAKAILSRYGVSVPAGVACFSVEEAVLAAEKLGGNKWVVKAQIYAGGRGKGGGVKLAKSIAEVRQFAEAMLFAPLVTHQTGPQGRIVHRLYIEQGVDIRHEYYLALVVDRTSQCVSLIASDAGGMDIEQVAAGSPEKIHKIQIDPLAGLNLRDAERIVREIDLPESCQSAAITMLDALYRAFDENDASLLEINPLIVTPDNRLIALDAKMNFDDNALFRHPEIVALRDLDEDDPLEAEASQHGLSYIPLDGDIACLVNGAGLAMATMDIIKLYGGNPANFLDVGGGATVEKVTEAFKLMLRNPGLQAILVNIFGGIMRCDVIAEGVVSAAREVKLTVPLIVRLEGTNVELGKKILADSGLTIISAGNMADAARKAVDAAARHCAEAATGGV

SEQ ID NO: 68799 - protein, 227 aa, Brassica napus
  misc_feature (82)..(82): Xaa can be any naturally occurring amino acid
  misc_feature (89)..(89): Xaa can be any naturally occurring amino acid
MDSVFSNVVRAPEDPILGVTVAYNNDPSPAKLNLGVGAYRTEEGKPLVLDVVRRAEQQLVNDPSRVKEYIPIAGLADFNKLXSAKLILXVADSPAIQESRVATIQCLSGTGSLRVGAEFLKKHYHQSVIFIPKPTWGNHPKVFNLAGLSVEYYRYYDPATRGLDFQGLLEDLGAAPSGAIVLLHACAHNPTGVDPTSERWEQIRQLIRSKSSLPFFDSAYQGFASGS

SEQ ID NO: 68800 - protein, 349 aa, Magnaporthe grisea 70-15
MAKTEKAFTNAEKILMAKAWIYGIRPFFKHGKNFNPTRDIPPQTGKTMLVTGGASGIGAAFVAEIARHSPAQVWIADLRPEAAEKAISAISAECPDVKIDFLQIDLGDAESVKRAASEFLSRTERLDVLLNNAGILPAKGWTTKDGYESMFGVNFVGHARLTELLLPRLMETAAIPGADVRVVSVASGGHGVHPKPDGVRLSSGGALLKEPTCGGMTAMQRYAQSKLAVILWVRRLAREFPAITIVSAHPGTVATSIANDLSGSTRQPPAFFVKLTGTKTPEMGCYNQLWCATAPRDQLVSGKYYCPVGLPDQEFGIARDRKKADELEERLWVWLQKELKGDSFVKVDA

SEQ ID NO: 68801 - protein, 435 aa, Coccidioides immitis RS
MTKRKRLTREAKWLVDHPLVCNRQDNCYMGRLGSNPPQPATQLTTQQSHKSIMQPHHHSFIAQGTPYRVFIYRHKLYSVVLQMQQTCKYSIQDTCFSPVVAKLTTLFVLKSFVIMADCPKHHCLYSRESRTPNYTIFGGPISSSGQLHKPLWHGFCEIESEPALFNVMLRDWGVKGVKVQEVVSLDNDMLQFLQPIYGLVFLFRWREDDPVKQEQSCPEGLWFANQTVNYACASVALLNIINNIEGVELDEELRSFKEFTMDFTPALRGDAIRNFAFIKEIHNSFARKMDILNVDLQLKNDASKKRSKLCRKDQGFDESEAGFHFIAFVPARGKVWKFDGLERQPQNLEKAVVSEIDMQSYTNMSKERLLEAQKTLIDAQKEICVAIKEEQQVREADNTYAEKKRHDYGPAVYSWLRALARKGLIEHLARDTPPP

SEQ ID NO: 68802 - protein, 390 aa, Rhodococcus sp. RHA1
MNTTTLALIELGAVFFALGLLGRLAAQFGMSPIPFYLLGGLCFGSGGFVNLGDISEFSHLASEIGVVLLLLLLGLEYTASELVTGLRRSWMAGVVDAVLNAAPGAVVALMLGWGTTGAVVMAGVTYISSSGIIAKVLSDLGRLGNRETPVVLSILVFEDLAMAVYLPILTALLAGVSFAGGLEAVGISLVVISVVLVIALRYGRYVSALLDSPDSETLLLKLLGAALLVAGISSAMQVSAAVGAFLLGIAISGTTAHNASRVLEPLRDLFAAMFFVVFGLNTDPRAIPPVLGWAALLAVVTALTKMITGAWAAKQQGVARLGRARAGVALIARGEFSIVIAGLALSAGAVESELVALATAYVLLMAVIGPVAARVVEPVAGAWIRVRTSA

SEQ ID NO: 68803 - protein, 423 aa, Triticum aestivum
  misc_feature (306)..(306): Xaa can be any naturally occurring amino acid
MTNSPPRLSPPYLSPPQTPRGDGRNRTQPPPLGFAAAVGGGKPAATAAMAGHGQDRKTIDLEDGWAFMQRGITKLINILEGKPEPQFSSEDYMMLYTTIYNMCTQKPPHDYSQQLYDKYREAFEEYIRATVLPSLKEKHDEFMLRELVQRWSNHKVMVRWLSRFFHYLDRYFITRRSLTALRDVGLICFRDLIFQEIKGKVKDAVIALIDQEREGEQIDRALLKNVLDIFVEIGLGNMDCYENDFEDFLLKDTTDYYSVKAQSWIVEDSCPDYMIKAEECLKREKERVGHYLHINSEPKLLASNLXRIRHELLASYATQLLEKEHSGCFALLRDDKVEDLSRMYRLFSKITRGLEPISNMFKTHVTNEGTALVKQAEDSANNKKPEKKEMVGMQEQVFVWKIIELHDKYVAYVTDCFQGHTLF

SEQ ID NO: 68804 - protein, 138 aa, Microcystis aeruginosa NIES-89
ADMLTEIGVHYVVIGHSERRQYFGETDETVNLRVISAQKQGLTPIICVGESKAQRDAGETEKVIIKQIQGGLVNVDQKNLVIAYEPIWAIGTGETCESEEANRVIGLIRQQLDNPEVTIQYGGSVKPDNIDEIMAQSQ

SEQ ID NO: 68805 - protein, 871 aa, Arabidopsis thaliana
MERHCLFFVIFSLILHLVQAQDPIGFINLDCGLSIQGSPYKESSTGLTYTSDDGFVQSGKIGKITKELESLYKKPERTLRYFPDGVRNCFSLNVTRGTKYLIKPTFLYGNYDGRNVIPDFDLYIGPNMWITVNTDNTIKEILHVSKSNTLQVCLVKTGTSIPYINTLELRPLADDIYTNESGSLNYLFRVYYSNLKGYIEYPDDVHDRIWKQILPYQDWQILTTNLQINVSNDYDLPQRVMKTAVTPIKASTTTMEFPWNLEPPTSQFYLFLHFAELQSLQANETREFNVVLNGNVTFKSYSPKFLEMQTVYSTAPKQCDGGKCLLQLVKTSRSTLPPLINAMEAYTVLDFPQIETNVDEVIAIKNIQSTYGLSKTTWQGDPCVPKKFLWDGLNCNNSDDSTPPIITSLNLSSSGLTGIIVLTIQNLANLQELDLSNNNLSGGVPEFLADMKSLLVINLSGNNLSGVVPQKLIEKKMLKLNIEGNPKLNCTVESCVNKDEEGGRQIKSMTIPIVASIGSVVAFTVALMIFCVVRKNNPSNDEAPTSCMLPADSRSSEPTIVTKNKKFTYAEVLTMTNNFQKILGKGGFGIVYYGSVNGTEQVAVKMLSHSSAQGYKQFKAEVELLLRVHHKNLVGLVGYCEEGDKLALIYEYMANGDLDEHMSGKRGGSILNWGTRLKIALEAAQGLEYLHNGCKPLMVHRDVKTTNILLNEHFDTKLADFGLSRSFPIEGETHVSTVVAGTIGYLDPEYYRTNWLTEKSDVYSFGVVLLVMITNQPVIDQNREKRHIAEWVGGMLTKGDIKSITDPNLLGDYNSGSVWKAVELAMSCMNPSSMTRPTMSQVVFELKECLASESSREVSMTFGTEVAPMAR

SEQ ID NO: 68806 - protein, 306 aa, Rhodococcus sp. RHA1
MCSDGWVHVPQSSESAPGHVGTDPRRLLEVAVAVAEEAAAHVRARRPEVFGIVGKLAGSGDSVASKSTPTDPVTVVDTESEQVIRDRLAELRPDDAILGEEGGGEEDSVAEVRWIVDPIDGTVNFLYGVPAYAVSVAAQIDGVSVAGAVVDVAARSTYAAARGGGATLTDADGRVSDLRCNPVTDVSMALLATGFGYGAARRKAQGALIADILPRVRDIRRIGSAALDLCMVAAGRVDAHFEHGLSPWDWAAGSLIATEAGARVRIPSPQTSSADGDVVVAAAPGIADALDALFAEIGVDAPIPEG

SEQ ID NO: 68807 - protein, 883 aa, Arabidopsis thaliana
MERHFVFIATYLLIFHLVQAQNQTGFISVDCGLSLLESPYDAPQTGLTYTSDADLVASGKTGRLAKEFEPLVDKPTLTLRYFPEGVRNCYNLNVTSDTNYLIKATFVYGNYDGLNVGPNFNLYLGPNLWTTVSSNDTIEEIILVTRSNSLQVCLVKTGISIPFINMLELRPMKKNMYVTQSGSLKYLFRGYISNSSTRIRFPDDVYDRKWYPLFDDSWTQVTTNLKVNTSITYELPQSVMAKAATPIKANDTLNITWTVEPPTTQFYSYVHIAEIQALRANETREFNVTLNGEYTFGPFSPIPLKTASIVDLSPGQCDGGRCILQVVKTLKSTLPPLLNAIEAFTVIDFPQMETNENDVAGIKNVQGTYGLSRISWQGDPCVPKQLLWDGLNCKNSDISTPPIITSLDLSSSGLTGIITQAIKNLTHLQILDLSDNNLTGEVPEFLADIKSLLVINLSGNNLSGSVPPSLLQKKGMNVEGNPHILCTTGSCVKKKEDGHKKKSVIVPVVASIASIAVLIGALVLFLILRKKRSPKVEGPPPSYMQASDGRLPRSSEPAIVTKNRRFSYSQVVIMTNNFQRILGKGGFGMVYHGFVNGTEQVAVKILSHSSSQGYKQFKAEVELLLRVHHKNLVGLVGYCDEGDNLALIYEYMANGDLKEHMSGTRNRFILNWGTRLKIVIESAQGLEYLHNGCKPPMVHRDVKTTNILLNEHFEAKLADFGLSRSFLIEGETHVSTVVAGTPGYLDPEYHRTNWLTEKSDVYSFGILLLEIITNRHVIDQSREKPHIGEWVGVMLTKGDIQSIMDPSLNEDYDSGSVWKAVELAMSCLNHSSARRPTMSQVVIELNECLASENARGGASRDMESKSSIEVSLTFGTEVSPNAR

SEQ ID NO: 68808 - protein, 94 aa, Potamogeton distinctus
MTSVSRSAMDQQMALAKRCSHEGIKAGVKAAVVATVASAIPTLASVRMLPWARTNLNPTAQALIVSTAAGMAYFIVADKTILATARKNSFGRSV

SEQ ID NO: 68809 - protein, 137 aa, Phaseolus vulgaris
MAQKAQKNDTDFKVPEPITPCATATAAAATSISEPSRFFDAATPATSSRSPKRSLPLEDAANADRTVASEPKRAVNRCSGCRRRVGLTGFRCRCGDLFCAEHRYTDRHDCSYDYKTVGREAIARENPVVKAAKIVKV

SEQ ID NO: 68810 - protein, 483 aa, Parvularcula bermudensis HTCC2503
MNQTVKTGDCCSVNKNGDDSYDLIVIGAGSAGFSASISAAEAGRRVAMVGHGTIGGTCVNVGCVPSKAMIRAGEAVHAGTAAARFPGIEPCAHSVDWSAVVKGTADLVDEMRQKKYIDLLPSYEYVTYIEEGAARLVEGGIEVGGRIIAAPKVLIATGSRPFLPEIDGIETVEALDSWDLLSLPDQPESILVLGGGYIGCELAQMASRLGVKVTLVTRSRLLPGVEPEVAKALTDALKAEGVAVETGLSYRSVRRSDGGVTLTIERGGKPVTLSAQRLVATTGRVANSEDLGLREFGIETDARGSIKVGADMATTRPGVWAAGDVTDRDQFVYMAAYGAKVAVNNALGLQDLRYDNAAMPWVVFTDPQVAGVGLSEVQAKAAGHDVKTSVLTLDHVARAAAARDTRGVIKLVADAKTDRLLGGQIAAPEGSDAIQTLAMALKFGMTSKALGETIFPYLTTVEGLKLAAQTFDKDVAKLSCCAG

SEQ ID NO: 68811 - protein, 138 aa, Microcystis aeruginosa NIES-98
ADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPDVTIQYGGSVKPDNIDEIMAQSQ

SEQ ID NO: 68812 - protein, 869 aa, Arabidopsis thaliana
MKSLHWFLHLLIIAFTVLRSVEAQNQAGFISLDCGLVPKETTYTEKSTNITYKSDVDYIDSGLVGKINDAYKTQFQQQVWAVRSFPVGQRNCYNVNLTANNKYLIRGTFVYGNYDGLNQFPSFDLHIGPNKWSSVKILGVTNTSMHEIIHVVPQDSLEVCLVKTGPTTPFISSLEVRPLNNESYLTQSGSLMLFARVYFPSSSSSFIRYDEDIHDRVWNSFTDDETVWISTDLPIDTSNSYDMPQSVMKTAAVPKNASEPWLLWWTLDENTAQSYVYMHFAEVQNLTANETREFNITYNGGLRWFSYLRPPNLSISTIFNPRAVSSSNGIFNFTFAMTGNSTLPPLLNALEIYTVVDILQLETNKDEVSAMMNIKETYGLSKKISWQGDPCAPQLYRWEGLNCSYPDSEGSRIISLNLNGSELTGSITSDISKLTLLTVLDLSNNDLSGDIPTFFAEMKSLKLINLSGNPNLNLTAIPDSLQQRSKKVPMVAIAASVAGVFALLVILAIFFVIKRKNVKAHKSPGPPPLVTPGIVKSETRSSNPSIITRERKITYPEVLKMTNNFERVLGKGGFGTVYHGNLDGAEVAVKMLSHSSAQGYKEFKAEVELLLRVHHRHLVGLVGYCDDGDNLALIYEYMANGDLRENMSGKRGGNVLTWENRMQIAVEAAQGLEYLHNGCRPPMVHRDVKTTNILLNERCGAKLADFGLSRSFPIDGECHVSTVVAGTPGYLDPEYYRTNWLSEKSDVYSFGVVLLEIVTNQPVIDKTRERPHINDWVGFMLTKGDIKSIVDPKLMGDYDTNGAWKIVELALACVNPSSNRRPTMAHVVMELNDCVALENARRQGSEEMYSMGSVDYSLSSTSDFAPGAR

SEQ ID NO: 68813 - protein, 449 aa, Parvularcula bermudensis HTCC2503
MKDAYDLIVIGGGTGGNGVARMAAKAGWNVASIDSLPYGGTCALRGCDPKKMLVAVTEGVDWADRMKGNGLKMQPSVDWPEMIAFKRTFTDAMPPRIEAGMEKAGIDVLHGEARFTGADSIELNGEILRAKHFHIATGARPITLNIPGEAYLTTSTEFLELTERPDRIAFVGGGFIAMEFAHIARRAGASEVTVLEMAERPLGTFDDDLVEILVEGTEELGIDLRTKAKVLAIEKQGEEFIVTVEGAGGAETLTCDLVVHGTGRVPNIDGLNLEAAGVEYTRRGIQVNASMRTSNPAVFAAGDCADSGPNLTPVSAFEGRVAGKNLLAGKDERQVKYPPIPSVVFTLPMVATVGLSEAAARKQGLKFDIHFEKTHDWYSSMRVGAKRTAYKVLVEQDTGKILGAHLIGPGAEEQINLFAMAMRAGQTANQIKAMIFAYPSYASDIGSMV

SEQ ID NO: 68814 - protein, 865 aa, Arabidopsis thaliana
MKSLHFCLLFMIVSFTVSRPVEAQDQAGFISLDCGLVPKETTYVETSTNITYKSDANYTDSGLVGKINDAHKTLVQQPLWALRSFPEGERNCYNFNLTVNSTYLIRGTFLYGNYDGLNQSPSFDLHIGASKWTSVNIVGVTDTVMPEIIHVLTQKRLQVCLVKTGKTTPFISSLELRPLINNIYIAESGSMVLQNRVYFPSDSTSIVRYDEDIHDRVWNPVSDDDSSSISTDLQVQTNNLYDVPQFVMKTAAIPKDASAPWSLVWTIDNTTALSYVYMHFAEIQDLKANDLREFDITYNGGKLWFSQFRPNKLSILTMFSQVPLTSSNGEYNFTFEMTSNSTLPPLINALEIYTGLEILQLQTDKDEVSAMMNIKTTYDLSKKISWQGDPCAPQLYRWEGLDCSYPDTEASRIISLNLNASGLNGTITSDITKLTQLSELNLSGNPKLNLTVPDSLQQRVNNKSLTLILGEKVKMNPTAKKESKKVPIVPIAASVAGVFALIVILAIFFIVKGKKGKSAEGPPLSVTSGTAKSETRSSNPSIMRKDRKITYPQVLKMTNNFERVLGKGGFGTVYHGNMEDAQVAVKMLSHSSAQGYKEFKAEVELLLRVHHRHLVGLVGYCDDGDNLALIYEYMANGDLRENMLGKRGGNVLTWENRMQIAVEAAQGLEYLHNGCTPPMVHRDVKTTNILLNAQCGAKLADFGLSRSFPIDGECHVSTVVAGTPGYLDPEYYRTNWLSEKSDVYSFGVVLLEIVTNQPVINQTRERPHINEWVGFMLSKGDIKSIVDPKLMGDYDTNGAWKIVELGLACVNPSSNLRPTMAHVVIELNECVAFENARRQGSEEMYTRSSTNFSHTSASEFSPGAR

SEQ ID NO: 68815 - protein, 389 aa, Legionella pneumophila subsp. pneumophila str. Philadelphia 1
MSLITSYSPMPVTFTHGEGVWLYDEQGKKYLDGLSGIAVCGLGHAHPDVTRTIQEQAARLIHTSNVFHIKEQELLAAKLTSMARMEQVFFANSGAEANEAAIKLTRLFGHKKGIETPSIIVMEKAFHGRTMATLTASGSRKVQAGFEPLVPGFIRAPFNDLDAIHTIAANREDVVAVMVEPIQGEGGIYPAEEGYLRALANLCEQNDWMLILDEIQTGNGRTGKLYSCMHYDIQPDILTTAKGLGNGMPIGACLMSKRAKDLFKPGNHGSTFGGNPLACATALTVLEVIERDKLCERVTKNSALLMDKLISNLGEHPHVKAIRGKGYMIGIELDRPANDMRVLGLENQVLFNITAETVVRLLPPLIISEDEIDELVNRITRTINQFTNQ

SEQ ID NO: 68816 - protein, 872 aa, Arabidopsis thaliana
MKSIHGFLLFLITAYVILESVQAQDQLGFISLDCGLVPKNATYTEKTTNITYKSDANYIDSGLVGRISAEYKAQLQQQTWTVRSFPEGERNCYNFNLTAKSRYLIRATFTYGNYDGLRQVPKFDIHIGPSKWTSVKLDGVGNGAVLEMIHVLTQDRLQICLVKTGKGIPFISSLELRPLNNNTYLTQSGSLIGFARVFFSATPTFIRYDEDIHDRVWVRQFGNGLKSISTDLLVDTSNPYDVPQAVAKTACVPSNASQPLIFDWTLDNITSQSYVYMHFAEIQTLKDNDIREFNITYNGGQNVYSYLRPEKFEISTLFDSKPLSSPDGSFSLSFTKTGNSTLPPLINGLEIYKVLDLLELETDQDEVSAMINIKATYDLSKKVSWQGDPCAPKSYQWEGLNCSYPNSDQPRIISLNLAENKLTGTITPEISKLTQLIELDLSKNDLSGEIPEFFADMKLLKLINLSGNLGLNSTIPDSIQQRLDSKSLILILSKTVTKTVTLKGKSKKVPMIPIVASVAGVFALLVILAIFFVVRRKNGESNKGTNPSIITKERRITYPEVLKMTNNFERVLGKGGFGTVYHGNLEDTQVAVKMLSHSSAQGYKEFKAEVELLLRVHHRNLVGLVGYCDDGDNLALIYEYMANGDLKENMSGKRGGNVLTWENRMQIAVEAAQGLEYLHNGCTPPMVHRDVKTTNILLNERYGAKLADFGLSRSFPVDGESHVSTVVAGTPGYLDPEYYRTNWLSEKSDVYSFGVVLLEIVTNQPVTDKTRERTHINEWVGSMLTKGDIKSILDPKLMGDYDTNGAWKIVELALACVNPSSNRRPTMAHVVTELNECVALENARRQGREEMHTSGYVDFSRSSASEFSPGAR

SEQ ID NO: 68817 - protein, 556 aa, Legionella pneumophila subsp. pneumophila str. Philadelphia 1
MAIKVTKRGMDILRDPILNKGTAFSLQERDEFALHGLIPTTVETLEQQVVRCLDAYSAKEDPLEKHIYLRALQDRNEVLFYRFIIDNLVHILPIIYTPVVGQACEMFSHIYRQPRGVFLSYPERDKLDSIIQNIASTRSTKVIVVTDGERILGLGDQGAGGLGIPIGKLSLYTSCGGIHPSNTLPIILDVGTNNKERLDDPEYIGWRHARISGKEYDDFVDQFVQSIKRHMPHVLLQFEDFAQQHAYPLLERYKNQLCTFNDDIQGTASVAVAAILAATRVTNTPLKEHRVALLGAGSAGCGISEQLVHAMMNQGLSEEEARSRFYLVDRYGLLHDEMTDLLPFQKGFVRSSTSLQNWKLEKKGEITLTDVINNAQPTILLGVSGQPNQFKEAMIKTMLSYCERPIIFPLSNPTSRAEAIPQDLLNWTAGKALIATGSPFEPVVINGHKIEIAQCNNSYIFPGVGLGVVAGQAKRVTDLMMMAAAVALSELAPAIRTGEGRLLPELNSIREVSQHIARAVILQGIKEGHIEPMNNNKIDDSIKRTMWTPQYEPYVL

SEQ ID NO: 68818 - protein, 137 aa, Geobacter metallireducens GS-15
MERTFAIIKPDAVERNIVGKVLEKIEAAGFRIVGMKKIQLSKKEAEGFYYVHSERPFFGDLCSFMSRSPVVVLALERENAIAKWREVMGATNPANADAGTIRKEFGLSIEENTVHGSDSPESAAFEIPYFFSQLELL

SEQ ID NO: 68819 - protein, 341 aa, Glycine max
MAHFTSSGKSDDLTKEDCKGQSALVVCFGEILIDFVPTVGGVSLAEAPAFKKAPGGAPANVAVGISRLGGSSAFVGKVGADEFGYMLADILKQNDVETSGMKFDPNARTALAFVTLRADGEREFLFFRNPSADMLLQESELDKNLIKKAKIFHYGSISLIDEPCKSAHLAAMRFAKESGCILSYDPNLRLALWPSAEAARDGIMSIWDQADVIKISEDEITFLTGGDDPYDDNVVLKKLFHPNLKLLIVTEGSEGCRYYTKEFKGRVAGVKVKPVDTTGAGDAFVSGIIYSLASDQSLFQNEEHLRKALHFANVCGAITVTERGAIPALPTKEAVLQFAAT

SEQ ID NO: 68820 - protein, 214 aa, Zea mays
MSEEDKTAASAEQPKRAPKLNERILSSLSRRSVAAHPWHDLEIGPDAPAVFNVVVEITKGSKVKYELDKKTGLIKVDRVLYSSVVYPHNYGFVPRTLCEDNDPLDVLVLMQEPVIPGSFLRARAIGLMPMIDQGEKDDKIIAVCADDPEYRHYNDISELSPHRLQEIKRFFEDYKKNENKEVAVDAFLPATTAREAIQYSMDLYAQYILQSLRQ

SEQ ID NO: 68821 - protein, 262 aa, Picea sitchensis
MADAAPAAGRGGFRGGFGSRGGDRGRGGLRGRGRGRGRGRGRGKEDQKEWVPVTKLGRLVRDGKIDKLESIYLFSLPIKEFEIIDFFLGSSLNDEVLKIMPVQKQTRAGQRTRFKAFVAIGDNNGHIGLGVKCSKEVATAIRGAIILAKLSVLPVRRGYWGNKIGKPHTVPCKVTGKCGSVTVRLIPAPRGTGIVSAPVPKKLLQMAGVQDCYTSARGSTGTLGNFAKATYAAIAKTYAYLTPDLWRDIPLTKSPYSEFKAL

SEQ ID NO: 68822 - protein, 438 aa, Xylella fastidiosa Dixon
MHANLQTRQIIIRLLSSMASAKEISQYLKRFSQLDAKRFAVVKVGGAVLRDDVDALTSSLSFLQEVGLTPIVLHGAGPQLDEELTAVGIQKKTVNGFRVTLPETMAIVRKVFHATNLQLIEALQRNGARATSITGGVFEAHYLDQETYGLVGGISAVNIAPIEASLRAASIPVIASLGETPSGQILNINADVAANELVHVLQPYKIIFLTGTGGLLDADGKIINSINLSTEYEQLIQQPWVYGGMKLKIEQIKHLLDRLPLESSVSITRPADLAKELFTHKGSGTLVRRGERVIRATTWKDLDLPRLQHLIQSSFRRTLIPHYFETTPLLRAYVSENYRAAVILTKLGNVPYLDKFAVLDDAQGEGLGRAVWSIMREETPQLFWRSRHNNQANAFYYAESDGYYKQDHWKIFWNGLHHFQQIQQCVAHCAQHPPTLID

SEQ ID NO: 68823 - protein, 440 aa, Saccharomyces cerevisiae
MLSCSVSFRDDKKLVIFSVKCNSQQYRPLRNARTNFFEPDWSPFLSSARLPIPVHPKKSTYINRLFTSKGSLFLVCPLSTVNNEQFFFFFLAIYPSTCTLVTMSTTASTPSSLRHLISIKDLSDEEFRILVQRAQHFKNVFKANKTNDFQSNHLKLLGRTIALIFTKRSTRTRISTEGAATFFGAQPMFLGKEDIQLGVNESFYDTTKVVSSMVSCIFARVNKHEDILAFCKDSSVPIINSLCDKFHPLQAICDLLTIIENFNISLDEVNKGINSKLKMAWIGDANNVINDMCIACLKFGISVSISTPPGIEMDSDIVDEAKKVAERNGATFELTHDSLKASTNANILVTDTFVSMGEEFAKQAKLKQFKGFQINQELVSVADPNYKFMHCLPRHQEEVSDDVFYGEHSIVFEEAENRLYAAMSAIDIFVNNKGNFKDLK

SEQ ID NO: 68824 - protein, 233 aa, Vitis vinifera
  misc_feature (229)..(229): Xaa can be any naturally occurring amino acid
MATKLVQPPVPASHVAPPIPRLTKMMRAHRPVSATHSGSRRRSVLGEFPSGSRPFYAIRVAEQSPGLVGDDQDIVVKEEEEEGASSDDRTIANVKADLYQAVQGINRGVFGVPSAKKSEIEALVKLLESQNPTPEPTLNLDKVNGWWKLVYSTITILGSKRTKLGLRNFITLGDFLQIIDVEERVDIKYDSSTITPDKIQMELGRLFLSIKIITMHATKRSKSIQPLDXAKGL

SEQ ID NO: 68825 - protein, 587 aa, Nostoc sp. PCC 7120
MSQPKNTQQSSTNPLNGENPGTGVVPQIFASSTEKFMFDSIDAALSDLKAGRAIVVVDDENRENEGDLICAAQFATPDMINFMAVEARGLICLAMTGDRLDELDLPLMVTNITDPNQTAFTVSIDASPHLGVSTGISAEDRARTIQITLNPATKPSDLRRPGHIFPLRAKAGGVLKRAGHTEAAVDLSRLAGLYPAGVICEIQNPDGSMARLQQLIEYAKHHNLKIISIADLISYRLQHDRLVYREVVTKLPSQFGQFDIYAYRHTLDNTEHVAIVKGNPENFRDEPVMVRMHSECLTGDALGSLRCDCRMQLQAALKMIETAGQGVVVYLRQEGRGIGLINKLKAYSLQDMGLDTVEANERLGFPADLRDYGMGAQMLMDLGVKKIRLITNNPRKIAGVKGYGLEVVDRLPLLIEANDYNSYYLATKAKKLGHMLLQTYLVTVAIHWQDDPQLVTKRYERLEKLRHLVRGYDLLLQEEARPLAIALFDKPSLTVHLGFDQEKVASCDWYSQSGHPYVQAILPILDNLATLPYVQKLEFLISPGSDPLSNLQVQLDRQTISPDKLPSSVSNELETQKIYSLSKELED

SEQ ID NO: 68826 - protein, 336 aa, Xylella fastidiosa Dixon
MALKNFLNTQDWSCSELNALLTQARAFKHNKLGNALKGKSIALVFFNPSMRTRSSFELGAFQLGGHAIVLQPGKDAWPIEFDTGTVMEAETEEHICEVARVLGHYVDLIGVRAFPKFLDWTYDRQDIVLNSFAKYSPVPVINMETITHPCQELAHIMALQEHFGTTDLRGKKYVLTWTYHPKPLNTAVANSALTIATRLGMDVTLLCPTPDYVLDERYIDWARQNIADTGSTFQVSHDIDNAYRGADVIYAKSWGALPFFGNWAMEKPIRDQYRHFIVDEAKMALTNNAVFSHCLPLRRNVKATDAVMDGSNCIAIHEAGNRLHVQKAVMAALASQ

SEQ ID NO: 68827 - protein, 421 aa, Xanthomonas oryzae pv. oryzae KACC10331
MPRRLPLQFSLARTSVGPVISTASALCCNRNLAGSASESQAARARPHVTQPAILVLEDGTVFEGESVGANGLSVGEVVFNTAMTGYQEVLTDPSYARQMVTLTYPHIGNTGFTDQDDEARKIWASGLIVRDVPRRPSNWRSQVALPEWLQARGVVAISGIDTRKLTRLLRQKGAQNGALMAGEIDVEKALDAARRFPGLKGMDLAKVVSTESTYNWQEGQLDLNADAFVRAGLKYKVVAFDYGVKLNILRMLAERGCDVTVVPAQTPVAEVLALQPDGVFLSNGPGDPEPCDYAIGAIKELIAQKVPTFGICLGHQLLALAAGARTLKMATGHHGANHPVQDLDGGRVMITSQNHGFAVDESTLPANVRVTHRSLFDGTNQGIALTDAPAFSFQGHPEASPGPRDVGPLFDRFVDLMAARA

SEQ ID NO: 68828 - protein, 305 aa, Haloarcula marismortui ATCC 43049
MVNVDEFIEEAKAEIAEEIGDKHAVIGLSGGVDSSTAAALAYEAIGDQLTAVYVDTGLMRKGETDEIRETFDYMDSLRIVEAQDRFLDELEGETDPEEKRHIIGEQFIREFETVAREVDADYLVQGTIYPDRIESEGTIKSHHNVGGLPERIDFDGIVEPMRDLYKDEVREVARALDLEEIISERMPFPGPGLAVRIIGEVTEEKLAVAREANHVVEEELEEYEPWQALAAVIGKATGVKGDNRVHGWVVAVRSVESRDGMTARAQELDWDTLQRMQSRITGAHENVARVVYDVTHKPPATIEYE

SEQ ID NO: 68829 - protein, 142 aa, Mycobacterium sp. MCS
MRIADVLRSKGSAVATITETTTVTGLLAELATHNIGAMVVVGQDGVVGMVSERDVVRRLHERGAELLRCPVSEIMTSVLVTCTPADPVDDLSALMTNNRVRHVPVLDNGRLAGIVSIGDVVKNRMEQLQTEQEQLQAYITRG

SEQ ID NO: 68830 - protein, 274 aa, Haloarcula marismortui ATCC 43049
MDDIQIQGTSVPALGLGTWQLTGQSCRETVETALGMGYRHIDTAQAYGNERQVGLGMDAAAVDREDVFLTTKLDGSNRDERSVRRSTRESLNKLGTDYLDLLLIHWPNTPWMASLSETLGAMNDVVEEGLVRHIGVSNFSPSLLDRARDISSAPIFTDQVQYHPYWDQRKLLDYCRIHDVLLTAYSPLARGGVLDDPALVQIGNKYGKSPAQVALRWLVQQDGVAAIPKASSREHLEANLAVFDFELTDAEMERIRDPSKVKTGVQFVRSQLPF

SEQ ID NO: 68831 - protein, 1061 aa, Bambusa oldhamii
MEGDAEAVKSGRHGSGQVCQICGDGVGTTAEGDVFAACDVCGFPVCRPCYEYERKDGTQACPQCKTKYKRHKGSPPIRGEEGDDTDADDASDFNYPASGNDDQKQKIADRMRSWRMNAGGGGDVGRPKYDSGEIGLTKYDSGEIPRGYIPSVTNSQISGEIPGASPDHHMMSPTGNIGKRVPFPYVNHSPNPSREFSGSIGNVAWKERVDGWKMKQDKGAIPMTNGTSIAPSEGRGVGDIDASTDYNMDDALLNDETRQPLSRKVPLPSSRINPYRMVIVLRLIVLSIFLHYRITNPVRNAYPLWLLSVICEIWFALSWILDQFPKWFPINRETYLDRLALRYDREGEPSQLAAVDIFVSTVDPMKEPPLVTANTVLSILAAFDALAETSEFARKWVPFVKKYNIEPRAPEWYFCQKIDYLKDKVHPSFVKDRRAMKREYEEFKVRVNGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPVKQKKKGGFLSSLCGGRKKTGKSKKKSSEKKKSNKHVDSSVPVFNLEDIEEGVEGAGFDDEKSLLMSQMSLEKRFGQSAAFVASTLMEYGGVPQSATPESLLKEAIHVISCGYEDKSEWGTEIGWIYGSVTEDILTGFKMHARGWRSIYCMPKRPAFKGSAPINLSDRLNQVLRWALGSVEILFSRHCPIWYGYGGRLKFLERFAYINTTIYPLTSIPLLIYCVLPAICLLTGKFIIPEISNFASIWFISLFISIFATGILEMRWSGVGIDEWWRNEQFWVIGGISAHLFAVFQGLLKVLAGIDTNFTVTSKASDEEGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 68832 - protein, 1067 aa, Bambusa oldhamii
QVCQICGDGVGTTAEGDVFAACDVCGFPVCRPCYEYERKDGTQACPQCKTKYKRHKGSSSPPIRGEGGDDTDADDASDFNYPASGNDDQKQKIADRMRSWRMNAGGGGDVGRPKYDSGEIGLTKFDSGEIPRGYIPSVTNSQISGEIPGASPDHHMMSPTGNIGKRVPFPYVNHSPNPSREFSGSIGNVAWKERVDGWKMKQDKGAIPMTNGTSIAPSEGRGVGDIDASTDYNMDDALLNDETRQPLSRKVPLPSSRINPYRMVIVLRLIVLSIFLHYRITNPVRNAYPLWLLSVICEIWFALSWILDQFPKWFPINRETYLDRLALRYDREGEPSQLAAVDIFVSTVDPMKEPPLVTANTVLSILAVDYPVDKVSCYVSDDGAAMLTFDALAETSEFARKWVPFVKKYNIEPRAPEWYFSQKIDYLKDKVHSSFVKDRRAMKREYEEFKVRINGLVAKAQKVPEEGWIMQDGTPWPGNNTRDHPGMIQVFLGHSGGLDTEGNELPRLVYVSREKRPGFQHHKKAGAMNALVRVSAVLTNGQYMLNLDCDHYINNSKALREAMCFLMDPNLGRSVCYVQFPQRFDGIDRNDRYANRNTVFFDINLRGLDGIQGPVYVGTGCVFNRTALYGYEPPVKQKKKGGFLSSLCGGRKKTSKSKKKSSDKKKSNKHVDSSVPVFNLEDIEEGVEGAGFDDEKSLLMSQMSLEKRFGQSAAFVASTLMEYGGVPQSATPESLLKEAIHVISCGYEDKSEWGTEIGWIYGSVTEDILTGFKMHARGWRSIYCMPKRPAFKGSAPINLSDRLNQVLRWALGSVEILFSRHCPIWYGYGGRLKFLERFSYINTTIYPLTSIPLLIYCVLPAICLLTGKFIIPEISNFASIWFISLFISIFATGILEMRWSGVGIDEWWRNEQFWVIGGISAHLFAVFQGLLKVLAGIDTNFTVTSKATDEEGDFAELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQTCGINC

SEQ ID NO: 68833 - protein, 279 aa, Brassica napus
  misc_feature (143)..(143): Xaa can be any naturally occurring amino acid
  misc_feature (212)..(212): Xaa can be any naturally occurring amino acid
MGGKGAMMVAMLCLWALSATTEAVVMEEEPGLMMNFYKDTCPQAEDIIREQVKLLYKRHKNTAFSWLRNIFHDCAVESCDASLLLDSTRRELGEKEHDRSFGLRNFRYIEEIKEALEREWPGVVSCSDILVWYAREGIEAVSXPNFMPNISLCANVHVFFWGGFMQCVYPDHVPHMLHKCPASTPDPKPVQYVRNARGTPMVLATTYSRNIXATKGLLLVDHQLAHDKRTRPIVKKMAKAQASFFKEFTRPIQILSETPPLPGSKGEIRKQCNLANKIH

SEQ ID NO: 68834 - protein, 879 aa, Arabidopsis thaliana
MKTMNGFLLLSTIAFAVFHLVQAQSQSGFISLDCGLIPKDTTYTEQITNITYISDADYIDSGLTERISDSYKSQLQQQTWTLRSFPEGQRNCYNFNLKANLKYLIRGTFVYGNYDGLNQMPKFDLHIGPNKWTSVILEGVANATIFEIIHVLTQDRLQVCLVKTGQTTPFISSLELRPLNNDTYVTQGGSLMSFARIYFPKTAYFLRYSDDLYDRVWVPFSQNETVSLSTNLPVDTSSNSYNVPQNVANSAIIPAEATHPLNIWWDLQNINAPSYVYMHFAEIQNLKANDIREFNITYNGGQVWESSIRPHNLSITTISSPTALNSSDGFFNFTFTMTTTSTLPPLINALEVYTLVENLLLETYQDEVSAMMNIKKTYGLSKKISWQGDPCSPQIYRWEGLNCLYLDSDQPLITSLNLRTSGLTGIITHDISNLIQLRELDLSDNDLSGEIPDFLADMKMLTLVNLKGNPKLNLTVPDSIKHRINNKSLKLIIDENQSSEKHGIKFPLVAILASVAGVIALLAIFTICVIFKREKQGSGEAPTRVNTEIRSSYQSIETKDRKFTYSEILKMTNNFERVLGKGGYGRVYYGKLDDTEVAVKMLFHSSAEQDYKHFKAEVELLLRVHHRHLVGLVGYCDDGDNFALIYEYMANGDLKENMSGNRSGHVLSWENRMQIAMEAAQGLEYLHNGSRPPMVHRDVKTTNILLNELYQAKLADFGLSRSSPVDGESYVSTIVAGTPGYLDPEYYRTNLLSEKTDVYSFGVVLLEIITNQPVIDTTREKAHITDWVGFKLMEGDIRNIIDPKLIKEFDTNGVWKAVELALSCVNPTSNHRPTMPHVVMELKECLDSEIARKQGSQDMFSRDSIELTFSPTGFSPGPR

SEQ ID NO: 68835 - protein, 404 aa, Nostoc sp. PCC 7120
MQFSQRLHPLQSNVFADMDKAKSLALAAGKELIDLSLGSSDLPAEAHVIEAIAKSLYDPSTHGYLLFNGTRDFRQAAANWYEQKFGVKVDPETEVLPLIGSQEGTAHLPLALLNPGDFALLLDPGYPSHAGGVYLASGQIYPMPLKAENDFLPVFADIPTDVLAQSRMMVLSYPHNPTAAIAPLSFFKEAVAFCQEHNIALVHDFPYVDMVFENAGNLNTNLPQSPIPNHQSLVPSILQADPDKSVSIEFFTLSKSYNMGGFRIGYAIGNAQMIQALRQIKAAVDFNQYRGILNGAIAALTGPQAGVEAAVSTFCQRRDAFINALHHIGWYVPTPKATMYIWAKLPSSWSQNSIEFCTQLVRQTGVAASPGAGFGKSGEGYVRFALVHEPSILKIAVERMSNFL

SEQ ID NO: 68836 - protein, 502 aa, Zea mays
MPEPGGRCLGDLGGQRQVLKGWPDLWLVGDKPGLRALSTAAMAAAPQPPPLEADQTLALPDVLLLRVLACLPEPQLTGAASLVCRRWTRLAGRLRRRLAVRDWAFVAHRLPYRFPDLADLDLFPASIAAPTTAVPHGAAASPLLTCGVVSLTLDTSADPPLGACRFIDDDALDRGLAAVAASFPNLSRLSATAASESGGLMAIAVGCPTLQELELHRCTDLALRPVSAFAHLQILRIVAASPALYGTAEGGGVTDIGLTILAHGCKRLVKLELQGCEGSYDGIAAVGRCCAMLEELTIADHRMDGGWLAALAFCGNLKTLRLQSCSRIDDDPGPAEHLGACLTLESLQLHRCQLRDRSALHALFLVCEGAREIQFQNCWGLEDDMFALAGLCRRVKILLLEGCSLLTTRGLESVITSWGDLQSLEVVTCNKIKDEEITPTLAELFSNLKELKWRPDNKSLLAASLVGTGMGKKGRVFFKRLILPAHQRIKGKVLNNSAGVAA

SEQ ID NO: 68837 - protein, 875 aa, Arabidopsis thaliana
MERHCVLVATFLLMLHIVHAQDQIGFISVDCGLAPRESPYNEAKTGLTYTSDDGLVNVGKPGRIAKEFEPLADKPTLTLRYFPEGVRNCYNLNVTSDTNYLIKATFVYGNYDGLNVGPNFDLYFGPNLWTTVSSNDTIKEIIHVTKTNSLQVCLIKTGISIPFINVLELRPMKKNMYVTQGESLNYLFRVYISNSSTRIRFPDDVYDRKWYPYFDNSWTQVTTTLDVNTSLTYELPQSVMAKAATPIKANDTLNITWTVEPPTTKFYSYMHFAELQTLRANDAREFNVTMNGIYTYGPYSPKPLKTETIYDKIPEQCDGGACLLQVVKTLKSTLPPLLNAIEAFTVIDFPQMETNGDDVDAIKNVQDTYGISRISWQGDPCVPKLFLWDGLNCNNSDNSTSPIITSLDLSSSGLTGSITQAIQNLTNLQELDLSDNNLTGEIPDFLGDIKSLLVINLSGNNLSGSVPPSLLQKKGMKLNVEGNPHLLCTADSCVKKGEDGHKKKSVIVPVVASIASIAVLIGALVLFFILRKKKSPKVEDGRSPRSSEPAIVTKNRRFTYSQVAIMTNNFQRILGKGGFGMVYHGFVNGTEQVAVKILSHSSSQGYKEFKAEVELLLRVHHKNLVGLVGYCDEGENMALIYEYMANGDLKEHMSGTRNRFTLNWGTRLKIVVESAQGLEYLHNGCKPPMVHRDVKTTNILLNEHFQAKLADFGLSRSFPIEGETHVSTVVAGTPGYLDPEYYKTNWLTEKSDVYSFGIVLLELITNRPVIDKSREKPHIAEWVGVMLTKGDINSIMDPNLNEDYDSGSVWKAVELAMSCLNPSSARRPTMSQVVIELNECIASENSRGGASRDMDSKSSIEVSLTFDTELSPTAR

SEQ ID NO: 68838 - protein, 542 aa, Shigella flexneri 2a str. 2457T
MIAVVKLLPTGEDFASHVYPCYTSHRKETIMTNNPPSAQIKPGEYGFPIKLKARYDNFIGGEWVAPADGEYYQNLTPVTGQLLCEVASSGKRDIDLALDAAHKVKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIVGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSVTQMGAQVSHGQLETILNYIDIGKKEGADVLTGGRRKLLEGELKDGYYLEPTILFGQNNMRVFQEEIFGPVLAVTTFKTMEEALELANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 68839 - protein, 581 aa, Arabidopsis thaliana
MSKQTYKVCFCFRRRFRYTASEAPREIKTIFEKYSENGVMTVDHLHRFLIDVQKQDKATREDAQSIINSASSLLHRNGLHLDAFFKYLFGDNNPPLALHKVHHDMDAPISHYFIFTGHNSYLTGNQLSSDCSEVPIIDALKKGVRVIELDIWPNSNKDDIDVLHGMTLTTPVGLIKCLKAIRAHAFDVSDYPVVVTLEDHLTPDLQSKVAEMVTEIFGEILFTPPVGESLKEFPSPNSLKRRIIISTKPPKEYKEGKDVEVVQKGKDLGDEEVWGREVPSFIQRNKSEAKDDLDGNDDDDDDDDEDKSKINAPPQYKHLIAIHAGKPKGGITECLKVDPDKVRRLSLSEEQLEKAAEKYAKQIVRFTQHNLLRIYPKGTRVTSSNYNPLVGWSHGAQMVAFNMQGYGRSLWLMQGMFRANGGCGYIKKPDLLLKSGSDSDIFDPKATLPVKTTLRVTVYMGEGWYFDFRHTHFDQYSPPDFYTRVGIAGVPGDTVMKKTKTLEDNWIPAWDEVFEFPLTVPELALLRLEVHEYDMSEKDDFGGQTCLPVWELSEGIRAFPLHSRKGEKYKSVKLLVKVEFV

SEQ ID NO: 68840 - protein, 97 aa, Potamogeton distinctus
QFSIMVPTASELFGLKHFGIIYNFMLLGNPLGAVLFSGFLAGYVYDTEAAKQHGEPNDTNSSCLGPDCFRLTFEVLAAVCVLGSILSTILTVRLRPV

SEQ ID NO: 68841 - protein, 138 aa, Microcystis wesenbergii NIES-104
SDMLTEIGVHYVVIGHSERRQYFGETDETVNLRVISAQKQGLIPIICVGESKAQRDAGETEKVIIKQIQGGLVNVDQNNLVIAYEPIWAIGTGETCESEEANRVIGLIRQQLDNPEVTIQYGGSVKPDNIDEIMAQSQ

SEQ ID NO: 68842 - protein, 634 aa, Burkholderia mallei ATCC 23344
MYDLLKTIDDPADLRRLDRRQLQPLADELRAFVLDSVSKTGGHLSSNLGTVELTIALHYVFNTPDDRIVWDVGHQTYPHKILTGRRDGMKTLRQFDGISGFPRRSESEYDTFGTAHSSTSISAALGMAIGSKLNGDDRFSIAVIGDGAMTAGMAFEAMNNAGVSEDAKLLVILNDNDMSISPPVGALNRHLARLMSGRFYAAARAGVERVLSVAPPVLELARKLEEHAKGMVVPATLFEEFGFNYIGPIDGHDLDSLIPTLQNIKELRGPQFLHVVTKKGQGYKLAEADPVLYHGPGKFNPAEGIKPSTTPAKKTYTQVFGEWLCDAAELDARVVGITPAMREGSGMVEFEKRFPERYYDVGIAEQHAVTFAGGLATEGLKPVVAIYSTFLQRAYDQLIHDVALQNLPVVFAIDRAGLVGADGATHAGAYDLAFLRCIPNMTVMAASDENECRQMLHTALQQPNPTAVRYPRGAGTGVATVKAFTEIPLGKGEVRRRTSQPDGKRIAILAFGTMVAPSLAAADALDATVANMRFVKPIDAELVQALARTHDYLVTVEEGCVMGGAGSACVEAMMESGAVRPVLQLGLPDRFVDHGDPAKLLSLCGLDGDGIAKSIRERFLSHAADVASPAKRVA

SEQ ID NO: 68843 - protein, 458 aa, Legionella pneumophila subsp. pneumophila str. Philadelphia 1
MSLGTVVEVIGAVVDVEFPRDSVPKVNDALKLVDSDLVFEVQQQLGDGVVRTIAMGTTDGLKRGLKAENTGHPIQVPVGKKTLGRIMDVLGRPVDDAGPIDAEETWAIHRKAPSYEEQAGSQELLETGIKVIDLLCPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLLFIDNIYRYTLAGVEVSALLGRMPSAVGYQPTLAEEMGMLQERITSTKTGSITSIQAVYVPADDLTDPSPATTFAHLDATVVLSRQIAELGIYPAVDPLDSTSRQLDPLIVGQEHYDTARRVQQTLQRYKELKDIIAILGMDELSEEDKRVVTRARKIQRFLSQPFFVAEVFTGSPGKYVSLKDTIKGFQGILAGEYDDLPEQAFYMVGSIEEAVAKAKTL

SEQ ID NO: 68844 - protein, 294 aa, Burkholderia mallei ATCC 23344
MTFDQWMRSVLERVETALGHYLPAGTVAPAQLHEAMRYAVLGGGKRVRPLLCHAAGELTGASEAARDAASAALEMIHVYSLVHDDMPCMDDDALRRGKPTVHVKYDEPTALLVGDALQSQAFVALTDAAALPADRQAALVRELALASGSIGMAGGQAIDLASVGVALTRDALEKMHRMKTGALLRASVRMGALAGETPSGDAMRALDAYAAAVGLAFQVVDDILDVTTDSATLGKTAGKDAANDKPTYVSIIGLDASRALAAQLRADAHAALEPFGARAQRLAELADLVVNRVS

SEQ ID NO: 68845 - protein, 123 aa, Thermococcus kodakarensis KOD1
MAKPSYVKFEVPQELAEKALEAVEIARDTGRIRKGTNETTKAVERGQAKLVIIAEDVDPEEIVAHLPPLCEEKEIPYVYVPSKKELGAAAGLEVPAASVAIIEPGKARELVEDIAMKVKELMK

SEQ ID NO: 68846 - protein, 429 aa, Nostoc sp. PCC 7120 [sequence omitted]

SEQ ID NO: 68847 - protein, 690 aa, Saccharophagus degradans 2-40
MSYQVLARKWRPRTFREMIGQEHVLRALINALDHGRLHHAYLFTGTRGVGKTSIARILAKCLNCETGVSSEPCGECSACVEISEGRFVDLIEVDAASRTKVEDTRELLDNVQYAPTRGRYKIYLIDEVHMLSNHSFNALLKTLEEPPEHVKFLLATTDPQKLPVTILSRCLQFNLKNMSPERIVGHLSHILEKEVIPFEESALWQLARSADGSMRDALSLTDQSISFGGGKVSEDEVASMLGTIDHKLVQNLVGALIAGDGSQILTSVAKFAEHAPDFDVALADLITLLHRIAIAQALPDALDNSYGDRTQILEFASKLAPEDVQLFYQTALIGRRDLSLSPDPRSGFEMTLLRMLAFKPQGVADVPTQRLQAQPASAPASSSDVASVAAPAAPTAQAAPQPSSNVEPAPAQAAPEQTEPSPPAQTSPPQQNVAPNTVEDNSPPADYYDNMPPYEEAQEPVKKPQAEPQQAQAEVPASEPAPLGPMHTVVTAAESTQAVAEPEVNTSAPAKTPADALREQVKAIVGKEGISAPPKPAQQLKNTPAAPINAAPVVTTPISLEELTPSHWVSVYNQLNVKGILQSTAANTVLIGREDNHLDFALDEQKSSLFDPSHSDRLSALLSDYFGVPIKAAIHLQNLPGDLETPAAYAIRIDQEKRVAAIQNMYDDPVVQTLQQQFNATLVEETVTYQ

SEQ ID NO: 68848 - protein, 492 aa, Ginkgo biloba
MRTNLIALGVSTLVEKNVGRIAQIIGPVLDVTFPPGNMPNIFNSLIVKGQDTAGQEIHVTCEVQQLLGNNRVRAVAMNATDGLMRGMKVIDTGAPLSVPVGGATLGRIFNVLGEPVDNLGPVDARTTSPIHRPAPAFTQLDTKLSIFETGIKVVDLLAPYRRGGKIGLFGGAGVGKTVLIMELINNIAKAHGGVSVFGGVGERTREGNDLYVEMKESGVINEQNISESKVALVYGQMNEPPGARMRVGLTALTMAEYSRDVNEQDVLLFIDNIFRFVQAGSEVSALLGRMPSAVGYQPTLSTEMGSLQERITSTKEGSITSIQAVYVPADDLTDPAPATTFAHLDATTVLSRGLASKGIYPAVDPLDSTSTMLQPWIVGEEHYETAQGVKQTSQRYKELQDIIAILGLDELSEEDRLTVARARKIERFLSQPFFVAEVFTGSPGKYVSLVETIRGFKMILSGELDGLPEQAFYLVGNIDEATAKAMNFKVES

SEQ ID NO: 68849 - protein, 306 aa, Anabaena variabilis ATCC 29413
MAALLGRDLLSLADLTPTELQELLQLATQLKSQQLKLRCNKVLGLLFSKASTRTRVSFTVAMYQLGGQVIDLNPNVTQVSRGEPVQDTARVLERYLDVLAIRTFEQQELATFAEYAKIPVINALTDLEHPCQILADLLTAQECFDTISGLTLTYVGDGNNVANSLMLGCALAGMNVRIATPSGYEPNPQVVAQAQAIADGKTEILLTNDPELATKGASVLYTDVWASMGQEAEANDRFPIFQPYQISEKLLSLAEPNAIVLHCLPAHRGEEITEEVIEGSQSRVWQQAENRLHVQKALLASILGAE

SEQ ID NO: 68850 - protein, 330 aa, Shewanella sp. MR-4
MQTLAQHLTSKAVNESLSQLILTLADTSKAISHAVRHGALAGVLGATEQENVQGETQKKLDIITNDMLKDALKVDGTVRGLASEEEDHVVEVSANGKYLVCFDPLDGSSNIDINSLVGTIFSVLPAPAGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGIDYSEEPTLD

SEQ ID NO: 68851 - protein, 438 aa, uncultured archaeon GZfos27G5
MEEEKRKAGEKRLSAINKHEPEKVASEYHSYYRGKIEIGLKAPVRSYDDFAIWYTPGVAEPSREIKNSRERVFEYTNKGNSVAIVTDGTRVLGLGDVGAEAALPVMEGKAMLFKYLGGVDAFPLCLDTSDAEDIINTVKWVAPTFGGVNLEDIESPKCYYILQRLQDELGMPVWHDDQQGTALVILAGVINALKVVGKRLSEIAISLVGAGAANMNVAKYLCLAGAKEGNMVMVDSKGILNRERMEDEKRDENKRDMCEKTNKEGRKGGIKEAMRDTDLCIALSTPGPGVIKKEWVADMADDAIVFACANPVPEIWPVEAEEGGARIVATGRSDFNNQVNNSLGFPAVFRGALDVRAARITDEMCIAAANAIARYTEEEGKGKEKGISESRIIPRMEESEMYVCEAVAVGMKAIEQGVAEKGMSMKALEERIREKISD

SEQ ID NO: 68852 - protein, 484 aa, Polaromonas sp. JS666
MGAADATAFFNFSGLKQAALGGGARDVIEPATGQVLCTVGIADAADVAAATATAAAAQKAWVAVPPREKAEIFRRAAALFQQHGDELALYAARETGGILAKGQHEIREAALICNLAASIPLQSQGHVLPSVPGRTSIARRVPHGIVGVISPFNFPMILTIRSVAPALAAGNAVVVKPDSRTPVTGGLMIARIFAQAGLPKDLLQVLPGDAEAGEALVIDPLVPMIAFTGSPAVGRRIGELAGRHLKKVSLELGGANSLIILDDADLDVAASNAAWGAYFHQGQICMASNRILVHESMAAELTRRLIAKATHLPMGNGASGQVALGPLIDARQRDRVHALVQDSVKAGAKLEAGGVFDGLFYKPTVLTGVKAGMRVYDEETFGPVANIITYKTDAEAIALANNNTGSLSSAVISRSVGRAMAVGQQLKSGMVHINDQTVNDDCVNPFGGPGIAGNGTSVGGPADFEEYTMWQWMTIKDTAPNYPF

SEQ ID NO: 68853 - protein, 273 aa, Picea sitchensis
MVKLDSGRLLEVLNVRVTGSGERVVVLSHGFGGDQSMWKDILPYLVPDFKVIVFDLVFAGSVDPKHFDFDQSSNSLAAYADDILAILEELKIDRCMYVGHSVSGMLGCLASIKRPELFERLILLGASPRYLNDESYEGGSERGEIDGILSTIKSNYSAWVSGFVPLLIGVDQPSIVDDLSRKWLSIKPEIAFPVAKSIFECDLRSILTDVKTPCSIIQTRKDVVVPSSVPYYMQRNLGGENNSVHILDIDGHLPQLTSTHLLAKLLTQLLAGS

SEQ ID NO: 68854 - protein, 1080 aa, Bambusa oldhamii
MDGGGGDAAKSGKHGGGQVCQICGDSVGTTADGELFTACDVCGFPVCRPCYEYERKDGTQACPQCKTKYKRHKGSPPIRGEESEDVDADDASDFNYPAPGNQDHKHKIAERMLTWRMNSGASDDVGHTKYDSGEIGHPKYDSGEIPRGYIPSLTHSQISGEIPGASPDHLMSPVGNIGKRGHPFPYVNHSPNPSREFSGSLGNVAWKERVDGWKMKQDKGAIPMTNGTSIAPSEGRGIGDIDASTDYNMEDALLNDETRQPLSRKVPIPSSRINPYRMVIVLRLIVLCIFLHYRITNPVRNAYPLWLLSVICEIWFALSWILDQFPKWSPINRETYLDRLALRYDQEGEPSQLAAVDIFVSTVDPMKEPPLVTANTVLSILAVDYPVDKVSCYVSDDGAAMLTFDALAETSEFARKWVPFCKKYSIEPRAPEWYFAQKIDYLKDKVLPSFVKDRRAMKREYEEFKVRVNGLVAKAQKVPEEGWIMQDGTPWPGNNTRDHPGMIQVFLGHSGGLDTEGNELPRLVYVSREKRPGFQHHKKAGAMNALVRVSAVLTNGQYLLNLDCDHYINNSKALREAMCFLMDPNLGRSVCYVQFPQRFDGIDRNDRYANRNTVFFDINLRGLDGIQGPVYVGTGCVFNRTALYGYEPPIKKKKLGFFSWLCGGKKRTTKSKKKSSEKKSHKHVDSSVPVFNLEDIEEGVEGAGFDDEKSLLMSQMSLEKRFGQSSVFVASTLMEYGGVPQSATPESLLKEAIHVISCGYEDKSDWGTEIGWIYGSVTEDILTGFKMHARGWRSIYCMPKRPAFKGSAPINLSDRLNQVLRWALGSVEILFSRHCPIWYGYGGRLKFLERFAYINTTIYPLTSLPLLLYCILPAICLLTGKFIIPEISNFASIWFISLFLSIFATGILEMRWSGVGIDEWWRNEQFWVIGGISAHLFAVFQGLLKVLAGIDTSFTVTSKASDEEGDFTELYMFKWTTLLIPPTTILIINLVGVVAGISYAINSGYQSWGPLFGKLFFAFWVIVHLYPFLKGLMGRQNRTPTIVVVWAILLASIFSLLWVRIDPFTTRVTGPDTQKCGINC

SEQ ID NO: 68855 - protein, 451 aa, Shewanella sp. MR-4
MSLVVAKFGGTSVADYGAMNRCADIVLGNPDCRLVVVSASSGVTNLLVELTQESMNDDGRLQRLKQIAQIQYAILDKLGRPNDVAAALDKLLSRMAVLSEALASQRSKATMDELLSLGEQCSSALFAAVLREKGANSSAFDVRRVLRTDSHFGRAEPQVEQIAILSREHLLPLLSEQVIVTQGFIGSDEAGQTTTLGRGGSDYSAALLAEALKASAVEIWTDVAGIYTTDPRLAPNAHPIAEISFNEAAEMATFGAKVLHPATILPAVRQQIQVFVGSSKEPEKGGTWIRHQVEDAPVFRAVALRRDQTLLNLHSLQMLHAQGFLAETFATLARHKISVDLITTSEVNVSLTLDKTGSDSSGQGLLSEALLQELSQHCRVRVEDGLALVAIIGNRIATTAGICRRVFEVLEPHNVRMICQGASPHNLCVLVAESEAAQVVKALHENLFEGA

SEQ ID NO: 68856 - protein, 231 aa, Oryza sativa
  misc_feature (222)..(222): Xaa can be any naturally occurring amino acid
MSAAPIPREWVGLQQFPAATQTKLHELLGKLKEENVSTLTILVMGKGGVGKSSTVNSIVGERVATVSAFQSEGLRPMMCSRTRAGFTLNIIDTPGLIEGGYINEQAVEIIKRFLLGKTIDVLLYVDRLDAYRMDTLDDQVIRAVTNSFGKAIWRRTLVVLTHAQLSPPDGLDYNDFFTKRSESLLRYIRAGAGVSKRELGVMYTSLVFYMGIIGISRFFFFXCNLSAASSV

SEQ ID NO: 68857 - protein, 314 aa, Vitis vinifera
MLIDFVPTVGGVSLSESPAFKKAPGGAPANVAVGISRLGGSSAFIGKVGEDEFGFMLADILKQNNVDSSGMRFDRNARTALAFVTLRDDGEREFMFFRNPSADMLLRESELDANLIKKASIFHYGSISLIEEPCKSAHLAAMNIARKSGSILSYDPNLRLPLWPSPETARKTIMSIWNQADLIKISEEEITFLTGGDDPNDDNVVLKKLYHSNLKLLVVTEGSNGCRYYTKEFKGRVTGVKVKAVDTTGAGDAFVGGILNSLAADLNLYKNEEKLREALLFANACGAITVTERGAIPALPTKEAVLQILPKANA

SEQ ID NO: 68858 - protein, 154 aa, Triticum aestivum
MAQRDHKQEEPTELRAPEITLCANSCGFPGNPATHNLCQNCFLAGPASTSPSSSSSSSLPGVSVSTPVVDRPRPAPVEVELAVDLAPARTSVNRCSSCRKRVGLTGFRCRCGDMFCGEHRYSDRHGCSYDYKAAARDAIARDNPVVRAAKIVRF

SEQ ID NO: 68859 - protein, 525 aa, Bambusa oldhamii
MEEGRSDLKEASRLERALSAESGGGGGDSGSDSGRKKFMRLLRLFFACMVSGGIQYGWALQLSLLSPYSQTLGISHTYVSLTWICGPISGFVVQPIVGYYSDRCTMRIGRRRPFILAGCLVICISVMLIGFSADIGRRLGDTKEHCSTYTGPRWSAAIVYIAGFWFLDFANNTVQGPARAMMADISAGHHGPSVGQAIFSLWMAIGSILGYLAGANAKWHEWFPSLKTAACCDACANLKGAFFTAVALIVISMTVTMLLADEKPLYKVDVDTSSGGGWSAFGDLFKSFKNLSPAMFKVLAVTAITWLSWFPFFQYNTDWMGREIYHGDPHGKGVKADSYNAGVREGAVGLLLCSISLGVTSFLIPKLCRKLTSKVVWSISNFLVFIIMTVMVVVGMVSMKGYRPSLSATLTGSDPTLKAIALTIFALIGVPQAVLFSVPWVVASEVAAEEGGGQGLTVGVLNIAIVVPQLIIALTAGPIDGAFNKGNTPAFGIGGAFAFICAVLALFLLPKTRGISHAAVVASGH

SEQ ID NO: 68860 - protein, 131 aa, Corynebacterium efficiens YS-314
MTTVADRIELTGLECFGHHGVFDFEKEQGQPFIVDVTCWMDFAAAGASDDLSDTVDYGALAQLVAEIVEGPARDLIETVATETAEKIMDTFGALHAVEVTIHKPKAPIRRTFADVAVVARRSRKAHGRSTR

SEQ ID NO: 68861 - protein, 110 aa, Glycine max
  misc_feature (86)..(86): Xaa can be any naturally occurring amino acid
MASSMIWDRAVTTVNRAGAGMVAPFTGLKSMAGFPTRKTNNDITYIASNGGRVQCMHVWPPIGKRKSRLFSTWQNLVNPNLPKEVXFLLRKGWIPCLEFELEHGFLYRGP

SEQ ID NO: 68862 - protein, 436 aa, Burkholderia mallei ATCC 23344
MKAAGDPLRLLARRAHPRRIQGPIIEAPLPEVAIGELCAIRAAAGSDTTIGRAQVVGFGRDTAILSTLGSTAGLSRQVALVPTGERMTIDVSPALLGAVVDATGGIVETFGAPPPPAGAAPGRRAIDAAPPDYAARRPIERRLATGVRAIDGLLACGVGQRFGIFAAAGCGKTSLMNMMIEHAAADVYVVALIGERGREVSEFVERMRRSGSRDRTVVVYATSDRSSVDRCNAALVATTIAEYFRDLGCDVMLFLDSMTRYARALRDLALATGEAPARRGYPASVFEQLPRLLERPGRTRAGSITAFYTVLLENEEEPDPIGDEIRSIVDGHVYLSRQLGAKGHFPAIDVLRSASRLFDEIADAPHRALAKRFRQHLARIDEMQVFLDLGEYRRGENPENDDALDRRPALDAFLQQAVDEASAFGDTLERLSEAAS

SEQ ID NO: 68863 - protein, 147 aa, Medicago sativa
MPIRNIAVGTPQEATHPDTLKAGLAEFISTFIFVFAGSGSGIAYNKLTNDGAATPAGLISASIAHAFALFVAVSVGANISGGHVNPAVFGAFVGGNITLLRGIVYIIAQLLGSIVCSALLSLLPLRLFQHSDYQRVLELDQLWCWRL

SEQ ID NO: 68864 - protein, 334 aa, Picrophilus torridus DSM 9790
MKAAFLKKLNSELEIDDIEEPEPGDDEVVIEQRYTGICYRDILTMQGFQPRVNIPVIPGHEISGRIIKKGKNVESFNINERVSSLIYIPCGKCEFCLSGNENLCVNKRIFGESVNGAYRKYINVNMNSLVHVPDNVPEESSVIAACVTGMIIHALRLGNISEKKTVLITGAGGGVGMHAIEIAKTYGATVIAETTSEWKKKAIYEAGADYVVSGSYSKDVKNYGGADIVLEIVGKDTFNESLRSLKTGGSLVLIGNVRPASAEMPIGLIIMKGNRIIGSLSSTRKDVSEALQLSSEKRISPRIFDKVSLNDVNRAFDDMINKRNNGRILIDLNK

SEQ ID NO: 68865 - protein, 256 aa, Burkholderia mallei ATCC 23344
MSAPNLFDLSGKIAVVTGGSRGIGAEVAKLLGAFGAHVVVTSRRLDDCRAIADEIVAAGGSAEAAACHIGELEQIDALYASLEGRHGRLDVLVNNAATNPYYGPIVDTDLGAFQKTVDVNIRGYFFMSSRGAKLMGKNGGGSIVNVASVNGVIPGYWQGIYSITKAAVISMTKAFAIECAASGVRCNALLPGLTDTKFASALTQTPEVLKQVLAHVPMRRAAQPTEMAGAVLYLASAASSYTTGTVLNVDGGYLSV

SEQ ID NO: 68866 - protein, 603 aa, Xylella fastidiosa Dixon
MSLFPRCFLLLCVFFSHVSAEQREVGLLREGVARVPPGAVIASSHYLATDAGLQILKQGGNAFDAAVAVSSTLSVVEPISSGLGGGGFFLLHDAKTGRDVMLDAREYAPASVNLGTFLNKDGQLDHDRSINGPWSAGIPGLPAALVELAEHYGKLPLRQTLAPAIRIASAGFPVYRRMVEGYQSRREVMERYPGTREVYLRGGKPMDEGDIFKQPELARTLLLLANKGFDGFYKGETAQRLLAGVNRAGGRWTAEDLAGYRVKSRVPITFDYRGWKITTAPPPSSGGIALAEMLQILEGWDLNRLDDVHRVHLVVEAMRRAYRDRTFFLGDPDFVSIPQRVLTSKDYACGLRAGINPEKATPSVLLSGHPTPLEDEETTHFSIIDAEGNRVGATQTVNLLYGSGLIPKGTGVLLNNEMDDFALQPGVPNVFGVMGYEANAPKPGKRMLSSMTPTFLESADKVAVIGTPGGSRIITMVLLGILGYDAGLDAQQVAALPRYHHQWLPDVIETEAATFPAEVIKGLETMGHTIKQPSDTVAGGRGSSHVWGNVQTVEWDRRSNVLIGGHDPRHVVGKAVVWLTDKAVVLPPMDHLPTPCLQDCHAQ

SEQ ID NO: 68867 - protein, 118 aa, Oryza sativa
MAQDLRSQEIKNPIDIAEYLFRRLQQVGVESIHGVPGDYNLVALDYIPKVGLKWVGNCNELNAGYAADGYARVKGISALVTTFGVGELSAVNAIAGAYSEYVPIVHIVGYPSTVSQKN

SEQ ID NO: 68868 - protein, 390 aa, Candidatus Kuenenia stuttgartiensis
MRIYEFQAKDILKTYSICVPRGRVVSAADDARTAYKEIGGGKCVVKAQILAGGRGKSGGVRFVNSSEEAESCISGMLGSRLTTYQTNQESFEIKHVLLEEAVSIQKEFYLAITIDRSLQSLLLIVSAEGGVAIEDVAKKTPEKIFKEPVDLFFGLLPFQLRRITEKLMISAKLSEKVNELIKKLFSVFINKDCLLLEINPLVLTENNELVVLDAKMELDDNAIFRHPELEYILAEQDIPPDEALAKKHGLSYIHLDGDIGCLVNGAGLAMATMDSIKLCGGEPANFLDVGGDASLEQVTRAFKIILSDRKVKAVLINIFGGIMKCDVIAEGIIRVVKEADIPFIVRLEGTNVDLARKILDDSGLKIISVGNMKDAARFAVKASKGEYINQ

SEQ ID NO: 68869 - protein, 498 aa, Typha latifolia
MRINPTTSSPGGSTLEEKNLGRIAQIIGPVLDAVFPPGKMPNIYNALVVKGRDTLGQQINVTCEVQQLLGNNRVRAVAMSATDGLMRGMEVIDTGAPLSVPVGGTTLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNLAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKETLQRYKELQDIIAILGLDELSEEDRLTVARARKIERFLSQPFFVAEVFTGSPGKYVGLAETIRGFQLILSGELDSLPEQAFYLVGNIDEATAKAMNLEVESKLKK

SEQ ID NO: 68870 - protein, 166 aa, Glycine max
  misc_feature (162)..(162): Xaa can be any naturally occurring amino acid
MNALAATNRNFKLASRLLGLDSKLEKSLLIPFREIKVECTIPKDDGTLQSYVGFRVQHDNARGPMKGGIRYHPEVDPDEVNALAQLMTWKTAVANIPYGGAKGGIGCDPAELSISELERLTRVFTQKIHDLIGTHTDVPAPDMGTGPQTMAWILDEYSKFHXYSPA

SEQ ID NO: 68871 - protein, 339 aa, Vibrio sp. Ex25
MEVISKTETEVKCKVLNNGALGENKGVNLPGVSVNLPALSEKDKNDLKFGCEQGVDFVAASFIRKASDVQEIREVLAANGGENIHIISKIENQEGVDNFDEILELSDGIMVARGDLGVEIPAEEVIFAQKMMIEKCNRARKMVITATQMLDSMINNPRPTRAEAGDVANAVMDGTDAVMLSGETAKGKYPVEAVTIMAQIANRTDSALKAELGSRLDSPRLRITEAVCKGAVDTAEKLAAPLIVVATEGGKSARSVRKYFPTANILALTTNKKTAAQLVLTKGVTPVVVDSIESTDAFYVAGKELALESGLGNKGDIVVMVSGALVASGTTNTASVHVL

SEQ ID NO: 68872 - protein, 319 aa, Polaromonas sp. JS666
MTTSPVRTTLDATPLDPAFAGFLAQAAAQGAPPLEALPPPIARQVYRDLANALGLPAPAIGKVEDKSIPGPGGVLPLRAYSPTTQGPWPVLLYVHGGGFVMGDLQTHDEVCRTLCHLTGMLVVAVDYRLAPEHPFPAAPDDAEAALRWICVHADTLGGDPHRIAVAGDSAGAQLALVAVRRVQSPAVRALGLIYPVAQHPDEPSPSYQENEGKFLTKGVMQWFTASYLGGPSPTPPDHPDVALLKSELAALPATWVATMGHDPLRDEGHALALRAEAAGVLVAHQHYPSAIHACIHFSAVSPIGPQVLADLAQWLREQA

SEQ ID NO: 68873 - protein, 764 aa, Xylella fastidiosa Dixon
MSNDTFKQAAIDYHRTQPAGKIKVVATKPMLTQRDLSLAYSPGVAFACQAIVENPQQASELTARGNLVAVISNGTAVLGLGNIGPLAGKPVMEGKGVLFQKFAGIDVFDIEIDESDPDKLVDIIASLEPTFGGVNLEDIKAPECFIVERKLRERMSIPVFHDDQHGTAIIVGAAVLNAMVITGKKIGEVKLATTGMGAAGVSCVNMLVSLGLNPDNILAYDREGVIHTGRTDLDPEKQRYARDTDKRTLAEIVEGADIFLGLSAAGILTPEMVVTMAPDPVIFALANPIPEIMPEAVCAVRTDAIIGTGRSDYPNQINNVLCFPYLFRGALDVGATTINEEMKIACVKAIAALARCEASDLGAAYGGETPSFGREYLIPRPLDPRLLVELSSAVAQAAMDSGVATRPITDMSAYHDKLSQFVYRTSLMMKPVYDRARADKQRVVYAEGEEEVILRAVQNVIDEGLAFPILIGRPDVIESRIQRMGLRMKVGVDFEVTNIHDDPRFNDYWQYYHGVTERRGVTVSAAKELMRSRPTLIASVMVARGEADALLTGAVGRFHKRLGYARSVIPLEPRVSSTAAMTGVINQHGAFFFVDTHVQEDPSAEQIAEATLQACYRLKLFGIEPSVALLSHSNFGSHDSRDALKMRQVRELLLKRSPRLNIDGEMQADTAWDEVLRERIMPNTTLKGRANLFVFPNLEAANIAYNLVRVFTDGVAIGPILMGISKAVHILTSSTTSRRVMNMTAIAAVDAQIRKQFEGGKRGG

SEQ ID NO: 68874 - protein, 164 aa, Glycine max
  misc_feature (67)..(67): Xaa can be any naturally occurring amino acid
  misc_feature (85)..(85): Xaa can be any naturally occurring amino acid
ASSMISSPAVTTVNRAGAGMVAPFTGLKSMAGFPTRKTNDGITSIASNGGTVHCVQVWPPFGKKKFXTLSYLPDLNDAQLANDVXYLLRKGWIPCLESDLDHGFMYREHNRSPSYYDGRYWTMWNLPMFGCADASHVSNELQDVYTAYPLGSIPFTLVDDARQI

SEQ ID NO: 68875 - protein, 534 aa, Candida albicans SC5314
MASRDLPHSLNDLAFGWAKHLKEEIIINKNSQQLVDEDFQPDEDVTKETKVKLNNLWPAFASGAGLFADGYVNNSIGIVMACLKILYGDEFTKSNAISNIGSIGFVGTVVGQLSFGYISDRVARKGGMMTANIMLIAFTLLCAVGSWGTTIQGFFACLTVWRFCLGVAIGAEYPTSSVIASEFANQLPAGKRNRYFIWFTGFMIDFGFVVSAFVPFVLLWIFTEKHLRALWRVSIGLGAILPTALFFIRLKMKDSTSFEKLHMKNVRYRDYPWWLIVKFYWFRLTIVSMIWFIYNFSVYSFGTFNAIILGQIIPDAPLWQQWGWSVVFNLFYIPGSFLGAFSADYLGPRLTLAIGVGLQGIIGFIMSACLNGLRKQVAAFTVVFGIFATLGEFGPGGNIGLLASKTSATPIRGQYYGIAAAMGKIGAFVGTWIFPAIQRRYASKTNPDLELQVPFYLSSGLCIFSALLTFFLCPHVGQDAINREDKEFVEYLRKNGFDVSKLGEDSSSVDVDVVKDTDSAEKISETIEVGQKLA

SEQ ID NO: 68876 - protein, 234 aa, Oryza sativa Japonica Group
MAQPQPQRMEDQLQSQAQGQGQGQTEAIKYGHVFAVTGELAGQPIAPRDAAAMRSAEESASDAATNQGIAVTQTSVPGGRIITEFVAGQVVGQYSVADQAVEQDATKITVGEALEATALAAGERPVDRTDVEAIRAAEMAAQGSDVTMPGGLADQGQAAARSKADADRDDDKITDATAKLAGDKVAGAEDAAKVVQAETYSDAAARTRAGGVGAAVSTAARLNQADDDADDDAE

SEQ ID NO: 68877 - protein, 501 aa, Xanthomonas oryzae pv. oryzae KACC10331
MAGGALRRRPMAATPWTLLCMFPGEPMSSASIDGAPDAGENTRFIILISCVATIGGFLFGFDSGVINGTVDGLKQTFQSTAAETGFEVASMLLGCAIGAFFAGRLADRSGRRAVLIISAALFLLSAIGAGASHSSGFFIFARVMGGFAVGAASVISPAYIAEVASARYRGRLATMQQIAIISGLFCAFLSNYLLANAAGASTEPLWAGQAAWRWMFWMQAVPSLLFLLLLLVIPESPRYLVVKGRREQALVVLKRLYGNAAAQTKLGEISASMSADRHKPKFSDLINQATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDLNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKCVYETKGKELEQMEG

SEQ ID NO: 68878 - protein, 373 aa, Haloarcula marismortui ATCC 43049
MTAFSRRVEQVSISGIREVFEAAGEDAINLGLGQPDFPTPEHAREAAVEAIQAGKVDAYTSNKGTEELREAIAAKHERDNDLEVDPGDIIATSGGSEALHIALEAHVDAGQEVIFPDPGFVSYDALTHLAGGTPRPVPLREDLTMAPETVEEAITDDTAAFVVNSPANPTGAVQSPEDMREFARIADEHDVLCISDEVYEHQVFEGEHRSPAEFSETGNVVIVNACSKAYSMTGWRLGWVTGATDRIERMLRVHQYAQACASAPAQYAAEAALTGPQEPVAEMREAFKERRDVLLDGLNEMGLDCPTPKGAFYAMPKVPDGWVDEVIDRGVVVVPGDAFGEHGAGYARISYATDMETLEEAIDIMADATAALR

SEQ ID NO: 68879 - protein, 495 aa, Mycobacterium avium 104
MVTDRFDAIIVGAGFGGIGAAIQLKRLGFDNIVILDREDDLGGTWHVNHYPGIAVDIPSTTYSYWFEPNPGWSRLFAPGGEVKQYAADVADKYDVRRHMRFNTTVEGAQWDEDAEVWRVALAGGESLTTRFLITATGFLSQPHTPDIPGIGSFGGKVVHTTAWDHDYRYQGRRIAVIGTGASAVQVVPELAKEAEELTVYQRTATHVLPKVDFEFDPAVRRLFARVPAAQRALRWVTDVLLEIIMIVGALHFKESRGRGNISASDLAKINRFRWIRDKELRAKLTPDYDCGCKRPTFSNSFYRVLTQPNVHLETNPIERIEPDGIVTADGRKNVIDTLVLATGFDLWEANFPAIEVIGRKGRNLGKWWRETRFQAYQGVSMPYFPNYLSLASPFAFSGLSFFHTIEYQMRHMDRLLGEVKRRGATTFEVTEEANDRFMERMTKLLDNSVFYAGNCATSRSYYFSPSGEASLLRPTSTLNSIREASSFPLSDYVIA

SEQ ID NO: 68880 - protein, 355 aa, Craterostigma plantagineum
MEKYELVKDIGSGNFGVARLMRNKETKELVAMKYIERGHKIDENVAREIINHRSLRHPNIIRFKEVVLTPTHLAIVMEYAAGGELFERICNAGRFSEDEARYFFQQLICGVHYCHALQICHRDLKLENTLLDGSPAPRLKSCDFGYSKSSLLHSRPKSTVGTPAYIAPEVLSRREYDGKLADVWSCGVTLYVMLVGAYPFEDQEDPFFFRKTILWIMAVQYKIPDYVRISQSCRHLLSRIFVANPLRRITIKEIKSHLWFLKNLPRELTEVAQAAYFRRDNPTYSLQSEEEIMKIVEEAKVPPQASRSIGGFGWGTEEDEENVEEEEEGESEGEEDEYEKQVKAAHASGEVPPLT

SEQ ID NO: 68881 - protein, 296 aa, Clostridium difficile 630
MGNIVVIGSVNMDMVCSVDKRPEKGETVLGNSFFTSPGGKGANQAISASKLGANVKMISCIGEDGLGEELIRNFRTNKVDYSLVSRNNHKSSGVAVITLCENDNSIVVVPGTNELVDIELIKKNEEEIKNADIVLLQLEIPLKTINYVVNFCFENRIRVLLNPAPAVKLNEDIIEKVTYLTPNEHEYKIVFDTNEGIEEVLKKYPNKLVITEGKNGARFYDGEEIKHVSCISVDVQDTTGAGDTFNGALAVAITEGQNLYTAVEYAVVVSGLSVTKLGAQSGMPYKEDVEKYLNNK

SEQ ID NO: 68882 - protein, 175 aa, Triticum aestivum
  misc_feature (107)..(107): Xaa can be any naturally occurring amino acid
  misc_feature (124)..(124): Xaa can be any naturally occurring amino acid
  misc_feature (127)..(127): Xaa can be any naturally occurring amino acid
MAPIGVGSTLPDGQLGWFDENDQLQQVSIHSLAAGKKVILFGVPGAFTPTCSNQHVPGFITQAEDLKAKGVEEILLVSVNDPFVMKAWAKTYPENKHVKFLADGAAXYTKALGLEPDLTEKGWXSFXAVALLADNSRHVANSKKWHYISGARNLKCRLRLGSTPNLLSIDFAKHG

SEQ ID NO: 68883 - protein, 280 aa, Potamogeton distinctus
MTKEVTEEAVHTPVKDYCDPPPAPFFDASELKLWSFYRAAIAEFIATLLFLYVTVATAIGNSKQQNPCEGVGLLGIAWAFGGMIFILVYCTAGISGGHINPAVTFGLFLARKVSLPRALVYMVAQCAGAICGVGLAKGFMKNPYMRNGGGANFVHPGYSKGTALGAEIIGTFVLVYTVFSATDPERSARDSHVPVLAPLPIGFAVFMVHLATIPITGTGINPARSFGAAVIYNKDKPWDDHWIFWVGPFIGALAAAAYHQYILRAAAIKALGSFRSNPHN

SEQ ID NO: 68884 - protein, 842 aa, Nostoc sp. PCC 7120
MRAVLMAGGSGTRLRPLTCDLPKPMVPILNRPIAEHIINLLKRHHITEVIATLHYLPDVLRDYFQDGGDFGVQMTYAVEEDQPLGTAGCVKNIAELLDETFLVISGDSITDFDLGEAIAFHKQKQSKATLILTRVPNPIEFGVVITDEAGKIKRFLEKPSTSEIFSDTVNTGTYILEPEVLEYLPSNTECDFSKDLFPLLLAKDEPMYGYVAEGYWCDVGHLDAYREAQYDGLDRKVKLDFAYRENSPGLWIGQNTYIDPSAHIEAPAVIGNNCRIGARVQIEAGTVIGDNVTIGADANLKRPIVWNGAIIGEEAQLSACVISRGTRVDRRAHVLEASVVGSLSTVGEEAQISPGVRVWPSKKIESGAILNINLIWGNTAQRNLFGQRGVQGLANIDISPEFAVKLGAAYGSTLKPGAKVTVSRDQRNVSRMVTRSLIAGLMSVGVDIQNLDATAIPIARTVIPTMGVAGGIHVRVHPDRADYILIEFMDHKGINISKAQEKKIEGAYFKEDMRRALTHEIGDVAYPSQVIDLYCTAFEKLLNVSTLNNSRAKVVIDYVYAVSGAVLPQMLDKFGADAVVLNASLNKNAVTTTDRETLLTQLGHVVEALKANFGVQVSANGEQLILVDESGYPIRGELLTALMVDMILTSNPRGTVVVPVHASSAVEQVARRHDGRIIRTKANATALMEACQKNPNVVLGGSGETGFIFPQLHPGFDSMFCIAKIIEMLTIQERSLATVRSELPRVIYRTHTIRCPWSAKGALMRYLVETHPAQNLELIDGVKIRQPFDDSWLLVLPDASEPLVHLYANSHERDWVDETVRDYRSRVQSFVERQQEYHPAEV

SEQ ID NO: 68885 - protein, 52 aa, Potamogeton distinctus
TLLEGLADLEVALCLCTVIKASVLGINLNVPLDLSLLVNYCGKKVPAGFQCP

SEQ ID NO: 68886 - protein, 304 aa, Sinorhizobium meliloti 1021
MKDERSSFPARLKTNAVAVEALLETLLGPAVGTGEIARPANLLGAMRHGVLNGGKRLRPFLVAESTALLGGDAEAALRTGAALECIHCYSLVHDDLPAMDDDDMRRGKPTVHVAFDEATAILAGDSLLTFAFDIVAAPETALSDRQKTTLVLALARAAGHGGMAGGQALDLAAEKSAPDEAGIVLLQSMKTGALIRFACEAGAIIADAPAEDRRRLRAFGDKIGLAFQLADDLLDLTADAAIVGKATGKDAARGKGTLVSLHGQPWAERRLESLVAEAEGLLEPYGPRSAILAETARFIANRRN

SEQ ID NO: 68887 - protein, 389 aa, Oryza sativa Japonica Group
MEAAAAAAAEEEAGNPDGVEGAAVAAVAPEAAAEGPSEPNAGEASREPDAGQASREPGAAGPSREPDVAGPSREPDAAGPSREPGAAGGSREPGAAGGSRQPVPDAAQLAVVPYVEDIDRYLRSLEAEQTRRPMINYVQEIQGGIINMDVRGILVDWMADVAYVFNLQEETLHHAVSYVDRFLSKIAFPGDKLKLLGTTALFVASKYEEIHPPHVRNFSAVTVNTYTTQQVSKMELDILRFLNFDVGSPTVITFLRKFLTSCCGGNNSSNRKLELMCNYLAELSLLDDYYIRFLPSIVAAACLFVGKFTLNPNTRPWFGSVSTITPPENIKGGVEKYMVSRIYMCVFDLPMLFLMETWSSSGVSNHTKLQLKQNMMELPIENPTFISAS

SEQ ID NO: 68888 - protein, 535 aa, Candida albicans SC5314
MSTRDLPHSFSELSYGWVKRIRAEFTVGKSKEQLLAEDYHSTTDEDSEVVTSVKANSLWPAFASGAGLFSDGYVNNSISTVLFCLKKIYPDEITKSNAINNIASIAFVGTVVGQLGFGYISDRIARKGGMMAANVMLIFFTLMCAVGSWGVTVQGFFACLTVWRFFLGVAIGAEYPTSSVIASEFANQLPPGKRNRYFSWFTNAMIDSGFVVSAFVPFVLIWIFTEKHLRALWRVAIGLGVIPPLSLFFMRLKMKNSSSFQKLHMKNVKYRDYPWWLIVKFYWFRLTIVSLIWFIYDFSAYSFGNFNTIIIGEIIPEAPIWKQWGWSIVFNLFYIPGAFLGAISADYIGPRLTLALGVGIQGVIGIAMSACLNSLKKHIAGFVVVFGIFTTFGEFGPGDNIGLLASKTSATAIRGQYYGIAAAIGKIGAFVGTWVFPAIQSKYANNANPDLQLQVPFYISSALCLFSACLAIFFCPQVGQDAIYKEDHDFVQYLSNNGFDINMLGEGGDVREVCRESDSLEKGKRDDFQVDNNSL

SEQ ID NO: 68889 - protein, 532 aa, Candida albicans SC5314
MATRDLPHSVGDFCFGWVDQIRSEITLGKSQDQLIKEDVLEDDETVETKVEIKNLWPAFASGAGLFSDGYVNAGISTVLSCLKKIYGDEFTKSNAMNNIGSIGFVGTVVGQLSFGYISDNFDRKTGMLTANVMLIFFTLMCAVASWGTTVQGFFACLTVWRFFLGIAIGAEYPTSSVIASEFANQLPSGHRNRYFSWFTNAMIDFGFVVSAFVPLVLLWIFTPRHLRAVWRLSIGLGVIPPLILFFIRLKMDNSKSFKKMNMKRVNYSKYPWWLIIKFYWFRLTVVSLIWFIYDFSVYSFGTFNTIIIGEVIPNGTLYENWGWSVVFNLFYMPGAFLGAFIGDYLGPRLTLAIGVGAQGIIGIAMSACLKSLKKHVAGFVVVFGIFSTFGEFGPGNNTGLLASKTCASSIRGQYYGIAAAIGKIGAFVGTWVFPAIQKHYAYSEDLSLQVPFYVSSALCLFSAFLTIFFVPPVGQDAINKEDRLFKEYLEENGFDIRLLGDSGVVTQYQEDEDIGVISDEKDDTVKVQQKNV

SEQ ID NO: 68890 - protein, 390 aa, Haloarcula marismortui ATCC 43049
METTAAFRGLICTACGAETDSTADRCPDCGGVLVGDYDVPDLTPEALPDVTGPGRYEPLRPFSGDATVTLDEGATPLVPVPELADELGVDSVYVKDEGRNPTASLGDRKLSLAVTAAAQRGAERVATPSTGNGAQANAAYAARAGIESKGFVPSRCPFLNKAMVNVHGGDMRVVEGRYDDAASVSDEELADASDGWVSVAPGHPFRIEGAKSVAFETADDLDWTAPDAVVHPTGHGETLVGLEHGFQAAAESGLTDSTPRIYAAQPDSTAAIADAASEGASEPATIEHPDTIVGPLEVPDPAAGAAALDSLDRSGGDGVAVSDKDILAGAVDGCEMGPETGATGGTAIAGARALADDGAFDDDDVVVLVNPVAGSKEADLLRSHLMSQGI

SEQ ID NO: 68891 - protein, 462 aa, Saccharomyces cerevisiae YJM789
MFSRTASKFRNTRRLLSTISSQIPGTRTSKLPNGLTIATEYIPNTSSATVGIFVDAGSRAENVKNNGTAHFLEHLAFKGTQNRSQQGIELEIENIGSHLNAYTSRENTVYYAKSLQEDIPKAVDILSDILTKSVLDNSAIERERDVIIRESEEVDKMYDEVVFDHLHEITYKDQPLGRTILGPIKNIKSITRTDLKDYITKNYKGDRMVLAGAGAVDHEKLVQYAQRYFGHVPKSESPVPLGSPRGPLPVFCRGERFIKENTLPTTHIAIALEGVSWSAPDYFVALATQAIVGNWDRAIGTGTNSPSPLAVAASQNGSLANSYMSFSTSYADSGLWGMYIVTDSNEHNVQLIVNEILKEWKRIKSGKISDAEVNRAKAQLKAALLLSLDGSTAIVEDIGRQVVTTGKRLSPEEVFEQVDKITKDDIIMWANYRLQNKPVSMVALGNTSTVPNVSYIEEKLNQ

SEQ ID NO: 68892 - protein, 509 aa, Triticum aestivum
MAMEQAIYLVLALVLPLLLLKLIRKRSGGAGLKLPPGPWRLPVIGSLHHLAGKPLVHRAFADIAHRLGDAPLVYLKLGEVPVVVASSAEAAREVMKTQDVTFATRPWSPTTKILMSDGVGVAFAPYGAHWRQLRKICIMELLSARRVQSFRNVREEEAGRLVAAIAAGAGKGEPVNVSKRLAVLIADMTVRAMIGDRFSRREEFLEVLQQGVRILSGFNLRDLFPSSRLVGFVSGSARQAWENHTKGFELIECAIKQHEEVKATAAASNGDRKEGEQEDLLDVLLRIQKEGGHDVPFTMGAIKCLLVDLFSAGSETSATTLIWAMSELMRNPTTMAKAQAEVRNHLQGKPSVTEDDLADLKYMRLVIKETLRLHPSVPLLLPREPTEACKVLGYDVPMGTTVFVNTWAICRDPKHWDASEEFRPERFESGEVDFKGTNFEYTPFGAGRRICPGMLFAQSSMELALAALLYHFDWELPAGRELDMEEEMGIAVGRKNDLYLYAKVHVPLN

SEQ ID NO: 68893 - protein, 205 aa, Solibacter usitatus Ellin6076
MNKPAVPRLKKVAEAEFPTQFGLFRIYGFEGCAGSRPEEAVVLKMGEFAKGEPPLVRIHSQCLTGDVFHSLRCDCRAQLEIALKSIAQEGVGLLIYEHQEGRGIGLLNKLRAYELQDHGADTIEANEQLGFESDLRNYELPGAILQYFGLKAIRLMSNNPEKVEAVEKAGVRVVERVPCLADVLDTRIDYLRTKREKMGHLLEDF

SEQ ID NO: 68894 - protein, 129 aa, Zea mays
MAPIAVGDVVPDGTISFFDENDQLQTASVHSLAAGKKVILFGVPGAFTPTCSMKHVPGFIEKAEELKSKGVDEIICFSVNDPFVMKAWGKTYPENKHVKFVADGSGEYTHLLGLELDLKDKGLGVRSPH

SEQ ID NO: 68895 - protein, 577 aa, Glycine max
MAQVVASRSIQSTPLCPTSGSARDRTQNLLKPPSFASKVFPLGENNNKRSKLRLRSLQISARKSAPSEVIPMSPEDDPKIEEHLQHLRGVQPFGENSVGMWSKPTFRRKTKIVCTIGPSTNTREMIWKLAEAGMNVARLNMSHGDHASHQKVIDLVKEYNASHEDNVIAIMLDTKGPEVRSGDLPQPITLMPGQEFTFTIQRGVGTADCVSVNYDDFVNDVEMGDMLLVDGGMMSMVVKSKTEDSVKCEVVDGGELKSRRHLNVRGKSATLPSITGKDWDDIKFGVDNKVDFYAVSFVKDAEVVHELKNYLKSCGADIHVIVKIESADSIPNLHSIITASDGAMVARGDLGAELPIEEVPLLQEEIINLCRSMGKAVIVATNMLESMIVHPTPTRAEVSDIAIAVREGSDGIMLSGETAHGKFPLKAVQVMHTVALRTEATIPGGKMPPNIGQVLKNHMSEMFAYHATMMSNTLGTSTVVFTRTGFMAVLLSHYRPSGTIFAFTDEKRVQQRLALYQGVCPIYMEFCDDSEATFRRALDLLQKQAMVKEGEEVALVQSGRQPIWRFQSTHNIQVRKV

SEQ ID NO: 68896 - protein, 466 aa, Shigella flexneri 2a str. 2457T
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKQGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 68897 - protein, 231 aa, Brassica napus
  misc_feature (187)..(187): Xaa can be any naturally occurring amino acid
MSRLENDRPLLTERIYKELHEEEETAYDEAEKVHIARDEDDDERDLEHGVGCGGAPPFSWRKLWLFTGPGFLMSIAFLDPGNLEGDLQAGAVAGYSLLWLLMWATAMGLLVQLLSARLGVATGRHLAELCREEYPTWAGMVLWVMAELALIGSDIQEVIGSAIAIQILTNGIFPLWAGVVITALDCXVFLFLENYGIRKLEAVFAVLIGTMAVAFAWMFGQAKPSGSELLV

SEQ ID NO: 68898 - protein, 181 aa, Oryza sativa
MGNLFANLFSGLFGKRDMRILMVGLDAAGKTTILYKLKLGEIVTTIPTIGFNVETVEYKNISFTVWDVGGQDKIRPLWRHYFQNTQGLIFVVDSNDRERVGEARDELHRMLQEDELRDAVLLIFANKQDLPNAMNAPEITDKLGLHSLRNRNWYIQATCATSGDGLYEGLDWLSNQLKNQK

SEQ ID NO: 68899 - protein, 114 aa, Zea mays
YYRGTKLSPAKMSTVTRAYLDQRLALANRCSREAAMAGAKAAAVATVAAAVPTLASVRMLPWARAHLNPTGQALIISTIAGMAYFIVADKTILSMARKHSFDDAPDHLKNTSFN

SEQ ID NO: 68900 - protein, 313 aa, Haloarcula marismortui ATCC 43049
MTGWTIEDMPPLRDRTVVVTGANSGLGLEGSKAFARRGATVVMACRSVERGESAAAEIREAVPNATLDVRECDLADLSNVASFADGLRADYDAVDILCNNAGVMAIPRSETADGFETQFGVNHLGHFALTGHLLDLLGAADGESRIVTQSSGAHEMGEIDFDDLQRERSYGKWSAYGQSKLANLLFAYELQRRLGNHGWDDVLSVACHPGYADTDLQFRGPREMGSTLRTAAMGVANAVFAQSAEQGALPMLYAATAEDVIGGEYVGPGGLFDMRGSPEFQQSNDASQDEETAEQLWAVSTDLTGVEYDFERT

SEQ ID NO: 68901 - protein, 427 aa, Physcomitrella patens subsp. patens
MNWEAIQALRARDGSVGLSHFKLLRRLGCGDIGSVYLCELRGSDCYFAMKVMDKAALATRKKLSRAQTEKEILASLDHPFLPTLYAHFDTAQFSCLVMEYCSGGDLHSLRQKQAGKCFPDMAAKFYAAEILLALEYLHMMGVVYRDLKPENVLVREDGHIMLSDFDLSLRCAVNPSLIMAQPILAALPSRNERRATSEIWMSEPQQVALQSCVPIISSQYRFRKPMALRSKRSGRSENEKGAVSPPSMPELVVEPTEVRSMSFVGTHEYLAPEIISGDGHGSSVDWWTFGIFLYELLYAKTPFKGADNELTLTNVVSHPLIFPPNTDTVTVSDSAKDLIRGLLMKDPMKRIGSIRGAGEIKAHPFFEGVNWALIRCACPPEVPKPYRLELAAAAGVPTLGQALADEKKKATGGRHDGDNGVPEFECF

SEQ ID NO: 68902 - protein, 456 aa, Xanthomonas campestris pv. campestris str. 8004
MSARYDYDVVVLGGGSGGLAAAFRAAKHGARVAIMEPGELGGTCVNLGCVPKKAMWLAADLASKIELAGALGFDVVRPTLTWQELVTHRQGYIGNIHASYRRRLDDDGVVLIPQRGVLQDRHTLMGADGVPVTAEHIVIATGAHPLRPHVEGAEHGHVSDDFFNLCHAPDHVAIVGGGYIAVEIAGLLQALGSRVHLFVQGERLLERFDAELTLQLADNLRHLGVRLHFGFRTTGVQRDDTGKLRMRGHSAHPGELGNDVFDQVFFAIGRLANTAGLGLEALGVELGKKGEIVVDDGQTTNVPNIHAVGDVDGKVGLTPVAIAAGRKLMDRLFGGQPDARMDYDNVPSVVFSHPPLGAVGLTEEQARERYDGAVRVYRSNFRPMLHALADAPQRSVFKLVCVGEEERVVGVHLLGESADEMLQGFAVAVKMGATKRDFDETVAIHPTSSEEIVLMH

SEQ ID NO: 68903 - protein, 169 aa, Nostoc sp. PCC 7120
MDLSRIPAQPKPGVINILIEIAGGSQNKYEFDKDLEAFALDRVLYSSVKYPYDYGFVPNTLADDGDPLDGMVIIDEPTFPGCVIAARPIGFLEMIDGGDRDEKILAVPDKDPRYAHVKSLNDVAPHRLDEIAEFFRSYKNLEKKVTQILGWQDVDQVKALVDQSIKAYK

SEQ ID NO: 68904 - protein, 644 aa, Acinetobacter sp. ADP1
MIQLDQFSVRRGGRVLFQKASMQLHPGWKIGLTGVNGAGKSTLFSALLGGIESDSGSLSRPNVWTVAHMAQEIKALNMKAIDFVLSGDEEYWTIQHQLEHPEQLSDNELAHLYSRFDEINGYAAAAKASQLMAGLGFFEYQSQYDVASFSGGWRMRLNLARTLMSRSDLLLLDEPTNHLDLDAILWLEDWLKAYEGTLVLISHDRDFLDAITDHILHIENQQLTLYTGNYSTFETTRAERLAQQQQAFEKQQETRAHLQKYIDRFKAQATKARQAQSRIKQLERMQELAPAHVDTPFTFSFREPSKMSSPLLALEHADIGYGDKLIVTNVNLQITPTSRIGLLGMNGAGKSTLIKSLVGDLALLRGTRYASELLNIGYFAQHQMDALDGSASPMLQLSRIADKKISEATLRAFLGSFGFSGERMDTPSESFSGGERARLALALIVWQRPNVLILDEPTNHLDLDMRHALTMALQDFEGAVVLVSHERQLIASVCDELILVHNGSSRDFDGDLHDYANWLRQARNDMMKQGQQPTAPIQSKVEAQPVISKLDKEAQRKEAAKRREQTRPIRKNIEKCESQVERLQKRLAEIETLLGDSSLYDADRKNDLLKLMNEQSDSKQELEQAEEQMLELMMQLEELESLFD

SEQ ID NO: 68905 - protein, 1282 aa, Emericella nidulans
MAQEREFYKYCQLPQRPGLLDRPPVSPRTEQNVELLPQSSQDTTLTALAQLGALRLNCQRCMISLFDRRTQYILTEATRTLSLQDDRVHLDGDALWLGSSVIPKEDGICHLVCQESSLNASQCESDPACGLVVPDLTKDDRFNKRQYVVKAPHLRFFAGVPIRTRRGIAIGAFSVSDGKTRPSGLTSLELRFMTDTAAAIMNHLEMVRSHEQNRRGANMIAGLGNFVQGGIFPSSSLRRRSRLNVDNETAAKDDSPRNSVLVSRRIHARSEQSTANDRAQREKSPIPSVPESKESNELQPLCEPSTPKRKRENEVTLTSGTREIFGRAARILQESLDVQGVVFFDASVKSYAGLVRNSDDRPSDAESSSGSSEAPEASSSDSDNPATGHSTTDTDDFSTSDVLGYSLEDPEQPMGAMRETFLRSLLRNYPQGAIFNVDENGSISSSEGSDSSSGTSVSREIVYRRHEAPKVQRRWKQQKRHRLSLKEENKWLLKIFPSARCITLFPLWDSRRNRWFSGLFLWTKSPRSFSLGGELAYLYAFSNSIMAEIHRLDIELANRAHATLVGSISHELRSPLHGILGSTELLGDSDLTPAQTALVNTVEHCGRSLLDIINNMLDFAKINQFARKSRSSRFKSSSPRRRQHRFLMPAKGNGVVNLISDVQLDAVLEEVAGSVFAGHCFSSKNRTLALASVPTLDREGELVMASPTERPLSVFNESLTVIYDVAPDFQWLFETQAGAWRRVLMNLFGNALKYTQSGYILVSLKSSTPATAKGRRLSRGESADTATVTLTVKDTGQGIDKEYLQSNVFKPFSQENPLSPGSGLGLSIVHQTVVSLGGSIDIVSTKGTGTEVKVRVDLPRTPKSEATNGDQNQHHKAVTETRELVRGKSIGLVGFGTPAEHNEEALTLLRSSLQRMYQDYFGMEVGFASPGNPGSFDIYVVRQTYLDVADEIFRNVGTVHGKRPAVLVICSTPQIAQKLSSTASQRRSPAVYEFISQPCGPCRTADALRGCVNRRETESPRPSPPLTSETIDSYGHVTVIETANSGASGMPYTGCATNGYRAANGIPQDTPQVHTNQRANGLTGLKIETLKSPASPIALSPKTLALQNGKTVSTGVEVQLSPTSAVTTITTSAVEEGDGAVTEISATLEASHIVPSVLLVDDNSVNLQLLVAVMKKAKFSYFTACNGLEALEVYKAHAKEIHVILMDISMPVMDGLESTREIRLFEKTQRESPAFKPATIIALSGLGSASVRQEAFNSGLDLFLSKPVRFQELTTQLGELMR

SEQ ID NO: 68906 - protein, 336 aa, Picea sitchensis
MEETPSSLPIVFESPGFLRIYEDGTVERLIDRGTVPPSTQDDNFDEEKEGVASKDVLLDPQTGVFVRLYLPRLQVTDVKQKVPILVYFHGGGFCVESAASPLYHSYLNKVATEAKVIGVSVEYRRAPEHRLPAAYDDCFGVLEWLVRQAEAAEGVTIDPWLASHADFSKVFVAGDSAGGNIVHQVCIRASARNWDGLCLQGAILVHPFFAGEERIECELGTGAEVEGILKVVDGIWSISLPEGADRDHPFCNPDGPHSLALSTLVCPRTLVIVAEKDFLRDRGILYYEALKKAGKDVDLVMTEGENHVFHLLNPKSENAPLMMKRISDFMNSSSDH

SEQ ID NO: 68907 - protein, 504 aa, Oryza sativa Japonica Group
MDHIFSTNAWLTIALVFIITLAAKVVRSSVTLPAEKTSKPRPPPEAKGAPLVGIIPAVLRRGLQAVIREQHRALGSVFTLRSLGLAVTFLVGPECSDHFFHAPELEIAIDGLYEVTVPIFGKEVGYDIDLDTRNEQHRFFAKMLRPAKLRGHVLPMVCEIEEYFGKWGECGVVDLMQEVDHVLMLIASRCLLGKEVRENMFDEVASLFHELMGGMHLISMFFPYLPTPGHRRRDKARAKLGEIFSQIVKTRKMSGRVEDDMLQDLIDSTYGDGRATTDTEVTGLLVALLFAGHHTSSTVAVWTALRLLTHPEHLRAVRAEQERLVAAAEQQRSHHGGGGGGGIDYGVLLQMDVLHRCIKEALRLHPVTPMILRRARRGFTVRDKEGGEYSVPAGRLLASPLVVNTLLPNIYKDPHVFDPDRFAAGRAEDKAVAGARDLAYLSFGAGKHACMGEGYAYQQIKVILSHLVSNFELKLESPFPETEDMLSMRPKGKAIVSYKRRTLS

SEQ ID NO: 68908 - protein, 455 aa, uncultured archaeon GZfos28B8
MENEVKKNNSELIEEEGVKKTEKLQMEAVRQHSSYAGKIQIMPKCSIHSLDDFAVYYTPGVAGPCKIIEKEKEKAYELTNKWNTVAVISDGTRVLGLGDIGPEAGLPVMEGKALLFKYLGGVDAIPICLDTKNAEEIIQAVKWLQPSFGGINLEDIANPKCFQILDTLREEMEIPVWHDDQQGTAAVTLTGLTNALKIVGKKLEDARIAFIGAGAANVAISRVLFSAGVKPRNCIVADSKGILHTGRKDIEERKDEYRDKWRLCRITNPEGITGGMDIALKDVDVCLALSKPGPGVIKPEWVNTMNEAAIVFACANPVPEIWPQEAKEAGAEIVATGRSDFANQVNNSIGFPGIFRGALDVRAKTITDEMCIAAANALALFAQKRGINEDYIIPTMEDSEAFVEEAVAVGLQAQKDGVARLNISSKELYHKAESIISNAQKSTSLLMKEKLIPSY

SEQ ID NO: 68909 - protein, 189 aa, Haloarcula marismortui ATCC 43049
MDRLKKSLLEAPIIEKEGYHYFVHPISDGVPMLRPELLREIVIKIIRKAELDDVDKIVTPAAMGIHISTAVSLMTDIPLVVVRKRQYGLDGEVSLSQVTGYSESEMYVNDVYEGDQVLVLDDVLSTGGTLAGLTGALEDIGADIRDIVCVIKKADGTNKLDEAGYDAKTLINVQVIDGEVTIVDEHGDD

SEQ ID NO: 68910 - protein, 443 aa, Mycobacterium avium 104
MTDHLWLHFARHGPGITPPIITRGHGVTIYDDRGNSYLDGLSGLFTVQVGHGRAELAEAAARQAGTLAFFPLWGYATPPAIELAERLAGYAPGDLNRVFFTTGGTEAVETAWKLAKQYFKLTGKPGKHKVISRAVAYHGTTQGALAITGLPRYKAPFEPVTPGGFRVPNTNFYRAPEAFANDPKGFGLWAADRIAEAIEFEGPDTVAAVFVEPVQNAGGSIPPPPGYFERVREICDRYDVLLVSDEVICAFGRIGSMFACADFGYVPDMITCAKGMTSGYSPIGAMIASERLFEPFADGDTMFPHGYTFGGHPVSAAVGLVNLDIFEREGLNDRVRTLAPTFRATLEKLYDLPIVGDVRGEGFFYGVELVKDRATKQTFTDSERRALLGRVGAALFEAGLYCRTDDRGDSVIQLAPPLISGQAEFDTIEAALRGVLSDECRRL

SEQ ID NO: 68911 - protein, 274 aa, Vigna unguiculata
MEIAPIPVDTYTLGFIGAGKMAESIARGAVRSGVLPPSRIRTAVHSNPARRTAFESFGVTVLSSNDEVVRQSNVVVLSVKPQLVKDVVSKLKPIITKDKLLVSVAAGVKLKDLQEWAGSDRFIRVMPNTPAAVGEAASVMSLGAAATEEDGNVIAKLFGSIGKIWRAEEKYFDGITGLSGSGPAYIYLAIEALADGGVAAGLPRDLSLSLASQTVLGAASMVTQSGKHPGQLKDDVTSPGGTTITGIHELENGGFRGTLMNAVVAAAKRSRELS

SEQ ID NO: 68912 - protein, 109 aa, Populus alba x Populus tremula var. glandulosa
MSKKVVAESPLQRNSLASLDQKLAMAKRCSHEGVVAGAKAAVLATIATAIPTMASARMLPWARANLNHTAQALIISTVAGAAYFIVADKTVLATARKNSFKSPRSNIEA

SEQ ID NO: 68913 - protein, 349 aa, Vitis vinifera
  misc_feature (120)..(120): Xaa can be any naturally occurring amino acid
  misc_feature (200)..(200): Xaa can be any naturally occurring amino acid
  misc_feature (213)..(213): Xaa can be any naturally occurring amino acid
MEETEARAGGDLKWSRETIPKVLRIVGTRLPQRDLISLLLVSPWIHRTLVSCSSLWLVLDFRETNNAGNRLVAALSLFRYQHVKQINLEFAQDIEDKHLDLLKTKCLDSLQELESLNLNXCQKISDRGVETITSACPKLKVFSIYWNVRVTDIGMTHLVKNCKHIVDLNLSGCKNITDKSLQLIADNYPDLELLNLTRCXKLTDGGLQQILLXCSSLQSLNLYALSSFTDEAYKKISLLTDLRFLDLCGAQNLSDQGLCCIAKCKNLVSLNLTWCVRVTDVGVIAIAQGCTSLEFLSLFGIVGVTDKCLEALSRSCSNMITTLDVNGCIGIKGIKSPFGSDSSKNAFNL

SEQ ID NO: 68914 - protein, 155 aa, Brassica napus
DVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRSGAYHTEWTKLARKSN

SEQ ID NO: 68915 - protein, 181 aa, Cucumis melo
  misc_feature (137)..(137): Xaa can be any naturally occurring amino acid
  misc_feature (156)..(156): Xaa can be any naturally occurring amino acid
  misc_feature (158)..(158): Xaa can be any naturally occurring amino acid
  misc_feature (167)..(167): Xaa can be any naturally occurring amino acid
MELDLKPMDPTNFFTGEGGSFHKWFPSDHLIIPQTKVGAGRLLLHPRGFAVPHNSDSSKVGYVLQGSGVAGIVFPCKSEEAVVRLKKGDVIPVPEGVTSWWFNDGDSDFEVLLVGDTRNALIPGDITYVVFAGPLGXLQGFSSDYIEKVYDLTEEXRXVLLKSQPNXLIFKLKDEQTLPEP

SEQ ID NO: 68916 - protein, 166 aa, Lipomyces spencermartinsiae
VTDKFPEDVKFLYIAYTPAKADITACGIPIPLDFDKEFRDKTVVIVAIPGAFTPTCTANHIPPFVEKFTALKSAGVDAVIVLSANDPFVQSAFGKALGVTDEAFIFASDPGAEFSKSAGLSLDLPPAFGTRTARYAIIVSNGVVKYVEKDSEGVAGSGVDAVLAAL

SEQ ID NO: 68917 - protein, 492 aa, Yersinia pestis KIM
MPVWRPVGMNCAVWPRRGNCDAPRLSRWLTSLDKFEERISQTTTIRRYGRLTRATGLVLEATGLQLPLGATCLIERHNGGEVQEVESEVVGFNGQHLFLMPLEDVEGIVPGARVYARVTTSGTSASKQSISSKQSIPSKQSFASKQLPLGPELLGRVLDGSAKPLDGLPAPETGYRAPLITPPINPLQRTAIVQVLDVGVRTINALLTVGRGQRMGLFAGSGVGKSVLLGMMARYTQADVIVVGLIGERGREVKDFIENILGAEGRARSVVIAAPADVSPLLRMQGAAYATRIAEDFRDRGQHVLLIMDSLTRYAMAQREIALAIGEPPATKGYPPSVFAKLPALVERAGNGVSGGGSITAFYTVLTEGDDQQDPIADSARAILDGHVVLSRRLAESGHYPAIDIEASISRAMTSLIDDDHYSRVRQFKQLLASYQRNRDLISVGAYAAGSDPLLDKAIALYPQMEAFLQQGMFERSSFDDACQHLKVLFPG

SEQ ID NO: 68918 - protein, 178 aa, Triticum aestivum
  misc_feature (88)..(88): Xaa can be any naturally occurring amino acid
  misc_feature (158)..(158): Xaa can be any naturally occurring amino acid
MAAAAVDPMVLGLGTSGGASGSGVVGGGVGRAGGGGAVMEGAQPVDLARHPSGIVPVLQNIVSTVNLDCRLDLKQIALQARNAEYNPXRFAAVIMRIRDPKTTALIFASGKMACTGAKSEEHSKLAARKLARIVQKLGFPATFKDFKIQNIVPSGDVXKFPFRLEGLCLIPRGPFSSY

SEQ ID NO: 68919 - protein, 223 aa, Vitis vinifera
MTKQQANWSPYDNNGGSCVAIAGADYCVIAADTRMSTGYNILTRDYSKICKLADKCVMASSGFQADVRALQKHLAARHLIYQHQHNKQMSCPAMAQLLSNTLYYKRFFPYYSFNVLGGLDNEGKGCVFTYDAVGSYEKVGYSSQGSGSTLIMPFLDNQLKSPSPLLLPALDAVTPLSEPEAVDLVKTVFASATERDIYTGDKLEIVILNASGIRREYMDLRKD

SEQ ID NO: 68920 - protein, 389 aa, Brassica napus
  misc_feature (361)..(361): Xaa can be any naturally occurring amino acid
MAMMATAIRNSASRGTMMSRQISGLRSMSSWWKNVEPAPKDPILGVTEAFLADPSPDKVNVGVGAYRDDNGKPVVLECVREAERRIAGTSFMEYLPMGGSVKMVDETLKLAYGDNSEFIKDKRIAAVQSLSGTGACRLFADFQKRFRPDSQIYIPVPTWSNHHNIWRDAQVTQKTYHYYHPETKGLDFSGLMDDVKNAPQGSFFLLHACAHNPTGVDPTEEQWREISQLFKAKNHFAFFDMAYQGFASGDPARDAKSIRIFLEDGHHIGISQSYAKNMGLYGQRVGCLSVLCENEKQAVTVKSQLQQLARPMYSNPPLHGAQIVSTILGDPELKSLWLKEVKIMADRIIGMRTALRESLEXKVGSPLSWEPVTQQIGMFCYSGMTPEQV

SEQ ID NO: 68921 - protein, 516 aa, Oryza sativa
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRMYVTMDRYENDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 68922 - protein, 389 aa, Oryza sativa Japonica Group
MAPPAPATARRPMAAVRCSAAKRSYNVTLLPGDGIGPEVVAVAKDVLSLAGALEGVEFRFQEKLMGGAAVDAYGVPLPEETLAAAQASDAVLLGAIGGYKWDNNEKHLKPETGLLQIRAGLGVFANLRPAAVLPQLVDASTLKKEVAEGVDIMVVRELTGGIYFGQPRGFGKNDKGEDTGFNTEVYSASEIDRITRVAFEVARKRRGKLCSVDKANVLEASMLWRKRVTSLASEFPDIELSHMYVDNAAMQLIRNPKQFDTIVTNNIFGDILSDEASMLTGSIGMLPSASVGESGPGLFEPIHGSAPDIAGQDKANPLATILSAAMLLRYGLGEENAAKRVEAAVTETLNNGFRTGDIYSPGTTLVGCKRMGEEVLKTVESQSAVALNS

SEQ ID NO: 68923 - protein, 144 aa, Parvularcula bermudensis HTCC2503
MRAKDMLKDKGRDVVTIDHKASLAEAIEVLASKNIGAVVVTSPGKAVAGILSERDVVRVLSGAPTGFRESPVTDIMTREVFTAGLEASVDQLLDLMTDRRIRHVPIVDGDGLVGLLSIGDVVKCRIRQAVGEADALKEYISAAG

SEQ ID NO: 68924 - protein, 162 aa, Oryza sativa
  misc_feature (103)..(103): Xaa can be any naturally occurring amino acid
  misc_feature (132)..(132): Xaa can be any naturally occurring amino acid
MRPASSPVPAVLTAPATAATAAIAVKPTPPQRALQASRRELVVAAAAVALWPCGGAARAASDDEYVSETKDVIGKVRSTINMDRADPGVADAVAELRELSNSXWVAKYRREKSLLGRPSFREMYSAPNAVSXHYISFGPTAPIPNKGRARILQGGPGTQFPL

SEQ ID NO: 68925 - protein, 271 aa, Brassica napus
MEKFSYNSYPDSAESSPRSRDVDFDNPPPWEDQTQQQQQQTHSYKVKFMCSYGGKIQPRPHDNQLTYVNGDTKILSVDRGIRFPALASKLSAVVGGDGGGGEISFKYQLPGEDLDALISVTNEDDLEHMMHEYDRLLRMSSKPARMRLFLFPLSSPVSTGGGFGSEGSTKSDRETLNNTITNRPESEKSVMAPASNADFLFGSEKVVVAPPAPASPPQQIIQDPQMFVNQQVITPEQHPVDIQRQIHEFQRIQIRDQNNRCRSSYTEAMYR

SEQ ID NO: 68926 - protein, 410 aa, Sinorhizobium meliloti 1021
MTINATVKEAGFQPASRISSIGVSEILKIGARAAAMKREGKPVIILGAGEPDFDTPEHVKQAASDAIHRGETKYTALDGTPELKKAIREKFQRENGLAYELDEITVATGAKQILFNAMMASLDPGDEVIIPTPYWTSYSDIVHICEGKPVLIACDASSGFRLTAEKLEAAITPRTRWVLLNSPSNPSGAAYSAADYRPLLEVLLRHPHVWLLVDDMYEHIVYDGFRFVTPAQLEPGLKNRTLTVNGVSKAYAMTGWRIGYAGGPRELIKAMAVVQSQATSCPSSISQAASVAALNGPQDFLKERTESFQRRRDLVVNGLNAIDGLDCRVPEGAFYTFSGCAGVLGKVTPSGKRIKTDTDFCAYLLEDAHVAVVPGSAFGLSPFFRISYATSEAELKEALERIAAACDRLS

SEQ ID NO: 68927 - protein, 249 aa, Xylella fastidiosa Dixon
MRPKIVVGNWKLHGSHAFAQALVAQVAAGLPLPGVSVIILPPLLYLSDLTQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 68928 - protein, 405 aa, Mesorhizobium sp. BNC1
MEEFHKVRRLPPYVFEQVNRLKASARSRGADIIDLGMGNPDLPTPKAIVDKLCEVVRDPRTHRYSSSRGIPGLRRAQAAYYARRFGVKLNPDTQVVATLGSKEGFANMAQAITAPGDVVLCPNPTYPIHAFGFIMSGGVIRSIPAEPDHNFIPVLERAVRHSIPKPLALILNYPSNPTACLASLDFYKDVVAFARKHDIIILSDLAYAEIYFDTEAPPSVLQVPGAMDVAVEFTSMSKTFSMPGWRMGFAVGNERLIAALSRVKSYLDYGAFTPIQVAATAALNSDGTEIEEVRSVYHRRRDVMVDAFGRAGWQVPPPPATMFAWAPIPEPFRQLGSLEFSKLLVEKADVAVAPGIGFGEHGDDYVRIALVENEHRIRQAARNIKRFLATAAEHPSNVVPFAATR

SEQ ID NO: 68929 - protein, 445 aa, Sinorhizobium meliloti 1021
MNAHNKPNAPVLDSYWMPFTANRQFKAAPRLLAAAEGMHYTSVDGRTVLDGTAGLWCVNAGHGRRQIAAAVERQLSTMDFAPSFQMGHPIAFDFAERLAEIAPGPAGAKLDRVFFTGSGSESVDTALKMALAYQRSIGQGTRTRLIGRERGYHGVGFGGISVGGIVNNRRVFPQLPGSDHLRHTHDPAKNAFVKGQPEHGAELADDLERLVALHGAETIAACIVEPVAGSTGVLIPPKGYLERLRAICDKHGILLIFDEVITGFGRLGAAFATDYFGVTPDIVTTAKGLTNGAIPMGAVFASRKVHDALMHGPEGQIELFHGYTYSGHPAACAAGIATLDIYRDEGLMTRAAEIEGDWHEAMHSMKGLPHVIDIRTIGLIAGIELQSRDGAPGARAYDVFVDCFERGLLIRVTGDIIAFSPPLIAEKQHFGEIVSILADALKRVK

SEQ ID NO: 68930 - protein, 478 aa, Picrophilus torridus DSM 9790
MYMNYAVASSHPLSTFVGNEILKDGGNAYDAAIATSAALVVVQPHLNGLGGDFFSTIIDNDIYSINGSGNAPELATIEFFHRNGYNKIPEQGPLSSFSIPGLVSSWEILYKNATMKLEKLFSRAISFAMDGFIPSNSILKAIKNFKYGDVDFNNIYYNNERLLVQRALGKTLKLLAEKGLESFYHGDIARAIEDDMIKKHGLIRFNDLDSYSASVVKPLEIRYRNYSVYTNPPVSQGATALYWLNRLNKYDLYTMPDDLYYSSLINEMYPSYEFRKSMIYDGSSISNDDLLNNYSYSKNKKDEKYSDTTAFSVFDGDAGISAIQSNYMGFGSGHSIHGYGINMNNRGSYFTLDKNHKNALKPGKKTFHTLMSTILNGDKLILLGSMGGDIQPQVNVQIITRIIDLNYNIQDAISYPRFAYPASIYGDADLYSEKGIVPGSKYIDGLSSMMGHAQGILIEDDVHAGFDPRGDGLLKYHL

SEQ ID NO: 68931 - protein, 427 aa, Ustilago maydis 521
MISAFFIFNQKGEVLISRLFRNDLRRSIADIFRIQVVSNPDVRSPIITLGSTSFFHVRHENLYIVAVTKCNANAALIFEFCYRVITIGRSYFGGKFDEEAVKNNFVLIYELLDEILDFGYPQNSEIDTLKMYITTEGVKSEQAVREDSSKITIQATGATSWRRADVKYRKNEAFVDVVETVNLLMSNKGTILRADVDGAILMRAYLSGMPECRFGLNDKLVLEKNDKNRGKVDAVELDDCQFHQCVKLGKYDTDRSISFIPPDGEFELMRYRSTTNVNLPFKVHAIVEEVSKSKVEYTLNLKANFDSKLNATNVVLRIPTPLNTSTVKCQVSMGKAKYVPAENHIVWKIARIQGGGEASFGADAELSSTTVRKTWSRPPIEVDFQVLMFTSSGLLVRYLKVFEKSNYQSVKWVRYLTRSNGSYLIRF

SEQ ID NO: 68932 - protein, 400 aa, Polaromonas sp. JS666
MLSLTDIEQAAQRLQGHLLDTPCVESRTLSQLTGAQIYLKFENLQYTASFKERGACNKLAQLSGDERRRGVIAMSAGNHAQGVAYHAQRLGLRAVIVMPRFTPGVKTERTRGFGAEVVLHGDTLEESRAHALMLAEREGLVFVHPYDDEAIVAGQGTVGLEMLHAVPGLDTLVVAVGGGGLIAGMAIAAKALKPEIEIVGVQTSRFPAMVNAIKGTHHPQGTSTIAEGIAVGTPGVIPQAIIEKLVDDLVLVDEGDIEQAMVMLLEIEKTLVEGAGAAGLAAVLKYPARFAGKKVGLVLCGGNIDPLLLAAIIERGMVRAGRLARIKVSVRDVPGSLAKITATVADAGANIDEVHHQRAFTTLSVQNVEIELVIQTRGREHIAQVLAALAAAGFEASEQH

SEQ ID NO: 68933 - protein, 676 aa, Ralstonia metallidurans CH34
MQRVDRIDDAVSLPELTLRGIILGALITVVFTASNIYLGLKVGLTFSSAIPAAVISMAVLRLFPGANILENNMVQTQASAAGTLSSIIFILPGLVMLGHWQGFPFWQTLAICAAGGMLGVIFSIPLRHAMVVHSDLPYPEGVAAAEILRVGSASQDKGNGKQETGLGDLVAGGVAAGLFSIAAGGFRVLAEGANAWLAVGASVVRLSMGFSLALVGAGYLVGIVGGLAMLLGLFLTWGIAVPWLTAITPMPAGATLSSFGTAVWSTQARFIGAGTIGIAAIWTLGTLFKPMVEGVRASMGALRAGAPGEGGAVPRTQRDLPMAWIGVLTLVLLVVLAVTFGYFLAPAPLDTGATWRLVGCAVLFAFVFGFLVAAACGYMAGLVGSSASPISGIGIIAVILVSLLILGIGTLDGLLDTSEGGKYAIALAIFTTSAVVAVASISNDNLQDLKTGWLVGATPWRQQVALLIGCAVGAAVIPPVLELLYHAYGFAGALPRADMDPNSALAAPQATLMTAIATGIFTHKLNWTMILIGVALGVVLIAIDEVLRHRGGVARLPVLAVGIGIYLPPTISSALVVGAVLSWWLLRTERKRAEARGDDVPTVLAHAERRGTLLASGLIVGESLVGVALAAVIGLSGKEAPLALVGEGFGTTAQWLGLAVFVLVCVGFCRRVLAAR

SEQ ID NO: 68934 - protein, 432 aa, Escherichia coli O157:H7 EDL933
  misc_feature (144)..(144): Xaa can be any naturally occurring amino acid
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKXSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 68935 - protein, 112 aa, Glycine max
  misc_feature (23)..(23): Xaa can be any naturally occurring amino acid
  misc_feature (51)..(51): Xaa can be any naturally occurring amino acid
PLKLFLDLPNHYAQTYIAFTPYXQLYLTGTSVERDSITLLLLYFFYRIKFXLYLKVCILPTLFFVHCSCHTKLYHIFSTTGYKILICTYILYYPYLKLNINLCINFSFTHLK

SEQ ID NO: 68936 - protein, 421 aa, Brucella melitensis 16M
MTTENLLESALVRLDEAASHINIDADVIEKLKFARETMKVRLMIRMDDGSRKSFIAWRCRYDDTRGPTKGGIRYHPDSTVEEVETPAFWMTFKCAVMNLPYGGGKGAIQVDPRQLSKAELERLSRAYIQAFSGIIGPDRDIPAPDVYTNSMIMGWMADEYSQIVGQSSPAVITGKPIALGGSLGRNDATARGGFYLVRHLSHDLGLASVLRVAIQGFGNAGQFMAKLMAGDGHKIVAVSDSAGAVYCADGLDVDLLLAAKADGKSVISTAGHKGHEAISADELVAADCDVLVPSAMENMIHAGNAASIRAKLIVELANGPVTGDADKILAEKGVMVLPDILANAGGVTVSYFEWVQNRQGYYWTLEEIHERLKTIMEREGRAIWNHARERGVTLRTAAYVHALERLAQAIEAHGTQNDFAA

SEQ ID NO: 68937 - protein, 115 aa, Glycine max
KRSETLRKWNERWVILDPTTGRMEYKIRRNEPSVKGTIIFDANSTITISPVNFHGLPKYDGCCFCILFVAFTTYESSGCSKLMEVTLLVTLIAFFRYWDTTEKGLLPLCRDSWCS

SEQ ID NO: 68938 - protein, 319 aa, Yersinia pestis KIM
MSKIVSLGIHVLDVLGRHVNRFPPGGELDIINEIRLTVAGTAAGMSVDLAKLGGDVYAMGAVGLDESGNFIIDTLRRYGGNTDHIVRKSEVQTSCSMLPIRPNGERPVLHVLGANATYRLEDIHWDVIASADILHFGGTYLLPGLDGPPTATILKFAKEHGVTTTLDLLVNAQPDLLAKLEPALPYIDYFMPGLDEARAICGLEKRADVIAFFLNRGVGHTVFKMGAEGSSIASLEMAEILIPAYKAQVVDSTGCGDSYCAAFIMGLTKGWDLATSGRFASAAASLVVSGLGSDAGIIDFEHTLKVMNTAETLPIAQET

SEQ ID NO: 68939 - protein, 386 aa, Zea mays
  misc_feature (170)..(170): Xaa can be any naturally occurring amino acid
  misc_feature (215)..(215): Xaa can be any naturally occurring amino acid
  misc_feature (246)..(246): Xaa can be any naturally occurring amino acid
  misc_feature (262)..(262): Xaa can be any naturally occurring amino acid
  misc_feature (300)..(300): Xaa can be any naturally occurring amino acid
  misc_feature (335)..(335): Xaa can be any naturally occurring amino acid
  misc_feature (351)..(351): Xaa can be any naturally occurring amino acid
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPXVAGFLMQKELDYLVGAVANPKKPFAAIVGGSKVSSKIGVIESLLXAKVDILILGGGMIYTFYKAQGYSVGKSLVEXEDKLELATSLIEKAKXRGVSLLLPTDIVVADKFAADAESKIVPATAIPDDWMGXLDVGPDATKTFNEALDTTKTVIWNGPMGVFEFEKXAAGTEAIAKKLAELTXTKGVTTIFGGGTLSLVPKRWLADKITTISPGGGEP

SEQ ID NO: 68940 - protein, 289 aa, Streptomyces aureofaciens
MRGIVLAGGSGTRLRPVTRVASKQLLPVYNKPMIYYPLSVLMHAGIREILIISSPGFLGSYRDLLGDGRWLGLEISYAEQPSPDGLADALRIGRHFAGDDTIALILGDNIFYSHQLPAMLQGERQRLDGCTLFGYPVADPERYGIAVTDADGTLLSLEEKPEKPRSNLAVTGLYFYDNDAVDLVRGLTPSARGELEITDLNALYLTAGRARLVNLGRGSAWFDTGTHDSLLDAATFVQLIEKRQGIRIACIEEVAYRMGFIDADQLFEIGRRTGMSTEYGRYVIDLAGT

SEQ ID NO: 68941 - protein, 349 aa, Zea mays
MAAPAADEAWCRKTVPRVMELVCRRLPQRDACALLAVSPWCYRALVANSRLWEVLDLREMKNAGNRLISALSLARYRHLKVLNLEFAQDIEDRYLVHLKEMSGISLENLEFLNLNACQKISDKGIEAVTSLCPNLQRLAIYWIVGLTDSSIGHITKNCKHLVHLNLSGCKNITDKGMQLIANNYQGLKRLNITRCVKLTDDGLNQVLLKCSSLESLNLYALSSFTDSVYREIGSLSNLTFLDLCGAQNLTDDGLACISRCGRLTYLNLTWCVRVTDAGILAIAQGCRALELLSLFGIVGVTDACLEALSKSCSSSLTTLDVNGCIGIKRRSRDDLLKLFPSLSCFKVHS

SEQ ID NO: 68942 - protein, 98 aa, Arabidopsis thaliana
RYFTYSATDAKRSARDSHVPILAPLPIGFAVFLVHLATIPITGTGINPARSLGAAIIYNKDHAWDDHWIFWVGPFIGAALAALYHQLVIRAIPFKSRS

SEQ ID NO: 68943 - protein, 341 aa, Parvularcula bermudensis HTCC2503
MKALVKAHAEPGIWLQTVPEPEIGATDVLIKVKKTAICGTDIHIYEWDDWAQSTIPVPLTIGHEFMGEVVAVGSDVTNVALGDRVSAEGHITCGVCRNCRAGKRHLCRNALGLGVSRAGAFAEFVAVPAFNIYHLPDAVSDELGAIFDPFGNAVHTALSYDLVGEDVLITGAGPIGAMAAAIARFVGARHIVVTDINDFRLDLAAQMGATRTVNIGREALPDVMAELGMTEGFDVGLEMSGAAAGFRDMLDTMNHGGKIALLGLLPKGTGIDWSKVIFKGLDLKGIYGRRLFETWYKMGALTQSGLDLSPIITHRLPIEDFENGFEIMRSGRSGKIVLEWP

SEQ ID NO: 68944 - protein, 480 aa, Oryza sativa
MAAPQASPSPSAQVVGNAFVQQYYQILHQSPDLVYRFYQDASRLGRPPADRYGDMVSVTTMEAINEKIMAMDMSRAEIKTVDSQESLGGGVTVLVTGHLTVRDGVCREFSQSFFLAPQEKGYFVLNDMFRYVGDGPTPAAAAAAEVQPEADAVAPPLANGTATAPLQPAAPDYDAMPHEEPDVVENVAVPPEEEEEVYNPPLEEVEGGAVEEEQSVPEVINEVPNNVVPVVAPAAAPVSHEEAPKKSYASIVKVMKEAPVPAPIPATRPAPAARPAPPKPEKQSPAPPAPAPVADATPFSSNAESSNTHEPEVDAHAIYVRSLPLNATTTQLEDEFKKFGTIKPDGIQVRSHKIQGFCYGFVEFEEATAVQSAIEASPVMIGGRQCFVEEKRTPGSRGSSRGGRFAPGRGNNNFRADGMRGRGNYSGGRSYGRGDFSYRSDYGGRGGGRGGSARGPDVGYQRVDGGRGGRTSAGPGAPAK

SEQ ID NO: 68945 - protein, 617 aa, Candida albicans SC5314
MSEQAQTQVSADQQQHQHNHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSAGVILYVMLCGRLPFDDEFIPALFKKISNGVYTLPNYLSAGAKHLLTRMLVVNPLNRITIHEIMEDEWFKQDMPDYLLPPDLSKNKNSKIDVDEDVIRALSVTMGYDRDEIVNVIEKANKQVAAGNSSSQQSKSSNEILDAYLLMKENHALVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVDFKFDGWESAHGNAGTDSPQSHRQQDLDEVGSFSAYPFLHLATRLIMELAVNSQSG

SEQ ID NO: 68946 - protein, 233 aa, Zea mays
MGEEASCDAVSLTEAGTNAKPVGKENGREPAAAPAAAADPRLQGISDAIRVVPHFPKQGIMFNDITTLLLRPRVFKDAVDLFVERYRGMGIDAVAGIEARGFVFGPAIALAIGAKFIPLRKPRKLPESCADTGSRKQLLLLLLEGEVISEKYVLEYGTDCLEMRVGAIERSGERVLVIDDLVATGGTLCAAIRLLERAGADVVECACVIGLPKFKWRDDMDKDKYIRCITKSW

SEQ ID NO: 68947 - protein, 471 aa, Vibrio sp. Ex25
MCPLFISPEDIPVSKQTFDQVGLNPALLATLDSLNYTHMTPIQALSLPAILKHRDVIGQGKTGSGKTAAFGLGVLSNLNVKRFRVQSLVLCPTRELADQVAKEIRTLGRGIHNIKVLTLCGGMPMGPQIGSLEHGAHILVGTPGRILDHLEKGRINLSELNTLVLDEADRMLDMGFQDALDAIIDAAPKQRQTLLFSATFPEKIEQIAQRIMQTPEVIKVESTHDTSSIAQHFYKVEGSEARDEALANLLLTHQPESAVVFCNTKKEVQSVADELHRKGFSVIDIHGDLEQRERDQALVQFANKSVSILVATDVAARGLDVDNLDAVFNFELSRDPEVHVHRIGRTGRAGSKGLAFSFFGEKDGLRVARIEEYLEMDVVPATLPAKSNQQPYQAKMVTINIDGGKKQKVRPGDILGCLTGKNGIPGSQVGKIHLFPMRAYVAVEKSAAKKALQTISNGKMKGRQFRARLLK

SEQ ID NO: 68948 - protein, 504 aa, Sinorhizobium meliloti 1021
MVMTVVVRPKALGDYDTREFRMLIDGQWVDGAEGRTIERVAPGHGVVVSRYQAAAKADAERAIAAARRAFDEGPWPRMTASERSLILLRAADMIAARADELAFLDAVESGKPISQAKGELAGAADIWRYAAALARELSGESYNTLGEGTLGVVLREPIGVVSIITPWNFPFLIVSQKLPFALAAGCTTVVKPSELTSASTLVLGEILEAAGVPQGVVNIIVGTGPEAGAPLTTHPHVDMVSFTGSTGIGQLTMANAAQTLKKVSLELGGKNPQIVFPDANLDEFIDAAVFGAYFNAGECCNAGSRLILHRDIAEEVTARIASLSAKVKVGDPLDPETQVGAIITPQHLQKIAGYVSSASNEGARIAHGGTTLDLGMGQFMAPTILSAVRPEMAVAREEVFGPVLSVLTFEKTEEAIRIANSIDYGLSAGVWSRDFDTCLTIGRRVRAGTVWMNTFMDGASELPFGGYRQSGLGRELGRHAVEDYTETKTLNMHIGRRSNWWMPR

SEQ ID NO: 68949 - protein, 458 aa, Anabaena variabilis ATCC 29413
MTFDYDLFVIGAGSGGLAASKRAASYGAKVAIAENDLVGGTCVIRGCVPKKLMVYGSHFPALFEDAAGYGWQVGKAELNWEHFITSIDKEVRRLSQLHISFLEKAGVELISGRATLVDTHTVEVGDRKYTADKILIAVGGRPLKPELPGMEYGITSNEIFHLKTQPKHIAIIGSGYIGTEFAGIMRGLGSEVTQITRGDKILKGFDEDIRTEIQDGMTNHGIRIIPNTVVTAVEQVPDGLKINLSGDQEPIIADVFLVATGRVPNVDGLGLENAGVDVVASSVEGPGYSTMNAIAVNEYSQTSQPNIYAVGDVTDRLNLTPVAIGEGRAFADSEFGNNRREFSHETVPTAVFSNPQASTVGLTETQAREKLGDEGVTIYRTRFRPMYHSFTGKQERIMMKLVVDTNTDKVLGAHMVGENAAEIIQGVAIAVKMGATKKDFDATVGIHPSAAEEFVTMR

SEQ ID NO: 68950 - protein, 736 aa, Vitis vinifera
MEVKLSFPADHPPLYVIATAKVAGIPISEDSSLASGSLPTFLISSNDNEFKLRGTSINALLRYLGRVASIPNFYGQDAFESCQIDEWLEYAPTFSTGSEFENACCYVDGILLQRTFLVGYSLSIADIAIWSGLAGSGQRWESLRKSKKYQNLVRWFNSIYAEYNTVLNEVTGTYVGKRGLGKPMPAKMKEKEQQGINNHMKNVSGDANEKGKASSKATAEVDLPDAEVGNVRLRFAPEPSGYLHIGHSKAALMNQYFAQRYRGQLIVRFDDTNPAKESNEFVENLLKDIETLGIKYDAVTYTSDYFPQLMEMAENLICNGKAYVDDTPREQMQKERMDGIESKCRNNSPQENMELWKEMIAGSERGLMCCLRGKLDMQDPNKSLRDPVYYRCNPLPHHRIGSKYKLYPTYDFACPFVDAKEGITHALRSSEYHDRNAQYHRIQEDMGVKKVHIYEFSRLNMVYTLLSKRKLLWFVQNGKVDGWDDPRFPTVQGIVRRGLKIDALIQFILEQGASKNLNLMEWDKLWTINKKIIDPVCPRHTAVIDEKRVLVTLADGPEKPFVRIIPRHKKFEGAGEKCTTYTKRIWIDYADAVSISENEEITLMDWGNAIIKEIRKDQDGNIMQLIGVLHLEGSVKATKLKLTWLPETSELVNLSLMEFDYLITKKKLDEGDDFLDALNPCTKRETAAVGDSNIRNLKRGEIVQLERKGYYRCDAPFIRPSKPVVLFAIPDGRQQK

SEQ ID NO: 68951 - protein, 459 aa, Zea mays
MKRPALVGPVRSSDLVMCLATLSLHTHTQDTTQLVGSERLSSSSPTHRAKEDSERSTLLFSPSVVRLTALLERDLAAVPRDLVTDLSDKMVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGRKAVQALKDVYAHWVPEDRILTTNLWSAELSKLAVLGFAFKKDTGDTRETPAIDVCKGLLGDKAQISIYDPQVTEDQIQRDLAMNKFDWDHPMHLQPTSPTAIKQVSCVWDAYEATKGAHGVCILTEWDEFKTLDYQKIFDNMQKPAFVFDGRNIVDPEKLREIGFIVYSIGKPLDAWLKDMPAVA

SEQ ID NO: 68952 - protein, 168 aa, Ralstonia metallidurans CH34
MIAIGQRVPDATLYEFFETESEGCVLGPNAFSVAELVKGRKIVVFGLPGAFTPTCSAKHVPSYLKEYDALRAAGVDEIWCHSVNDAFVMGAWGREQKATGKVRMMGDGAAQWARALGLDQDLSQRGLGVRAKRYAMVVDDGVVTHLFIEEPGEFKVSSAEWVLQALRA

SEQ ID NO: 68953 - protein, 290 aa, Acinetobacter sp. ADP1
MRIGFIGLGAMGWHMAGHLTQLDATVMVWNRTQHKAEAHAMQFGSLAVELEQLVQADLIFSCLPTSAEVEAVIAAYPPRSGSVWIDCTSGVPASAQQLSRHLKQHGVDFLDAPVSGQTIGAEKGTLTVMIGGERTAFERAQPIIQAFAGLIEHVGDSGAGFAVKAVNNILMAANLWALSEGMSVLKAHAVHLDAALACINHSSGKSTMSETIMPQKILSRGFHKTFALNLLQKDIGIAIDLIKAVGQPADVLHCVQQMYSEMDLERATQVDFSAAIQTLEQRNQLLLDLA

SEQ ID NO: 68954 - protein, 275 aa, Triticum aestivum
FISEVSTIGNIHHVNVVRLVGFCSEEMRRALVYEYMPRGSLDKYIFSAEKSFSWDKLNEIALGIARGIDYLHQGCELQILHFDIKPHNILLDNNFIPKVADFGLAKLYPRDNSFVPSRALRGTIGYIAPEMISRSFGAISSKSDVYSFGMLLLEMAGGRRNADPNAANSSQAYYPSWVYDRLTEPEVDEISPATEMHELERKLCIVGLWCIQMRSHDRPMMSEVIEMLEDSVDGLQMPSRPFFCDEGHTHTDDTYHLSSELTEISEEDMSESIDV

SEQ ID NO: 68955 - protein, 868 aa, Alonsoa meridionalis
MAPPYDPIPIPIPMSAILNFLSSTVKDNSFELLDGTLSVKNVPILTDIPSNVSFSSFSSIVQSSEAPVPLFQRAQSLSSSGGFLGFSQNEPSSRLMNSLGKFTDRDFVSIFRFKTWWSTQWVGTTGSDIQMETQWIMLDVPEIKSYAVVVPIVEGKFRSALFPGKDGHILIGAESGSTKVKTSNFDAIAYVHVSENPYTLMRDAYTAVRVHLNTFKLIEEKSAPPLVNKFGWWTWDAFYLTVEPAGIYHGVQEFADGGLTPRFLIIDDGWQSINNDDNDPNEDAKNLVLGGTQMTARLHRLDECEKFRKYKGGSMSGPNRPPFDPKKPKLLISKAIEIEVAEKARDKAAQSGVTDLARYEAEIEKLTKELDQMFGGGGEETSSGKSCSSCSCKSDNFGMKAFTKDLRTNFKGLDDIYVWHALAGAWGGVRPGATHLNAKIVPTNLSPGLDGTMTDLAVVKIIEGSTGLVDPDQAEDFYDSMHSYLSSVGITGVKVDVIHTLEYISEDYGGRVELAKAYYKGLSKSLAKNFNGTGLISSMQQCNDFFLLGTEQISMGRVGDDFWFQDPNGDPMGVYWLQGVHMIHCAYNSMWMGQFIQPDWDMFQSDHPGGYFHAGSRAICGGPVYVSDSLGGHNFDLLKKLVFNDGTIPKCIHFALPTRDCLFKNPLFDSKTILKIWNFNKYGGVIGAFNCQGAGWDPKEQRIKGYSQCYKPLSGSVHVSGIEFDQKKEASEMGEAEEYAVYLSEAEKLSLATRDSDPIKITIQSSTFEIFSFVPIKKLGEGVKFAPIGLTNLFNAGGTIQGLVYNEGIAKIEVKGDGKFLAYSSVVPKKAYVNGAEKVFAWSGNGKLELDITWYEECGGISNVTFVY

SEQ ID NO: 68956 - protein, 424 aa, Staphylococcus aureus subsp. aureus MW2
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTFTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVNTRNHYKNSFKNKEGYNLTFFAFFVKAVADALKAYPLLNSSWQGNEIVLHKDINISIAVADENKLYVPVIKHADEKSIKGIAREINTLATKARNKQLTAEDMQGGTFTVNNTGTFGSVSSMGIINHPQAAILQVESIVKKPVVINDMIAIRNMVNLCISIDHRILDGLQTGKFMNHIKQRIEQYTLENTNIY

SEQ ID NO: 68957 - protein, 282 aa, Leccinum talamancae
  misc_feature (145)..(166): Xaa can be any naturally occurring amino acid
LENQEINIVAVNDPFIDLAYMVYMFKYDSVHGRFKGDVRAEDGKLVINGKSITVYAERDPANIKWGAVGADYIVESTGVFTTTEKAAAHLKGGAKKVIISAPSADAPMFVCGVNLDKYDSKYTVISNASCTTNCLAPLAKVINDXXXXXXXXXXXXXXXXXXXXXXDGPSAKDWRGGRAVNGNIIPSSTGAAKAVGKVIPALNGKLTGLAFRVPTNDVSVVDLVVRLEKSATYDEIKAAVRAASASPDLKGIIDYTDEAVVSTDFTGNPASSIFDASGGIML

SEQ ID NO: 68958 - protein, 333 aa, Triticum aestivum
MARFLRPSNCIAYLLLLLAFCCCGTEQRRVEASNRLTQHPRILTTVSVMKPSYPTITTPTSASYAMPASSRFPSLADANDGGDVGGGGIGGGGAAGGATGGGGTTGGGVGGGGATGGGAVGGVGGGGAAGGIGGGGGGGGGGTWCVASQSASTSALQVALDYACGYSGVDCSAIQTGGSCFNPDTIHDHASYAFNSYYQKNPLPTSCDFGGTATITTTNPSSGSCQYPASSGGAQGTMPPPSPTTLTPTTPMTPTPMTPFTPTPMTPDTPSTGTPMYGSNSPPDFGSMSPPGPGSNSPPDYSDVGGAPATAMGRATLALVSILAATLSMSLAT

SEQ ID NO: 68959 - protein, 245 aa, Leccinum crocipodium
NIVAVNDPFIDLAYMVYMFKFDSVHGRFKGDVHAKDGKLYINGKAITVYAERDPANIKWGDVGADYIVESTGVFTTTEKAAAHLKGGAKKVIISAPSADAPMFVCGVNLDKYDPKYTVISNASCTTNCLAPLAKVINDKFGIVEGLMSTIHATTATQKTVDGPSSKDWRGGRAVNGNIIPSSTGAAKAVGKVIPSLNGKLTGLAFRVPTNDVSVVDLVVRLEKSASYDDIKAAVKAASESPELKG

SEQ ID NO: 68960 - protein, 431 aa, Nostoc sp. PCC 7120
MLSIPINQHLPYTPRLVTSLPGPRAKAIVERDRAVTSPSYTRDYPLVVNRGEGCMVEDVDGNVFLDMTAGIAVTSTGHAHPEVVRAIQEQSARLIHMSGTDFYYEPMVELAENLASQAPFVHDTKVFFTNSGAESNEGAIKLARYYTKRSLIIAFLGAFHGRTYGAMSLTGSKTVQRANFGPLVPGVTHIPYGTHASLDYLENNLLTTIIPAHEVAAIVVEPIQGEGGYIVPEDGFLQRIRNICDRYGILMVVDEVQSGMGRTGRLFAIEHWNVTPDIITTAKGIASGMPLGAILARAELMTWPPGSHATTFGGNPVACAAGIVTLKLLESGLMDNATQMGELLQTGLTQLHEQFPRMSLPRGKGLMVAVDLLDEDGNFDSTLRDRIIQEAFYHGLLLLGCGKAAIRFCPPLVINREQIQTSLDILAGILR

SEQ ID NO: 68961 - protein, 382 aa, Shigella flexneri 2a str. 2457T
MFKSDAARTRQRLSARKGRTLPPGRGKFPHSTTESFRNTFWLKKIMEHCFNMVDQQTTTAQTNANFLQIRFTTMSKKIAVIGECMIELSEKGADVKRGFGGDTLNTSVYIARQVDPAALTVHYVTALGTDSFSQQMLDAWHGENVDTSLTQRMENRLPGLYYIETDSTGERTFYYWRNEAAAKFWLASEQSAAICEELANFDYLYLSGISLAILSPTSREKLLSLLRECRAKGGKVIFDNNYRPRLWASKEETQQVYQQMLECTDIAFLTLDDEDALWGQQPVEDVIARTHNAGVKEVVVKRGADSCLVSIAGEALVDVPAVKLPKEKVIDTTAAGDSFSAGYLAVRLTGGSAENAAKRGHLTASTVIQYRGAIIPREAMPA

SEQ ID NO: 68962 - protein, 202 aa, Zea mays
  misc_feature (32)..(32): Xaa can be any naturally occurring amino acid
ADYVSSDQDLLRCRVRTSGIFETKFQVDKVNXFHMCDVGGQRDERRKWIQCFNDVTAIIFVVASSSYNMVIREDNQTNRLQEALNLFKSIWINRWLRTISVILFLNKQDLLAEKVLAGKSKIVDYFPEFARYTTPEDATPEPGEDPRVARAKYFIRDEFLRISTASGDGRHYCYPHFTCAVDTENIRRVFNDCRDIIQRMHL

SEQ ID NO: 68963 - protein, 313 aa, Nostoc sp. PCC 7120
MTPRTALNLFSLLWQNYSARVTYARTYQQMITSAGGTVANDHIAFRSLRLSIDRPQGKVNLGIGYLSQIAEALGYEPAGEYIFPQTHLYALHYRHPQQAEFDLPKLFISELIVDELPDKIAQLIVQTVSTIPDNFTSPVKYFHQEKGNDEVIAQQLQKVFTRPWLTPRRSVVEEVNNITQYGAWVLLHGYAVNHFTGYVNRHQTPEYADIDHTARGLANLGVPMKAEIEGDVTWGLRQTATQAVKEMVTVIDDISGQEVEIPWTYAYYEVAQRYPLQVEPGKEALFDGFLGNNAQQLFEMTRLAECDTARIGK

SEQ ID NO: 68964 - protein, 355 aa, Haloarcula marismortui ATCC 43049
MRAAVLEAYGEPLAVRDRDPPTPNPDGAVVAVEACGICRSDWHAWQGHGDWADDDVPIGQVLGHEPAGRVTATGNQVTTVSVGDRVVVPFNLGDGTCGYCRNGHGNVCTDGWALGFESDAPGAFAEQVAVPQADYNLVGLPDGVSSDAAAALGCRYVTAFHALAHRADIAAGDRVAVHGCGGLGLAAVQIASALGASVIAVDIRDEPLAMARDAGASTVVDASAVEDVPAAIEGETDGGAEVSVDALGRAETCQNSVRSLRPRGTHVQVGLTTNAERGEVALPTDWITRWDIDVLGSRGMPPSRYDELLRLVADGPLDPGALVTRRVALEAVSERLAAMTDYGTDGIELVTEFGR

SEQ ID NO: 68965 - protein, 328 aa, Picrophilus torridus DSM 9790
MKDFYDWQYSMRSKIAEINQRLLDSIQTDEKYLYDMARYTIEAGGKRFRPLLTILSFEIASGESYEKILDLAAGYELIHTASLIHDDIIDHSDMRRGRYTLSYKEGINNAIVVGDYLFAKAYELGSRYGKEVSKIMADASSNLAEGQILEAENIGNLNMNEETYLKIIENKTARFFAACALGATKAAGADFEISNRLSNFAYNMGMAFQITDDILDIIGNEKDMGKPAMVDLGHDVITLPIIYSLKNNYYNNKIRDILTGNYKSPDLKDKFKNIMMETGAIEYSFKVAKDYINKSVSYLSGIGRSRDLDLLMELAMIVIERIDEAGLM

SEQ ID NO: 68966 - protein, 370 aa, Sinorhizobium meliloti 1021
MTVRNLFLLPGDGIGPEAMAEVRKIIAYMNAERDAGFVTDEGLVGGSAYDAHGAAISEGDMAKALAADAVLFGAVGGPKWDAVPYEVRPEAGLLRLRKDLELFANLRPAICYPALANASSLKPELVEGLDILIVRELTGGVYFGEPKEIVDLGNGQKRGIDTQVYDTYEIERIAGVAFELARTRNNRVCSMEKRNVMKSGVLWNQVVTETHKAKYSDVQLEHMLADAGGMQLVRQPKQFDVIVTDNLFGDMLSDVAAMLTGSLGMLPSASLGAPDAKTGKRKALYEPVHGSAPDIAGTGVANPIAMIASFAMCLRYSFNLVKEADDLEKAIANVLDQGIRTGDIMAEGCRKVGTAEMGDAILAEFKSLSA

SEQ ID NO: 68967 - protein, 430 aa, Zea mays
MKPRAFLERLARPFSSSRRSSSDQSRRDREEEADLEAIAAREQRAFRYETLAAATRSFSEKNRLGQGGFGPVYRGRLEDGRDVAVKRLGAGSRQGAREFRNEATLLSRVQHRNVVNLIGYCARGAEDKLLVYEYVPNESLDKILFSSSSSARSSSNSDRSRRAELTWPRRHEVVVGVARGLLYLHEDAHTPIIHRDIKASNILLDDRWVPKIADFGMARLFPEAGDGHSRVHTRVAGTNGYMAPEYLMHGDLSTKADVFSFGVVVLEIVSGRKNSAFIPPPDAEADSLLEYAWRLYKKGRSLELLDHAVKSSAVPEQVELCVRIGLLCVQADPRLRPDMKRVVIILSKKQSTLEEPTRPGVPGSRYRRRPHGLRGTHYSAGSSSGTSLPSTSATSDASASASASVSNAMTTSSTHTMRSQGLPSHREEHE

SEQ ID NO: 68968 - protein, 169 aa, Triticum aestivum
MAPTVMASSATAVAPFQGLKSTATLPVARRSTTSFAKVSNGGRIRCMQVWPAYGNKKFETLSYLPPLTEEQLLKQVDYLLRNNWVPCLEFSKEGFVYRENSTSPCYYDGRYWTMWKLPMFGCTDASQVYKELQEAIASYPDAYVRILGFDNIKQTQCVSFIAYKPAGSE

SEQ ID NO: 68969 - protein, 194 aa, Haloarcula marismortui ATCC 43049
MVELVGLAAGATLTLIVVALHYAKGTGWEAPEDISQEVLEQRAATVPETDFAEPYNRSIGGGGAVAIPAGEAEGELGEGEAVEEEDEGFDPDDIADDEVEYYEIEFAKEGETIEVANNETILDAGEEEGWDLPYACREGQCISCAGHIEDGPATDHIRHSNNDSLMDDDMEEGYCLTCVAYPTSEFTIETGESP

SEQ ID NO: 68970 - protein, 521 aa, Fragaria x ananassa
MASSSMAANGVPTLRLSTSNIATNQTQKTNRGLSFSGSHLSGTKIPTPATCLRTCSPSPSTRRAPLVVSPKAVSDSKNSETCLDPDASRSVLGIILGGDGRTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQCLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPYIASMGIYVVSKNVMLDLLREKFPGANDFGSEVIPGATSIGLRVQAYLYDGYWEDIGTIEAFYNANLGITKKPIPDFSFYDSSSPIYTQPRYLPPSKMLDADITDSVIGEGCVIKNCKIHHSVIGLRSCISEGAVIEDTLLMGADYYETDVDRRLMAKKGSVPIGIGKNSHIKRAIIDKNARIGDNVKIIKSDNVQETARETDGYFIKSGIVTVIKDAWIPSGTVI

SEQ ID NO: 68971 - protein, 299 aa, Haloarcula marismortui ATCC 43049
MELGVIGLGRMGRIVVDRVLEAGHEVVVFDIDEESVADAADAGARPASSIADLAGKLGSEKRIWLMVPAGDPVDAALDELAPTLDSDDVVVDGGNSYFEDSVRRAESTDAAYLDCGTSGGPAGADLGFSLMVGGPEWAYDELVPVFDAVATGPDGHDRMGPAGSGHYVKMIHNGVEYALMQTYGEGFELLANGRYDLDLESVANTWNNGAVIRSWLLELCEEAFREEGNDLGDVADRVEGGSTGTWTVQEALEQEVPVPLIYQSLAERFGSRADDGRFARRLASRLRYGFGRHEVPRRE

SEQ ID NO: 68972 - protein, 507 aa, Fragaria x ananassa
MDSWCVTLKPNTHLRQPTQAGLCCGANGFLGQRIRESFGNRGWVHGSEKTRPGVVSSVVTTKDFETTLKVPTYHRPRVDPKNVASIILGGGAFTQLFPLTRRAATPAVPVGGCYRLIDIPMSNCINSNINKIFVLTQFNSTSLNRHLARTYFGNGINFGDGFVEVLAATQTSGEAGMDWFQGTADAVRQFVWVFEDAKNRNVENILILSGDHLYRMDYMDFVQSHVDSNADITLSCAVVGDSRASDYGLVKIDSRGKIIQFAEKPRGAGLKAMQSDTTLLGFSPQDALKSPYVASMGVYVFKTDILLELLKKSYPNSNDFGSEIIPAAVEERNVQAYIFIDYWEDIGTIQSFYDANLALTEEFPKFQFYDPKTPFFTSPRFLPPTKIDNSRVVDAIISHGCFLQECFVQSSIVGERSRLDYGVELKDSIMMGADSYQTESEIAALLARGKVPIGIGRNTKIRLCIVDLNAKIGKDVIIMNKDGIQEADRPEEGFYIREESLSLWRRE

SEQ ID NO: 68973 - protein, 469 aa, Vitis vinifera
MERKQGFFSALKQEVVRGLSPGRSRARCESPMSRLRRRSKKQNQVPQPDLLIGRSGNLRPVETLSPLMEGPDPEGSECGDSRVEGGWGQWMKGQLSRAPSVSSSAYKGSDDLRLLLGVMGAPLAPVHVSSTDPLPHLSIKNTPIETSSAQYILQQYTAASGGQKLQSSIHNAYAMGKVKMLAAEFETANKVIKTRNSSKAAEGGFVLWQMNPDMWYVELALGGSKVHAGSNGNLVWRHTPWLGAHAAKGPVRPLRRALQGLDPRTTASMFTNARCIGEKRINGDDCFILKLCADPVTLKARSEGPAEIIRHVLLGYFSQKTGLLVHLEDSHLTRIQTNGGDAAYWETTINSFLDDYRPVEGIMIAHSGRSVVTLFRFGETAMSHTKTKMEEAWSIEEVAFNVPGLSLDCFIPPAELRFGSVSESCEFPQGERVKTAVAAAAAAAYRAKVAALEKSHESNVNKIIWKMDV

SEQ ID NO: 68974 - protein, 364 aa, Picea sitchensis
MTGRTLSGNSYYGKYSEELIATANYIATPGKGILAADESTGTIGKRLSSINVENVEVNRRSLRELLFTTPGALQYLSGVIFFEETLYQSTASGKPFVEVLQEAGVVPGIKVDKGTVDLAATNGETTTQGLDGLAQRCQQYYKAGARFAKWRAVLKIGPTEPSELSIEQNAQGLARYAIICQENGLVPIVEPEILTDGSHDIHKCAAVTENVVAAVYKALNDHHVLLEGTLLKPNMVSPGTDGPKVPPEEIAEHTVRALQRTVPAAVPGIVFLSGGQSEEEATLNLNAINACKTKKPWTLSFSFGRALQQSTLKTWAGKAENLGAAQKAFLARCKANSEATLGKYAGGAGAGLATESLHVKDYKY

SEQ ID NO: 68975 - protein, 132 aa, Helicobacter pylori
SNIKYELDKESGVLMVDRVLYGAQNYPANYGFVPNTLGSDGDPVDALVLSDVAFQAGSVVKARLVGVLNMEDESGMDEKLIALPIDKIDPTHSYVKDIDDLSKHTLDKIKHFFETYKDLEPNKWVKVKGFEN

SEQ ID NO: 68976 - protein, 353 aa, Fragaria x ananassa
VEVLAATQTPGESGKKWFQGTADAVRQFHWLFEDARSKDIEDVLILSGDHLYRMDYMDYIQNHRQSGADITISCLPMDDSRASDFGLMKIDKKGKVLSFSEKPKGNDLKAMAVDTTVLGLSVEEALKKPYIASMGVYVFKKEILLNLLRWRFPTANDFGSEIIPASANEFFMKAYLFNDYWEDIGTIRSFFEANLALTEHPNKFSFYDAAKPMYTSRRNLPPSKIDGSKIVDSIISHGSFLTDCLIEHSVVGIRSRINTNVHLKDTVMLGADYYETDSEVLSLLAEGRVPVGIGENTKIKDCIIDKNARIGNNVVIANTEGVQEADRSSEGFYIRSGVTVILKNSTIEDGLSI

SEQ ID NO: 68977 - protein, 430 aa, Nostoc sp. PCC 7120
MSIHEIFMPALSSTMTEGKIVSWVKSPGDKVEKGETVVVVESDKADMDVETFYEGFLAHIIVEAGDSAPVGAAIAYVAETEAEIEAAKSLGSSGAAAATPPAAPQPVATTAAVGVPATSQNGSNHREGRLIASPRARKLAKELKVDLTSLKGSGPYGRIVADDIESAVGKVKQPATTPSAPTPTFTPAAPPAPRTPAPAPAPIAAAPGQVVPFNTLQNAVIRNMVASLDVPVFRVGYTITTDGLDKLYKQIKSKGVTMTALLAKAVAVTLQKHPLLNASYSDQGLVYHPDINVAVAVAMDGGGLITPVLKNADKIDIYSLSRTWKSLVDKARSKQLQPDEYTGGNFTLSNLGMFGVDTFDAILPPGQGSILAIGASRPQLVATGDGLFGVKQQMQVNITSDHRIIYGADAAAFLQDLAKLIETDAQSLTL

SEQ ID NO: 68978 - protein, 486 aa, Comamonas sp. JS765
MLAKQILNFINGEFVATGKWFDNRTPISNAVIGQVAEAGQAEVDAAVAAARAALKGPWGSMTLAQRVELLEALVAEITRRFDEFLEAECADTGKPRSLASHIDIPRGAANFKVFADVVKNVPTEFFEMATPDGRGAINYGYRKPVGVVGVICPWNLPLLLMTWKVGPALACGNTVVVKPSEETPRTAALLGEVMNHVGIPKGVYNVVHGFGPGSAGEFVTSHPGIDAITFTGETRTGEVIMKAAAKGARPVSLEMGGKNAAIVFADCDFDAAIEGTLRSAFVNCGQVCLGTERVYVERPIFDKFVAALKQQVEGWKIGVPEGADTQLGPLISKEHQAKVLSYYQLAVQEGATVVTGGGVPDMPGELKDGCWVQPTIWTGLPETARVIKEEIFGPCCHIAPFDTEDEVLAKANDNEYGLATAIWTRDLSRAHRVAQRMEVGISWVNSWFLRDLRTPFGGSKQSGIGREGGVHSLEFYTELKNVCIKL

SEQ ID NO: 68979 - protein, 249 aa, Leccinum carpini
  misc_feature (245)..(245): Xaa can be any naturally occurring amino acid
IVAVNDPFIDLAYMVYMFKFDSVHGRFKGDVHAKDGKLYINGKAITVYAERDPANIKWGDVGAEYIVESTGVFTTTEKAAAHLKGGAKKVIISAPSADAPMFVCGVNLDKYDPKYTVISNASCTTNCLAPLAKVINDKFGIVEGLMSTIHATTATQKTVDGPSSKDWRGGRAVNGNIIPSSTGAAKAVGKVIPALNGKLTGLAFRVPTNDVSVVDLVVRLEKSASYDDIKAAVKAASESPDLKGXVAYT

SEQ ID NO: 68980 - protein, 251 aa, Leccinum uliginosum
  misc_feature (143)..(144): Xaa can be any naturally occurring amino acid
INIVAVNDPFINLDYMVYMFKYDSVHGRFKGDVHAKDGKLYINGKAITVYAERDPANIKWGAVGAEYIVESTGVFTTIEKAAAHLKGGAKKVIISAPSADAPMFVCGVNLDKYDPKYTVISNASCTTNCLAPLAKVINDKFGXXEGLMSTIHATTATQKTVDGPSAKDWRGGRAVNGNIIPSSTGAAKAVGKVIPTLNGKLTGLAFRVPTNDVSVVDLVVRLEKSASYDDIKAAVKAASESPELKGIVAYT

SEQ ID NO: 68981 - protein, 132 aa, Helicobacter pylori
SNIKYELDKESGALMVDRVLYGAQNYPANYGFVPNTLGSDGDPVDALVLSDVAFQAGSVVKARLVGILNMEDESGMDEKLLALPIDKIDPTHSYVKDIDDLSKHTLDKIKHFFETYKDLEPNKWVKVKGFEN

SEQ ID NO: 68982 - protein, 276 aa, Leccinum duriusculum
  misc_feature (143)..(152): Xaa can be any naturally occurring amino acid
  misc_feature (177)..(177): Xaa can be any naturally occurring amino acid
INIVAVNDPFINLDYMVYMFKYDSVHGRFKGDVHAKDGKLYINGKAITVYAERDPANIKWGAVGAEYIVESTGVFTTIEKAAAHLKGGAKKVIISAPSADAPMFVCGVNLDKYDPKYTVISNASCTTNCLAPLAKVINDKFGXXXXXXXXXXATTATQKTVDGPSAKDWRGGRAVNXNIIPSSTGAAKAVGKVIPTLNGKLTGLAFRVPTNDVSVVDLVVRLEKSASYDDIKAAVKAASESPELKGIIDYTDEAVVSTDFTGNPASSIFDASGGSM

SEQ ID NO: 68983 - protein, 238 aa, Leccinum monticola
INVVAVNDPFIDLDYMVYMFKYDSVHGRFKGDVHAKEGKLYINGNAITVYAERDPANIKWGAVGADYVVESTGVFTTIEKAAAHLKGGAKKVIISAPSADAPMFVCGVNLDKYDPKYTVISNASCTTNCLAPLAKVINDKFGISEGLMSTIHATTATQKTVDGPSAKDWRGGRAVNGNIIPSSTGAAKAVGKVIPALNGKLTGLAFRVPTNNVSVVDLVVRLEKSASYDEIKLAVKEA

SEQ ID NO: 68984 - protein, 339 aa, Solibacter usitatus Ellin6076
MRAAFFEGNRTLRVGDCAEVAPGAGQVQINVEFCGICGTDLHLFHGAMAHRLTLPHVMGHEMSGTLAAVGEGVAGWQAGDRVTVRPLDPCGTCPACRMGHSHICHNLKFIGIDTPGALQGMWTVPAHTLHRLPDSLSLREGAMVEPIAVACHDVRMSELQAGEFAVVIGGGPIGILIALVAKARGARVLQAEVNPFRLQLARDLGIDAVNPAETDLPALVNQHTAGAGADVVFEVSGSSAGCEMMTRLPRTRGRIVVVAIYAEPQKVDLFRFFWRELRLAGARVYEPEDFDGAIALAASGKLPLDRLITDVLPLSRLEEAMHRMERGGDCMKILVSCTD

SEQ ID NO: 68985 - protein, 477 aa, Brucella melitensis 16M
MTFHQNLIAGEWVGGDDIANINPSDTNDVVGTYARATAEDTKAAIAAAKAAFPAWSRSGILERHAILRKTADEILARKEELGRLLSREEGKTLVEGIGETIRASQIFDFFAGECLRLAGEVLPSARPGIGVEVTREPVGVVGIITPWNFPIAIPAWKIAPALCYGNTIVFKPAELVPGCSWAIADILHRAGLPKGVLNLVMGKGSVVGQTILDSADVNAATFTGSTGTGKRVAAASIEHNRRFQLEMGGKNPVVVLDDADLNVAVESVVNSAFFSTGQRCTASSRIIVTEGIHDKFVAAAIEKLKTVVVDNALKPGTHIGPVVDETQLQQDMDYIELGRKEGAKLAFGGERLNRETPGFYLQPALFTEATNQMRISREEIFGPVASVIRVKDYEEALATANDTSFGLSSGICTTSLKYATHFKRNSEAGMVMVNLPTAGVDFHVPFGGRKGSSFGPREQGRYAAEFYTTVKTAYTLA

SEQ ID NO: 68986 - protein, 373 aa, Brucella melitensis 16M
MWQPAVSSPASLMLVSSHSPGTMQVRQRRSNSMAKTMKAAVVRAFGKPLTIDEVPIPQPGPGQIQVAIQASGVCHTDLHAAEGDWPVKPNPPFIPGHEGVGFVSAVGSGVKHVKEGDRVGIPWLYTACGHCLGGWETLCEEQLNTGYSVNGGFAEYVVADPNFVGHLPKNIDFNEIAPVLCAGVTVYKGLKVTDTKPGDWVVISGIGGLGHMAVQYARAMGLNVAAVDIDDRKLDLARRLGATVTVNAKTVADPAAYIRKETDGGAQGVLVTAVSPKAFEQALGMVARGGTVSLNGLPPGDFPLSIFNMVLNGVTVRGSIVGTRLDLQESLDFAADGKVKATIQTGKLEDINAIFDDMRQGNIEGRIVMDLTQ

SEQ ID NO: 68987 - protein, 160 aa, Escherichia coli
  misc_feature (2)..(2): Xaa can be any naturally occurring amino acid
  misc_feature (106)..(106): Xaa can be any naturally occurring amino acid
  misc_feature (113)..(113): Xaa can be any naturally occurring amino acid
  misc_feature (125)..(125): Xaa can be any naturally occurring amino acid
EXRIGHGFDVHAFGGEGPIIIGGVRIPYEKGLLAHSDGDVALHALTDALLGAAALGDIGKLFPDTDPAFKGADSRELLREAWRRIQAKGYTLGNVDVTIIAQAPKXLPHIPQXRVFIAEDLGCHXDDVNVKATTTEKLGFTGRGEGIACEAVALLIKATK

SEQ ID NO: 68988 - protein, 546 aa, Oryza sativa
MDSCTANLMSRLSSIYSQHRTSGLRSDRSIMPNSTSNSLRTISSVHLPYNHRARNFHISHAVGDSSEHVIINGQASPSKVVQADAAALGTIAADMAPVVDGFSADDDELDLDSPTEGFSSIPEAIEDIRQGKYVIVVDDEDRENEGDLIMAASKVTPEAMAFIVRHGTGIVCVSMKEDDLERLELPLMVTTKENEEKLRTAFTVSVDAKEGTTTGVSAKDRANTVLALASPNSKPEDFNRPGHIFPLKYREGGVLKRAGHTEASVDLAMLAGLPPAAVLCEIVDDDDGSMALLPKLQDFARRENLKIISIADLIRYRRKRDRLVERVCVTPLQLQWGSFQSYCYRSLIDGMEHIAMVKGDVGDGQDILVRVHSECLTGDIFGSARCDCGNQLALAMTMIEKTGRGVVVYLRGHEGRGIGLGHKLRAYNLQDDGRDTVEANEDLGLPVDSREYGIGAQILRDLGVRTMRLMTNNPAKYTGLKGYGLSVLGRVPLLTPITNENRRYMETKRLKMGHVYGTRPSGNTSTLADGGIKKEQDQIDSASEQE

SEQ ID NO: 68989 - protein, 488 aa, Bordetella pertussis Tohama I
MGKITGFMEFQRLQEAAEAPQKRLKHWREFVLHLNDEQAKQQAARCMDCGIPFCSNGCPVNNIIPDWNDLVYRQDWRRALDVLHSTNNFPEFTGRICPAPCEAACTLNINSDAVGIKSIEHAIIDKGWAEGWVTPQVPVRKTGKKVAVVGSGPAGLACSQQLARAGHSVTLFEKSDRIGGLLRYGIPDFKLEKSQIDRRIAQMEAEGVEFAPSTYIGNPDDAAADGLTVRTPQSLLADFDAVVMTGGSETPRDLPVPGRELSGVYYAMDFLRQQNKAVAGDRLSGQTLAKDKHVVVIGGGDTGSDCVGTSNRHGAASVTQFELLPQPPECEDKPMVWPYWPLKLRTSSSHDEGCERDWSVATKALAGSDGQVEKLVGVRVEWFKDEATGQMKMREIEDSEFEIPADLVLLAMGFVSPVATVLDAFGVDRDARGNVRANTDDYRTNVDKVFAAGDMRRGQSLVVWAIREGRQCARSVDEYLMGASELPR

SEQ ID NO: 68990 - protein, 494 aa, Oceanobacter sp. RED65
MIETMQREWFSNIKNDLLAGTVVALALIPEAIAFSIIAGVDPKVGLYASFCIAVIIAFVGGRPGMISAATGAMALLMVTLVKEHGLQYLLAATLLTGVLQIAAGYLKLGSLMRFVSRSVVTGFVNALAILIFMAQLPELTDVTWHVYAMTAAGLGIIYLFPLIPGIGKSVPSPLVCIVSLTALSMIVGLDIRTVGDMGELPDTLPIFLWPDVPLNLETLMIIAPYSIGLAIVGLLESMMTATIVDDLTDTESDKNRECKGQGIANIGSGLLGGMAGCAMIGQSIINVKSGGRGRLSTFTAGLLLLIMVVFLDEWIGQIPMAALVAVMIMVSIGTFSWESVINLKKHPLSTNIVMVSTVAVVVATHNLALGVFVGVLLASLFFANKISRFMVVKSVNEDNKRVYQVTGQVFFASADKFVDAFDFKEAAEHVILDLSHAHLWDISAVSALDKVVIKFRREGANVEIIGMNEATATVVDKFAIHDDPAEVEKMMAGH

SEQ ID NO: 68991 - protein, 295 aa, Vitis vinifera
  misc_feature (103)..(103): Xaa can be any naturally occurring amino acid
  misc_feature (107)..(107): Xaa can be any naturally occurring amino acid
  misc_feature (115)..(115): Xaa can be any naturally occurring amino acid
  misc_feature (119)..(119): Xaa can be any naturally occurring amino acid
  misc_feature (143)..(143): Xaa can be any naturally occurring amino acid
  misc_feature (153)..(153): Xaa can be any naturally occurring amino acid
  misc_feature (158)..(158): Xaa can be any naturally occurring amino acid
  misc_feature (196)..(196): Xaa can be any naturally occurring amino acid
  misc_feature (215)..(215): Xaa can be any naturally occurring amino acid
  misc_feature (219)..(219): Xaa can be any naturally occurring amino acid
  misc_feature (226)..(226): Xaa can be any naturally occurring amino acid
  misc_feature (251)..(251): Xaa can be any naturally occurring amino acid
  misc_feature (263)..(263): Xaa can be any naturally occurring amino acid
  misc_feature (265)..(265): Xaa can be any naturally occurring amino acid
MEEGEMVCEAARKGDTAKLRALIDSGADVSFFDREGLSPLMHAARLGHADAVKILLEAGAPWNALSPSNLSAGDFAMDSGHQEAFEVLLNAANRLKRVVGKVXSKAXNAFVQGRXILDXVLVANEVLDSVLKNKEKARSRGGXGVNVSHLLFXDDTLXFCGASKVQLLHLSWILMWFEAMSGLRINLDKSELISVXCVDDVEDLAAAIGCKVGSXPTTXLGLPLGXQYRSLAVWDCVEERMRKKLARWKSXYISKGGRITLIXSXLANMPIYFMSMLSMPRKVRLRLERIQRDFL

SEQ ID NO: 68992 - protein, 460 aa, Saccharomyces cerevisiae YJM789
MMLEGYTVQPPQSTLIGDIEIQDENANQEVKNVLYQGVQKGIKRLEKRQRRVALGDVTSQKANKIHNAIHNKFHQTKNNFEIENIRSSALVKEQQRDVRDEDSDYFLIDSSEGSSTDDEQVNEDAIDDLLSRRVNDQQIQADEVYEDFDGEMQDVIEEDVDSQIEPLSPINNDEIQTELDRAFEKYFRSVPNPLDDDTHDVVMVVEYASDIFYYLRELEVKYRPNPYYMQNQVELTWPFRRTMIDWLVQLHFRFQLLPETLYLTINIVDRFLSKKTVTLNRFQLVGVSALFIAAKFEEINCPTLDDLVYMLENTYTRDDIIRAEQYMIDTLEFEIGWPGPMPFLRRISKADDYDFEPRTLAKYLLETTIVEPKLVAAAPSWLAAGAYFLSRTILGSNDWSLKHVFYSGYTSSQIIPLASLILENCKNASRRHHSIWKKYFDQKHYRCSQIVEEWIVSTEA

SEQ ID NO: 68993 - protein, 341 aa, Moritella sp. PE36
MKALAKLKPEQGIWMTDVEKPTLGHNDLLIKIRKTAICGTDIHIYNWDEWSQKTIPVPMVVGHEYVGEVVGIGQEVRGFTLGDRVSGEGHITCGHCRNCRAGRTHLCRNTIGVGVNREGAFAEYLVIPAFNAFKLPDDISDDMAAIFDPFGNAVHTALSFDVVGEDVLITGAGPIGIMAAAVCKHVGARNVVITDVNEFRLDLARKMGVTRAVNVTTESLTDVMDELKMTEGFDVGLEMSGVPSAFRDMLDKMNHGGKIAMLGIPPNDMSIEWGNVIFKGLVIKGIYGREMFETWYKMAALIQSGLDLTPIITHHFPIDQFQEGFDIMRSGMSGKVILDWT

SEQ ID NO: 68994 - protein, 175 aa, Triticum aestivum
  misc_feature (14)..(14): Xaa can be any naturally occurring amino acid
MAPTVMASSDTSVXPFQGLKSTAGLPVSRRSSSAGLSSVSNGGRIRCMQVWPIEGIKKFESLCEVPPLSTEALLKQVDYLIRSKWVPCLEYSKVGFVFREHNSSPGYYDGRYWTMWKLPMFGCTDATQVLNEVEEVKKEYPDAYVRVIGFDNLRQVQCVSYIAFRPPGCEESGMA

SEQ ID NO: 68995 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDGLSKHTLDKIKHFFETYKDLEPNKWVKVKGFEN

SEQ ID NO: 68996 - protein, 562 aa, Moritella sp. PE36
MSTTSRPLYLPYAGSALLETPLLNKGSGFSAIERQSFNLTGLIPPMVESIQEQAERAYKQFSGFESAMDKHVYLRNIQDTNETLFYRLVDNHLEEMMPIIYTPTVGAACQQFSDIYRRARGLFISYPERENIDDILHNVNKQNVKVIVVTDGERILGLGDQGIGGMGIPIGKLSLYTSCGGISPANCLPIVLDVGTNNEKRLQDPMYMGWRSPRIDQDKYNDFLELFIDAIKRRWPNVLLQFEDFAQQNAMPLLQRYKDEICCFNDDIQGTAAVTLGSLMAACRAAKTKLSEQKVAFLGAGSAGCGIAEQIVAQMKSEGLSDSQARERVFMVDRFGVLTDKMPNLLDFQQKLVQHQGLRDEWEIDSDVISLLDVMTHGKPSILIGVSGQPGLFTEQVIKTMAANTERPIIFPLSNPTSRVEATPQDLIRWTEGRALVATGSPFPPVSYGDELFTIAQCNNSYIFPGIGLGVLAAEATRVTNAMLMAASRALADCSPLGRDGEGPLLPPLTDIHSVSKEIAFWVAKTAQLQGVALQTSDEAIRNKIEKNFWLPEYREYKRVAN

SEQ ID NO: 68997 - protein, 384 aa, Saccharomyces cerevisiae YJM789
MTRPKTFFDISIGGKPQGRIVFELYNDIVPKTAENFLKLCEGNAGMAKTKPDVPLSYKGSIFHRVIKDFMCQFGDFTNFNGTGGESIYGEKFEDENFTVKHDKPFLLSMANAGPNTNGSQAFITCVPTPHLDGKHVVFGEVIQGKRIVRLIENQQCDQENNKPLRDVKIDDCGVLPDDYQVPENAEATPTDEYGDNYEDVLKQDEKVDLKNFDTVLKAIETVKNIGTEQFKKQNYSVALEKYVKCDKFLKEYFPEDLEKEQIEKINQLKVSIPLNIAICALKLKDYKQVLVASSEVLYAEAADEKAKAKALYRRGLAYYHVNDTDMALNDLEMATTFQPNDAAILKAIHDTKLKRKQQNEKLKSLFRRCSPDYLHYIYAYMFKY

SEQ ID NO: 68998 - protein, 410 aa, Bacillus clausii KSM-K16
MGTIVMPKLGMTMSEGTIVNWCKEVGEPVTKGEAIVEISSEKLTQELEAQEDGILLAKYGDVDAVMKVGEVLAHIGQEGEEIPETAATPSTAPQLSTSETDTASKTPAKQGQKKGEERIFITPLARKLAKEHNVNIEEVEGTGGNGRITKRDILREASNQISTQAVKQAANENAQVAHSDDIGEGLSPIRKTIARNMRASLHNTAQLTLHRKAHANALLAFRRLLKTESESHQLQLKLSVTVLIARATILALQQVGAMNSRYENGQLKEFENVHLGIATSLDDGLVVPVIRNADHLSIGQLATKIEKIAANARSGQSNPDELSGSTFTITNLGASSIEYFTPILNPAETGILGVGSLQQELALSEDGQVEPVQKMPFSLTFDHQIVDGVLAAQFLDAVVKYVENPHLLIL

SEQ ID NO: 68999 - protein, 173 aa, Picea abies
MDSRRLKRSGIVCMVLMSMLMLVVCEDSDNTACLSSLSSCAPYLNATTKPDSSCCSALISVIDKDSQCLCNLLNSDTVKQLGVNVTQAMKMPAECGKNVSATQCNKTATSGGSSVGKTPTSTPPPSSATPSTTTITKSNSNAAASVSVKMFPVAALVFVAVASVLGLKGPCLR

SEQ ID NO: 69000 - protein, 963 aa, Arabidopsis thaliana
MPHRTTYFFPRQFPDRGFDSFSLKNDHDKKKSSSNVGESFGFQRDNKSNGVGEDSNKEKESTVFSSNPLLSKSSAVSDLFSDDRKSEKKHQQQLAAFYEWLAEKKANLSRSSSTTTTHGRGVKPTRFSMSSDADEERELLLSSPADPAPLPATSSPDSIIDSARTVNIHERNIDRSFDREVSLPRMSSESSFAGSFFSGTTVDGNFSNFSSHTDARETSTTTLVSVNKEEEEVEVREQGKEQSLAQKSREGYYLQVTLAKWLSSQANLACESVHIQSTESISYRFWVSGCLSYSDKISDGFYSILGMDPYLWLMCNNSEDGKRIPSLLLLKETEPNDTSMEVVLIDRREDSRLKELEDKAHELYCSSDNMLVLVEKLGRLVAVYMGGNFQVEQGDLQKRWKLVSNRLKEFRKCIILPIGSLTMGLCRHRAILFKKLADYIGLPCRIARGCRYCKESHQSSCLVKIDDDRKLSREYVVDLIGEPGNVHDPDSSINGETQCQIPSPLQMSHLTDFSRPCVHSTSPCQTVESKTSRTLSENIQRSGSQGQVHKEFELPDNAGTVCCAHIDQTCCAKVSSMVLTESVLRALPLDIPNLSEEKIAPQETCKEETVLLEDPTAMKQPNLSVEPEIVEADTRKDKKGRLPVDAISPYLTIEPSLASDWLEVSWNELHIKERVGAGSFGTVHRAEWHGSDVAVKILSIQDFHDDQFREFLREVCKQAVAIMKRVRHPNVVLFMGAVTERPRLSIITEYLPRGSLFRLIHRPASGELLDQRRRLRMALDVVCAIPHYAKGLNYLHCLNPPVVHWDLKSPNLLVDKNWTVKVCDFGLSRFKANTFIPSKSVAGTPEWMAPEFLRGEPTNEKSDVYSFGVVLWELITLQQPWNGLSPAQVVGAVAFQNRRLIIPPNTSPVLVSLMEACWADEPSQRPAFGSIVDTLKKLLKSPVQLIQMGGDKGVIPTKSAPIL

SEQ ID NO: 69001 - protein, 401 aa, Escherichia coli O157:H7 EDL933
  misc_feature (284)..(284): Xaa can be any naturally occurring amino acid
MNVFNPAQFRAQFPALQDAGVYLDSAATALKPEAVVEATRQFYSLSAGNVHRSQFAEAQRLTARYEAAREKVAQLLNAPDDKTIVWTRGTTESINMVAQCYARPRLQPGDEIIVSVAEHHANLVPWLMVAQQTGAKVVKLPLNAQRLPDVDLLPELITPRSRILALGQMSNVTGGCPDLARAITFAHSAGIVVIVDGAQGAVHFPADVQQLDIDFYAFSGHKLYGPTGIGVLYGKSELLEAMSPWLGGGKMVHEVSFDGFTTQSAPWKLEAGTPNVAGVIGLSXALEWLADYDINQAENWSRSLATLAEDALAKRPGFRSFRCQDSSLLAFDFAGVHHSDMVTLLAEYGIALRAGQHCAQPLLAELGVTGTLRASFAPYNTKSDVDALVNAVDRALELLVD

SEQ ID NO: 69002 - protein, 3729 aa, Streptomyces fradiae
MSTENSTNVPASEDKLRAYLRRAMADLHESRERLRATEARAQEPIAVVGMGCRFPGGVGSPEALWRLVVEGVDAVSPFPGDRGWDVEGLYDPEPGVAGKSYVREGGFLHDAAEFDAEFFGISPREAVAMDPQQRLLLETSWEAIERAGIDPHSLHGSRTGVYAGVMYHDYGTGQTSATDTSGYSGTGTSGSVVSGRVAYTLGLEGPAVTVDTACSSSLVALHLAVQALRGGECDMALAGGVTVMAGPGMFVEFSRQRGLAADGRCKAFADGADGTAWAEGAGVVLVERLSDARRLGHPVLAVVCGSAVNQDGASNGLTAPSGPSQERVIRQALANARLTVADVDVVEAHGTGTRLGDPIEAQALLGTYGRDRDGGRPVWLGSLKSNIGHAQAAAGVAGVIKMVLAMRYGWLPRTLHVDEPSRHVDWSAGGVWLLTEAREWPGVDRPRRAAVSAFGVSGTNAHLILEAPDTAEAESATTPVRSEVSESAAVFDARSGVVPVVVSGRSRVVVREAAGRLAEVVEAGGVGLADVAVTMAGRSRFGYRAVVLARGEAELAGRLRALAGGDPDAGVVTGAVVDPETGSGGGGVVLVFPGQGTQWVGMGAGLLGSSEVFAASMRECARALSVHVGWDLLEVVSGGAGLERVDVVQPVTWAVMVSLARYWQAMGVDVAAVVGHSQGEIAAATVAGALSLEDAAAVVALRAGLIGRYLAGRGAMAAVPLPAGEVEAGLAKWPGVEVAAVNGPASTVVSGDRRAVAGYVAVCQAEGVQARLIPVDYASHSRHVEDLKGELERVLSGIRPRSPRVPVCSTVAGEQPGEPVFDAGYWFRNLRNRVEFSAVVGGLLEEGHRRFIEVSAHPVLVHAIEQTAEAADRSVHATGTLRRQDDSPHRLLTSTAEAWAHGATLTWDPALPPGHLTTLPTYPFNHHHYWLDTTPTTPATTTQSPTDAQNPADALPYKVSWKRLRDQDSLTARLDGRWLLVVPEASADPSVAEGVARELTARGATVESLTVEPGADRSRLRGLLVDATERDEAGPLRGIVSLLALAGDHAGADGARPVVPAGLAASLALIQAAGDAGTEAGLWAVTRGAVAAVPGDVPAPSQALLWGFGRVAGIELPHCWGGLLDLPTGPGDSGFRQLAATLAGRPAEDQVALRASGAYGRRLVRASAAGGADGWRPRGTVLVVGDTAEVAGPLVRWLLGNGARRVTLSGLSGPLPEELADVAARVTVAPCDPADRPALRTLLAEQAPTAVLVAPPAVPPTPLAEMTAEALAIALSAKTGLVDRLDSLLDEPDPLLEDGELDAFVVFSSVAGVWGGAGQGGYAAGTAYLDALAECRRAGGLPVTSVAWTPWLGTPAADSLGEQMSRAGITPLDPAASLDALARAVGRRAGCVTVADIDWERFASAYTATRPTPMFDEVPEVRRIQAAWAEAEADAARSGAGGDSQLLRSLRGRPEEAQLAELLRLVRTHAAAVLGLGSPGAVEARRSFKDLGFNSVTAVELRNRLKEATGLRLEVSLVFDHPDPASLARHLLDLALGQEPEETPRAFALEPAPNGEPIAIVSMACRMPGGVSTPEELWRLLRDGKDAIGPFPANRGWDLENLYDPDPDADGRTYVREGGFLHEAPDFDPSFFGISPREALAMDPQQRLLLETSWEALERAGIDPARLRGSRTGVFVGTNGQHYMPLLQNGGDSFDGYLGTGNSASVMSGRLSYVFGLEGPAVTVDTACSASLVALHLAVQAMRRGECDMALVGGATVMSTPEMLVEFSRQRVISANGRSRAFAAGADGVALGEGVGVLLVERLSDAERNGHPVLAVVRGSAVNQDGASNGLTAPNGPSQQRVIRQALADAGLRPEDIDAVEAHGTGTELGDPIEAEALLATYGRTRTADRPLWLGSLKSNIGHTQAAAGVAGVIKMVLALGNETLPRTLHVDEPTPRVDWSSGAVSLLTEPVDWPAGPSAPRRAAVSSFGISGTNAHTILEQAPVPAESRPGTEPADGTGAWENVTVPLLLSGHTEAALREQSTRLLNDLLEHPDEHPADVGYTLITGRAHFGHRAAVIGESREELLDALKALAEGREHHTVVRGDGTAHPDRRVVFVFPGQGSQWPSMARDLLDRAPAFRETAKACDAALSVHLDWSVLDVLQEKPDAPPLSRVDVVQPVLFTMMLSLAACWRDLGVHPAAVVGHSQGEIAAACVAGALSLEDAARIVALRSRAWLTLAGKGGMAAVSLPEARLRERIERFGQRLSVAAVNSPGTAAVAGDVDALRELLAELTAEGIRAKPIPGVDTAGHSAQVDGLKEHLFEVLAPVSPRSSDIPFYSTVTGAPLDTERLDAGYWYRNMREPVEFEKAVRALIADGYDLFLECNPHPMLAMSLDETLTDSGGHGTVMHTLRRQKGSAKDFGMALCLAYVNGLEIDGEALFGPDSRRVNPPTYPFQRERYWYHPTSGRRGDITAAGVAEAEHPLLGAGVELPETGGTVYTARFGPDSRPWLADHALLGTVLLPGTAILDLVLWAGERSGCGRVGELALQAPLVLPDSGDVELRLLVGGPDEEKRRTVTVHARPAAAGAEAPWTRHAEAVVLPATGEEPTPAPRPVPEPAGTTDPAAFYAEFAERGYDYGPAFQGFTAGARHGEDVVAEVALPSGLVADARHHRLHPALLDAALQAMILGTFFADDGRARMPFAVRGVRLHTAGADRLRVLISPAGDETVRLLCTDLATGAPVLEIDELVVRPVSGEQLAAGAPGRNGGELYRVDWTVLPEPAEVPAPRWALLGEDHAGLADVLGGTGGGCERYDTLTGLLEATTRSAGGILPDIVALSLPTAPEPGPQAVREVLSQALDAAQAWLAAGAETASARLVFVTGGAVATTADETVRDIAAAAVWGLVRSAQSEEPDRMVLLDLDGERPTARTLAAALASGEPQLAVRGSTVAAPRLAPAGPGPEDLVPPAGTTAWRLTPGGGTLEELSLAPAPDAEEPLAPGQVRIAVRAAGVNFRDALIALGMYPGKGTMGAEGAGVVVETAPDVTGLSAGDRVLGMWNGGFGPLVVADHRMVAPIPHGWSYAEAASVPAVLLTSYYALTRLARARTGQTVLVHAAAGGVGMATLQLARHLGLEVYATASTGKWDALQKHGIPDDRIADSRTLDFAERFLSRTGGRGVDIVLNSLAGEFVDASLRLLPRGGHFLELGKADVRDPRRIAAAHPGTDYRAFDLVQAGPDTVGEMLGELLELFAAGALRPLPLTAYGIRDARTALRTLSQARHTGKLVLTVPAGFDTHRTVLLTGGTGTLGQTLARHLVNRHGVRHLLLAGRTGAAAEGVAELIGELGELGAEVRVAACDAADRQRLTELLAGIPVEHPLGAVVHAAGTLDDGTIPSLTGENIDNVLRPKADAVLNLHELTRDADLSAFVLYSSSSALLGSPGQGAYAAANAFLDGFARYRKGLGLPALSLAWGLWGSNSRMAGHLDQSGMQRRLNRSGIMALTDAEGLALFDAAQDGGDALLVPMRLNRTALRASGRITPFLSGLAGGGPAAGERRPEVAAVSGTLAERLTGLTAQEGHALVLAEIRAHAAAVLGHGSDDSIPEDRAFKDLGFDSLTAVEMRNRLSAATGLRLPATLVFDHPTPGELAGHLSAELSADDAPGSASPLTELDRFEALFTALAPGTTKDTPGGAGALMIDEAERQEIAGRLAALAGLWNRLHGTTTAPEDGDTVADALEAADDHEIFAFLDERF

SEQ ID NO: 69003 - protein, 268 aa, Escherichia coli O157:H7 EDL933
MSVVISDAWRQRFGGTARLYGEKALQLFADAHICVVGIGGVGSWAAEALARTGIGAITLIDMDDVCVTNTNRQIHALRDNVGLAKAEVMAERIRQINSECCVTVVDDFVTPDNVAQHMSVGYSYVIDAIDSVRPKAALIAYCRRNKIPLVTTGGAGGQIDPTQIQVTDLAKTIQDPLAAKLRERLKSDFGVVKNSKGKLGVDCVFSTEALVYPQSDGTVCAMKATAEGPKRMDCASGFGAATMVTATFGFVAVSHALKKMMAKAARQG

SEQ ID NO: 69004 - protein, 287 aa, Leccinum vulpinum
  misc_feature (145)..(155): Xaa can be any naturally occurring amino acid
EINVVAVNDPFIDLDYMVYMFKYDSVHGRFKGDVHAKEGKLYINGKAITVYAERDPANIKWGAVGADYVVESTGVFTTIEKAAAHLKGGAKKVIISAPSADAPMFVCGVNLDKYDPKYTVISNASCTTNCLAPLAKVINDKFGIXXXXXXXXXXXTATQKTVDGPSAKDWRGGRAVNGNIIPSSTGAAKAVGKVIPALNGKLTGLAFRVPTNNVSVVDLVVRLEKSASYDEIKLAVKEASESSGLKGIIDYTDESVVSTDFIGNPASSIFDASGGIMLNPNFVKLIA

SEQ ID NO: 69005 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLIALPIDKIDPTHSYVKDIDGLSKHTLDKIKHFFETYKDLEPNKWVKVKGFEN

SEQ ID NO: 69006 - protein, 282 aa, Leccinum vulpinum
  misc_feature (127)..(149): Xaa can be any naturally occurring amino acid
AVNDPFIDLDYMVYMFKYDSVHGRFKGDVHAKEGKLYINGKAITVYAERDPANIKWGAVGADYVVESTGVFTTIEKAAAHLKGGAKKVIISAPSADAPMFVCGVNLDKYDPKYTVISNASCTTNCLXXXXXXXXXXXXXXXXXXXXXXXTTATQKTVDGPSAKDWRGGRAVNGNIIPSSTGAAKAVGKVIPALNGKLTGLAFRVPTNNVSVVDLVVRLEKSASYDEIKLAVKEASESSGLKGIIDYTDESVVSTDFIGNPASSIFDASGGIMLNPNFVKLIA

SEQ ID NO: 69007 - protein, 505 aa, Brucella melitensis 16M
MNKVEFSRTVKPAFAKRYGNFIGGKWVEPRSGRYFENTSPVNGQVLCEVARSDAADVEAALDAAHAARELWGRTSVAERALILNRIADRIEENLPALAAAETWDNGKPIRETTNADLPLAVDHFRYFAGVIRAQEGGISEIDHDTVAYHFHEPLGVVGQIIPWNFPLLMATWKLAPALAAGNCVVLKPAEQTPASILVLMELIADILPPGVVNIVNGFGLEAGKPLASSPRIAKIAFTGETTTGRLIMQYASQNLIPVTLELGGKSPNIFFKDVAAEDDDFLDKAIEGFVMFALNQGEVCTCPSRALIQESIYDRFMEKALKRVEAIVQGDPLDPATMIGAQASSEQLEKILSYLDIGRQEGAEVLAGNERNMLPGDLAGGYYVKPTVFKGHNKMRIFQEEIFGPVVSVATFKDDAEALSIANDTLYGLGAGIWTRDGTRAYRFGRAIKAGRVWTNCYHAYPAHAAFGGYKQSGIGRENHLKMLDHYQNTKNMLVSYSPKKLGFF

SEQ ID NO: 69008 - protein, 511 aa, Brucella melitensis 16M
MVFAGRFSGYAMVQEKQFDIFIIGGGINGCGIARDAVGRGFTVGLAEMNDLASGTSSRATKLIHGGLRYLEHYEFRLVREALMEREVLWANAPHIIHPMRFVLPYHKGGLRPAWLLRLGLFLYDHLGGRKKLPATRTLNMRTDKAGEPLKPLFTKAFEYSDCWVDDARFVALTARDAADRGAKIATRTSVVAASRDGQGWTITLEDTGTGRRENVHARLLVNAAGPWADKVLQSVEGDRQLHNIRLVQGSHIVVRRKFSDPRAYFFQNNDGRIIFAIPYEDDFTLIGTTDQDYKGDPAKVAITDSETDYLCQAASEYFREPVRREDIVWTYSGVRPLYDDGASKAQEATRDYVLKEDAPDGLAPLINVFGGKLTTARKLAEHMLQKIEHWLGRKGAPWTHAAPLPGGDFEDVAFETELKKLEAAYPFLDARRLFRLYGTRAYKLLGQASSLGDLGRHFGSDLYEAEVRYLVENEWARSAEDILWRRTKLGLRLTAAEVAAVQGFVEPAIAA

SEQ ID NO: 69009 - protein, 281 aa, Leccinum piceinum
  misc_feature (68)..(68): Xaa can be any naturally occurring amino acid
  misc_feature (132)..(148): Xaa can be any naturally occurring amino acid
VNDPFIDLDYMVYMFKYDSVHGRFKGDVHAKEGKLYINGKAITVYAERDPANIKWGAVGADYVVESTXVFTTIEKAAAHLKGGAKKVIISAPSADAPMFVCGVNLDKYDPKYTVISNASCTTNCLAPLAKVXXXXXXXXXXXXXXXXXTTATQKTVDGPSAKDWRGGRAVNGNIIPSSTGAAKAVGKVIPALNGKLTGLAFRVPTNNVSVVDLVVRLEKSASYDEIKLAVKEASESSGLKGIIDYTDESVVSTDFIGNPASSIFDASGGIMLNPNFVKLIA

SEQ ID NO: 69010 - protein, 393 aa, Solibacter usitatus Ellin6076
MPTLASSVEIVPRSRIRELAEIAMTMDGVLRLYFGESNLPTPEYIKQAAVRALADGFTFYTENAGLPSLRRALAANYERLHGVTLDPGSEIVVTASGVQALNLGIRCVLNPGDEAIALTPAWPNGSSSIMMANAAVRQIPHPLCGERYRVDFDALEAAVTPRTRLLLYTSPSNPLGWVATGEEQQGLLDFARRHNLWLMADEVYDRLYYAGERLGDPVPSILQRATREDAVMVVHSFSKSYCMTGWRVGWLVARRDLAAKATQLNEFIISHAPTFAQKAAETALAEGEPELARMLERLKENRDLCLEALRGLPGITVPKPDGAFYLFPRVEGMTDSFGFCRGLLEETRVGLAPGVAFGEGGEGSFRICYAAERSILEPAMERLTKFLRKGAHR

SEQ ID NO: 69011 - protein, 361 aa, Zea mays
  misc_feature (45)..(45): Xaa can be any naturally occurring amino acid
MMGGFLSRVLLLAFGYAYPAYECYKTVELNKPEIAQLIFWCQYWXGVSINYYAVAILTSVNNLPNLGLFPVSRILVALLTVLERFGDFTISWLPFYSEAKLMFFVYLWYPKTKGTTYVYGTFFKPYISQHENEIDRNLLELRARATDTVVLYFQKAASAGQSTFFDVLKYVAAQSPSQKSRQRLHQDSQQPPQQQQPQVQVQQAQPQKQAAPGMRRASSIAARQAAMAQQSQETKPVSSSPKIKRQTSARSGSVASTKPPVAASALKPGGSPKKGEVKPAADPVQTPTTGADSPKPEPSVPSLPGAEGVDKMAIDEASGDAPEGAEELDPALEEETPMEETIRVTRAKLRRRTATEDPAGN

SEQ ID NO: 69012 - protein, 541 aa, Oenococcus oeni
MTDQVSILNDPFINKGTAFTEAEREELGLNGLLPAKVQALQEQVDQTYAQFQSKVSNLEKRLFLMEIFNTSHVLFYKLFSQHVVEFMPIVYDPTIADTIENYSELFVEPQGAAFLDINHPENIQSTLKNAANGRVIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYEDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAKAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWEPKY

SEQ ID NO: 69013 - protein, 120 aa, Triticum aestivum
  misc_feature (19)..(19): Xaa can be any naturally occurring amino acid
  misc_feature (43)..(43): Xaa can be any naturally occurring amino acid
  misc_feature (82)..(82): Xaa can be any naturally occurring amino acid
  misc_feature (104)..(104): Xaa can be any naturally occurring amino acid
DDLDILVATCRSKQKETIXTTVEMRDTVDMSPLLQYKVHTAVXSQILLMEHAIQNRDFESLRRLTCADSNQFHAVCVDTSTXVFYMNDACSTILELCGKRVTLXSTSTAAYTFDADPTLS

SEQ ID NO: 69014 - protein, 541 aa, Oenococcus oeni
MTDPVSILNDPFINKGTAFTEGEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPDLYLHWDDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSELLTPEMISAAAHSLGGIVDTTKVGAAVLPPVSKLADFSRTVAVAVAKKAVEQGLNRQPIDDVEKAVDDLKWDPKY

SEQ ID NO: 69015 - protein, 306 aa, Aspergillus oryzae
MALVTIRVAIHPRGKPIKSLSQKVRIDPHNSTEELYDVLAQMSGLSIFRLRITKKSDSILVARSKESTLEEAGVKDMDVITVKDLGPQISWRAVFITEYLGPVFIPGLFLFQLRPYLYSNHGTIPEPSSFQLLLCALLIIHFVKREYESIFVHRFSKVTMPARKIVLNSAYYCVMSCNMAYWAFRPDTTPSNPVLCCAGLVLFAFGELANLNTHFVLRDLRRPGTPERGVPYGFGFGVVTCPNYLFEIIAWIGIWFVSGLSLSILIFIIIGSVQMAIWARKKEHRYRKEFGGKYKVKRFAMLPGIY

SEQ ID NO: 69016 - protein, 219 aa, Sinorhizobium meliloti 1021
MEVEERLNEVLSRIRASEKSANRPENTVSLVAVSKTFDAETIRPVIEAGQRVFGENRVQEAQAKWPALKRETPDIELHLIGPLQSNKAADAVALFDVIETIDREKIARAVAAEMKRQGRDIRLYVQVNTGLEPQKAGIAPEDAAAFVALCRDELALNIEGLMCIPPFDENPGPHFALLAKLAGQCGLSRLSMGMSGDFETAIAFGATGVRVGSAIFGAR

SEQ ID NO: 69017 - protein, 541 aa, Oenococcus oeni
MTDPVSILNDPFINKGTAFTEAEREELGLNGLLPAKVQALQEQVDQSYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDGEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKHLHEEMVEQGLSDEEAKKHFFLVDKQGLLFDDDPDLTPEQKPFAAKRSDFNNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWEPKY

SEQ ID NO: 69018 - protein, 403 aa, Rhodopseudomonas palustris CGA009
MSQSASTSHLLPVFARADVAFERGEGVWLHGTDGERYLDFTSGVAVNALGHCHPHLVEALQQQASKLWHVSNLFKSPEGERLAARLCEQSFADKVFFCNSGAEAVECALKMARHYHFSKGEPERTRVITFEGAFHGRTLGTLAATGSAKYLEGYGQPLEGFDQLPLGDLDAVKAAIGPNTAAILIEPLQGEGGVRSPELAFFRGLRELCDAHGLLLVFDEVQTGMGRTGELFAYKRIGVAPDIMALAKALGGGFPIGACLSTAEAAKGMAPGAHGSTFGGNPLAVAVANAVLDVMLQPGFFDHVKKMSLLLKQKLAGVVDRHPRVVSEIRGEGLLLGLKAVVPSPELIAALRAEKLLSVGAGDNVVRLLPPLIVNEAELDEAVGRLERACVTLAGQAAQKEAV

SEQ ID NO: 69019 - protein, 479 aa, Escherichia coli CFT073
MSVPVQHPMYIDGQFVTWRGDAWIDVVNPATEAVISRIPDGQAEDARKAIDAAERAQPEWEALPAIERASWLRKISAGIRERATEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKSIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEEAISMANDSDYGLTSSIYTQNLNVAMKAIKGLKFGETYINRENFEAMQGFHAGWRKSGIGGADGKHGLHEYLQTQVVYLQS

SEQ ID NO: 69020 - protein, 366 aa, Synechococcus elongatus PCC 6301
MTATYPSEAQPQSRAHGWPGLIEAYRDYLPVTDTTPIVTLHEGNTPLIPVPTIAREIGRGVEVFVKYDGLNPTGSFKDRGMTMAITKAKEAGAKAVICASTGNTSAAAAAYARRGGLRAFVLIPDGFVAQGKLAQALLYGAEVLAIKGNFDRALEIVREVANQYPVTLVNSLNPYRLEGQKTAAFELIDVLGEAPDWLCIPMGNAGNISAYWMGFQEYHAKGLSQKLPRMMGFQAAGSAPLVTGEIVQSPDTIATAIRIGNPANWQRALRVHEESNGAFNAVTDAEILDAYRMLAGQEGIFCEPASAASVAGMLKCKDEIPDGATIVCVLTGNGLKDPSSAIEFSHTGFKAGIEPDLDIVAHTMGF

SEQ ID NO: 69021 - protein, 333 aa, Escherichia coli CFT073
MSKVGINGFGRIGRLVLRRLLEVKSNIDVVAINDLTSPKILAYLLKHDSNYGPFPWSVDYTEDSLIVDGKSIAVYAEKEAKNIPWKAKGAEIIVECTGFYTSAEKSQAHLDAGAKKVLISAPAGEMKTIVYNVNDDTLDGNDTIVSVASCTTNCLAPMAKALHDSFGIEVGTMTTIHAYTGTQSLVDGPRGKDLRASRAAAENIIPHTTGAAKAIGLVIPELSGKLKGHAQRVPVKTGSVTELVSILGKKVTAEEVNNALKKATNNNESFGYTDEEIVSSDIIGSHFGSVFDATQTEITAVGDLQLVKTVAWYDNEYGFVTQLIRTLEKFAKL

SEQ ID NO: 69022 - protein, 152 aa, Oryza sativa
  misc_feature (5)..(5): Xaa can be any naturally occurring amino acid
  misc_feature (13)..(13): Xaa can be any naturally occurring amino acid
  misc_feature (15)..(17): Xaa can be any naturally occurring amino acid
  misc_feature (22)..(24): Xaa can be any naturally occurring amino acid
RSLQXVPIVSIEXRXXXRWEAXXXFSKTQDIQIVADDLTVTNPLRIKKAIDQKAANALLLKVNQIGTLTESIQAAKDSFADGWGVMVSHRSGETEDVTIADIAVGLRAGQIKTGAPARSERLAKLNQILRIEEELGSNAVFAGESFRKAINM

SEQ ID NO: 69023 - protein, 399 aa, Bacillus clausii KSM-K16
MLQHGGRLEDIRQAQEWGIETSVVQVDDSKLFRRQNAIIQSLSAGIAQLLKKNRITFFQGEATIDGSQQLVCDGHLIQSENLLLATGGKPFIPPIAQLETIDYMTTDTFFQQTSLPKSLVIIGGGVIAVELAFAVSPFGTKVTILEVASDILQTEDEQARAVVKKQLQQRGVEIETNVVIENVGQGLVRTANAAFPFERLLVAAGRRPNTELADALHLQKDANNRFIEVNPYYETSKKGIYAIGDVIGKYELAHAASAEGIAAVEHMAGIKQQPIDELGIPRCVYTDPEIASFGLSEKEAKERGYDVKVSFSANAANGKALAEGDTSGFVKLITEKKYGELLGAVIVGKHATELIGELLATRVSEGTISELQQLIHAHPTIAEVIGESALAFSKRAIHQ

SEQ ID NO: 69024 - protein, 702 aa, Vibrio sp. Ex25
MQRLELMATQGLIFEGDSIHINFNEGLVGLVKRSAEPLNLAEASKHPEFKFFPQLGEQIYHSFLATPIIHRKQVLGVLVIQQKTPRLFSEMEESFLVTLSAQLAVLIAHAQNLGHWQLASKPTVLKGLPASTGVAIGEFWFDNTQPSLSDVFPSSTLDKEREHETLLVAIERALNDFRRMRKKLDSEINKDALAIFDLFTHLLNDPMLRGDLKKQIEKGDRADWALRQVVESYSNRFARMSDVYMRERAQDIRELGQRLLYFLHNSEQENSAIDRPIILVASELTATLLASVPKEFLLAVVSLEGGANSHAAILSRALGVPAVMGANINQDVVNGKLGIVDGYTGEIFLEPNRQLLREYRSLVSEESELFAMVNKDLALPAVTQDNHHIEIMLNAGLSADSNIAINTGVDGVGLYRTEIAFLLQHHFPSEDEQYHQYQAILNSYPNQRVVMRTLDIGGDKPLPYLPIEEDNPFLGWRGIRFTLDHPDIFLIQLRAMLRASAESGNLSILLPMVSGVKELDDAISLINQAHSEAVLLDDRIQFPQVGVMIEVPSMVYLLPTIAHRVDFVSVGTNDLTQYLLAVDRNNSRVADVYESMHPAVLLALKQIHDVCDKYQVPVCICGELAGDPFGALLLLGLGYTSLSMNTSNVAKVKYLIRHSQQEELEKLAEQAMTKSYGEDIHQMMHDFFIQQGFAGFIRAGKK

SEQ ID NO: 69025 - protein, 310 aa, Bacillus clausii KSM-K16
MRVVDNIADLIGQTPLVRLNKLPDSEGASVYLKLEMNNPSGSVKDRAAFSMIIQAEKDGHLQPGSTIIEPTSGNTGIGLAMNAAARGYRAILVMPDTMSQERINLLKAYGAEVVLTEGDKKMPGAIEKAKELAESIPGSFMPMQFENEANPDAHRRTTAIEIKQDLDAIGATLSGFVAASGTGGTITGTGEVLKTYYPDALIHVVEPAGSPVLSGGKPGPHKLVGTSPGFVPPILNTAIYDQIRRIEDEDAYKTAKDLARLEGILVGPSSGAACFAALEMAKTLDKGDHVVAIACDTGERYLSTDLYQSE

SEQ ID NO: 69026 - protein, 1293 aa, Arabidopsis thaliana
MNTFTSNSSDLTTTATETSSFSTLYLLSTLQAFVAITLVMLLKKLMTDPNKKKPYLPPGPTGWPIIGMIPTMLKSRPVFRWLHSIMKQLNTEIACVKLGNTHVITVTCPKIAREILKQQDALFASRPLTYAQKILSNGYKTCVITPFGDQFKKMRKVVMTELVCPARHRWLHQKRSEENDHLTAWVYNMVKNSGSVDFRFMTRHYCGNAIKKLMFGTRTFSKNTAPDGGPTVEDVEHMEAMFEALGFTFAFCISDYLPMLTGLDLNGHEKIMRESSAIMDKYHDPIIDERIKMWREGKRTQIEDFLDIFISIKDEQGNPLLTADEIKPTIKELVMAAPDNPSNAVEWAMAEMVNKPEILRKAMEEIDRVVGKERLVQESDIPKLNYVKAILREAFRLHPVAAFNLPHVALSDTTVAGYHIPKGSQVLLSRYGLGRNPKVWADPLCFKPERHLNECSEVTLTENDLRFISFSTGKRGCAAPALGTALTTMMLARLLQGFTWKLPENETRVELMESSHDMFLAKPLVMVGDLRLPEHLYPTVNYVDRHISVILCDQSLSLESLRKHNALIITGGLSENIFVASKLISSYASYGKPNLSSRVFHLVTRRDIFLWNSIIKAHFSNGDYARSLCFFFSMLLSGQSPDHFTAPMVVSACAELLWFHVGTFVHGLVLKHGGFDRNTAVGASFVYFYSKCGFLQDACLVFDEMPDRDVVAWTAIISGHVQNGESEGGLGYLCKMHSAGSDVDKPNPRTLECGFQACSNLGALKEGRCLHGFAVKNGLASSKFVQSSMFSFYSKSGNPSEAYLSFRELGDEDMFSWTSIIASLARSGDMEESFDMFWEMQNKGMHPDGVVISCLINELGKMMLVPQGKAFHGFVIRHCFSLDSTVCNSLLSMYCKFELLSVAEKLFCRISEEGNKEAWNTMLKGYGKMKCHVKCIELFRKIQNLGIEIDSASATSVISSCSHIGAVLLGKSLHCYVVKTSLDLTISVVNSLIDLYGKMGDLTVAWRMFCEADTNVITWNAMIASYVHCEQSEKAIALFDRMVSENFKPSSITLVTLLMACVNTGSLERGQMIHRYITETEHEMNLSLSAALIDMYAKCGHLEKSRELFDAGNQKDAVCWNVMISGYGMHGDVESAIALFDQMEESDVKPTGPTFLALLSACTHAGLVEQGKKLFLKMHQYDVKPNLKHYSCLVDLLSRSGNLEEAESTVMSMPFSPDGVIWGTLLSSCMTHGEFEMGIRMAERAVASDPQNDGYYIMLANMYSAAGKWEEAERAREMMRESGVGKRAGHSVV

SEQ ID NO: 69027 - protein, 386 aa, Moritella sp. PE36
MSNIALLVLEDGTVFRGVSIGAEGHSVGEVVFNTSMTGYQEILTDPSYSRQIVTLTYPHIGNTGTNDEDAESSDVHACGLIIRDLPLVTSNFRNQQSLTDYLKERNVVGIADIDTRKLTRILREKGAQAGCIIAGGSIAGESIDEAKALELAKAFPGLKGMDLAKEVTVKEAYEWKQGSWTLMGGLPADATDSRFHVVAYDYGVKRNILRMLVDRGCRITVVPAQTTAKEVLALNPDGVFLSNGPGDPEPCDYAIAAIKEILTTDIPVFGICLGHQLLALASGAKTLKMKFGHHGANHPVKDLERGVVMITAQNHGFAVDQTTLPENLVMTHKSLFDDSLQGLHRTDKPAFSFQGHPEASPGPHDAAPLFNHFIELMEKSMEKSQA

SEQ ID NO: 69028 - protein, 410 aa, Blastopirellula marina DSM 3645
MSDPYFQQLFADRIGGANYGKGTEIYKFEKIKRAKRKALADHPERKLIDFGIGENDEMAPESVRQVMAAEINKTENRGYADNGIAAFKEAVARFMQRMFGVSLDATTEINHCIGSKTALAMIPACFINPGDVTLMTVPGYPVAGTHTRYYGGEVFRLPLLAENDFLPDLAAIPEDILRRTKLLVLNYPNSPTGKVATKEFYAEVVEFAKKHNIVVIQDAAHTVLTFDGEPLSFLSVPGAKDVGVEIHSLSKGFDMIGWRIGWVCGNPLLVQAFSDVKDNCDSGQFIAVQKAAAAALDDESIPGRTREKYQRRLTKLVSMLKRCGFECEMPGGTYFLYTKSPKGVVGGPTFDSGEAASQYLITEHSICTVPWDDAGAFLRFSVTYVAADEAAEDALMAETESRLKEIQLQF

SEQ ID NO: 69029 - protein, 361 aa, Blastopirellula marina DSM 3645
MNKKLLLLPGDGIGPEIITEVRKLISWINDHTDLTIETEEDYFGGAAIDAYGVPLRDETLAAARKSDAILMGAVGGPKWDNVAYDIRPEAGLLKIRKQLDLFANLRPAIVFDALIDASSLKPEIVKGLDILIVRELTGGVYFGEPRGIEDLGDGERRGVNTQVYTTSEIRRVGKVAFEIARKRQGKVTSCEKANVMESGKLWREEITRLHAESYSDVTLEHMYADNAAMQLCRRPSQFDVIVTDNLFGDILSDEAAMLTGSLGMLPSAALGAPDSPGLYEPVHGSAPDIAGQGIANPLATILSFAMLLKYSFNSVALGEQIEAAVQAVLAQGLRTADIMTEGCQKVTTVEMGDAVIKELAA

SEQ ID NO: 69030 - protein, 281 aa, Leccinum aurantiacum
  misc_feature (132)..(149): Xaa can be any naturally occurring amino acid
  misc_feature (259)..(259): Xaa can be any naturally occurring amino acid
VNDPFIDLDYMVYMFKYDSVHGRFKGDVHAKEGKLYINGKAITVYAERDPANIKWGAVGADYVVESTGVFTTIEKAAAHLKGGAKKVIISAPSADAPMFVCGVNLDKYDPKYTVISNASCTTNCLAPLAKVXXXXXXXXXXXXXXXXXXTATQKTVDGPSAKDWRGGRAVNGNIIPSSTGAAKAVGKVIPALNGKLTGLSFRVPTNNVSVVDLVVRLEKSASYDEIKKAVKDASESSGLKGIIDYTDESVVSTDFIGNXDSSIFDASGGIMLNPNFVKLIA

SEQ ID NO: 69031 - protein, 486 aa, Acinetobacter sp. YAA
MKDIKHYINGQYVGSASGKLFDNVNPANGKLISKVHEAGREEVDAAVNAAKAALRGPWGKMTLEERTSILHKVADGINARFDEFLKAECLDTGKPKSMASHIDIPRGAAHFKVFADMIKNVPTESFEMPTPDGTGALNYAVRRPKGVIGVISPWNLPLLLMTWKVGPALACANTVVVKPSEETPTTTALLGEVMKEAGIPTGVYNVVHGFGGDSAGAFLTEHPQVDGFTFTGETVPGEVIMKAAAKGIRDISLELGGKNAALVFADCDMDKAIEGTMRSAFANCGQVCLGTERVYVERSIFDEFVGRLKEAAEGLKIGPPDDAEANLGPLVSLKHREKVLSYYQKAVDDGATVVTGGGVPEMPEELAGGAWVQPTIWTGLPKDSAVITDEIFGPCVHVCPFDTEEEAIELANSLPYGLASAIWSENITRAHRVAGQIEAGIIWVNSWFLRDLRTPFGGSKQSGIGREGGVHSLEFYTEMKNICVKL

SEQ ID NO: 69032 - protein, 274 aa, Leccinum quercinum
  misc_feature (44)..(44): Xaa can be any naturally occurring amino acid
  misc_feature (134)..(154): Xaa can be any naturally occurring amino acid
VAVNDPFIDLDYMVYMFKYDSVHGRFKGDVHAKEGKLYINGKAXTVYAERDPANIKWGAVGADYVVESTGVFTTTEKAAAHLKGGAKKVIISAPSADAPMFVCGVNLDKYDPKYTVISNASCTTNCLAPLAKVXXXXXXXXXXXXXXXXXXXXXQKTVDGPSAKDWRGGRAVNGNIIPSSTGAAKAVGKVIPALNGKLTGLAFRVPTNNVSVVDLVVRLEKSASYDEIKKAVKEASESSGLKGIIDYTDESVVSTDFIGNPASSIFDASGGIML

SEQ ID NO: 69033 - protein, 274 aa, Leccinum versipelle
  misc_feature (124)..(136): Xaa can be any naturally occurring amino acid
PFIDLDYMVYMFKYDSVHGRFKGDVHAKEGKLYINGKAITVYAERDPANIKWGAVGAEYVVESTGVFTTIEKAAAHLKGGAKKVIISAPSADAPMFVCGVNLDKYDPKYTVISNASCTTNCLAXXXXXXXXXXXXXEGLMSTIHATTATQKTVDGPSAKDWRGGRAVNGNIIPSSTGAAKAVGKVIPALNGKLTGLAFRVPTNNVSVVDLVVRLEKSASYDEIKKAVKEASESSGLKGIIDYTDESVVSTDFIGNPASSIFDASGGIMLNPNFV

SEQ ID NO: 69034 - protein, 456 aa, Brucella melitensis 16M
MTAQPNSLEARDIRYHLHSYTDAVRLEAEGPLVIERGDGIYVEDIAGKRYIEAMSGLWSVGVGFSEQRLAEAAARQMKKLPFYHTFSYRSHGPVIDLAEKLVAMAPVPMSKAYFTNSGSEANDTVVKLIWYRSNALGEPERKKIISRKRGYHGVTIASASLTGLPNNHRSFDLPIDRILHTGCPHHYHDALPGESEEQFATRLANELEQLILAEGPHTIAAFIGEPVMGAGGVVVPPKTYWEKVQAVLGRYNILLVADEVICGFGRTGNLFGCQTFDIKPDILVMSKQLSSSYLPISAFLINERVYAPIAEESHKIGTLGTGFTASGHPVAAAVALENLAIIEERDLVANARERGARMQKRLRELQDHPLVGEVRGVGLIAGVELVIDKEAKTGLEQPGALGARANAALQERGVISRAMGDTLAFCPPLIINDQQVDTMVSALEAALNDVQASLGK

SEQ ID NO: 69035 - protein, 748 aa, Escherichia coli O157:H7 EDL933
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARVKYLLRRIDYAEAENLAQRSLEAQLATEVRHQVAAFMERRGMGGLIRGGL

SEQ ID NO: 69036 - protein, 499 aa, Triticum aestivum
LKMVLEKESWTIMSAEASQIISLAGLTGDGAALISPTSGSSTLPKDYFRGNSTATNTGRQNNGFASWHNMGNPFSFKLENGSAESPKGNVLFNSSVGNGNNSPFDEENEDLLADFIDEDSQLPSRTLKTKIVKGNTSHWKDGDISSQTGSSLSLLRMMDKYARLMQKLEMVNVELFKGMFQLFGIFYHHIYETFGYQDRSQSGKPLPDSQSFRLKAALSKITQDSDQWIKPQNSLYPSSSSLSIGSTIAQMDVMPTAPPSSMFTSYGLKERCAAAETVSLVARVLNRSRAHLHSVLSQNNTSVVEEFFGTLVDTVPDLAEHIHRTSARMLLHINGYPDKIANAKWEVKELGTDHNGYVDLLLGEFKHYKTRLDHGGISKELQHLLLDYGIESIAEVLVEGLSRVKRCTDEGRALMSLDLQVLINGLQHIVSSNVKPRLQIVETFVKAYYLPETEYVHWARSHPEYSKSQVVGLVNLVATMKGWKRKTRLETIEKIEAAA

SEQ ID NO: 69037 - protein, 237 aa, Oryza sativa
  misc_feature (203)..(203): Xaa can be any naturally occurring amino acid
MLLVPGIGIMAGDPEGKKAVQALKEVYAHWVPEDRIITTNLWSAELSKLAANAFLAQRISSVNAISALCEATGANVAEVAYSVGKDSRIGPKFLNASVGFGGSCFQKDILNLVYICECNGLPEVANYWKQVIKINDYQKSRFVNRVVSSMFNTVSGKKIAVLGFAFKKDTGDTRETPAIDVCHGLLGDKAQISIYDPQVTEEXIQRELAMRKFEWEHPMYMEANRPNGFKQGTVGVG

SEQ ID NO: 69038 - protein, 377 aa, Oceanobacter sp. RED65
MDLLARAKQFQAEGRDIIHLEVGEPDFPSLPCVISAGQQALANGHTHYTPALGLPQLRQVIAQYYKSRYQVDVDWNRIVITPGASGALQLVTTLLLDESDQIMLADPGYPCNRHFAAVVNAQAQEVVTSAKDDFHLTALQVSQHWQKQTKAVMVATPSNPTGAVMNLQQLQDLQTAIKQQRGVLIVDEIYQGLVFDSAKDITALQLSGDQSNLFVINSFSKYFAMTGWRLGWMVAPEWAMEGLDRLAQNIFLAANTPAQHAALAVFEKEALQQLDERKTELQKRRDFLLPELIKLGFDVVAEPEGAFYIFARISHFNHRHAKDSMAFCLDLLEKTGVAITPGVDFSPSHGHEYVRFAYTQPISELQRAMDKIKHYLM

SEQ ID NO: 69039 - protein, 379 aa, Chlamydomonas reinhardtii
MTQNGLGEQNRHGGEGPSYRSSRVPGSGVFLLMDAAKSAARASGVEVVDLSIGASDLAPPPEALAALKDSIDDPTTHSYCLKSGTMPLLEAACKWYGERYGTQLDPNCEALSLIGAQEGLGHALMAVADAGDGILMTSVAYPSYFGAVRVAGLDPIYMPLGPDFLPRLDAIAPADLARSRVLLLNYPNNPTSAVASAAFFQAAIDLCRRHGILLIHDNPYVDLVFGEEPSPSPLCLPGGRDCVLELFSFAKSYHLGGFRLGFALGNRNAIASLEALKAPIDFNQYKGIMRMGVACLQLPQERVRSDAGVWAARAAAMVESLRRAGCGEVDMPKACMYVWLRLPAGVDDVAFCQRLPEGVLAAAAEKIAAAMRAAKAALA

SEQ ID NO: 69040 - protein, 161 aa, Zea mays
  misc_feature (17)..(17): Xaa can be any naturally occurring amino acid
  misc_feature (38)..(38): Xaa can be any naturally occurring amino acid
  misc_feature (96)..(96): Xaa can be any naturally occurring amino acid
  misc_feature (114)..(114): Xaa can be any naturally occurring amino acid
  misc_feature (135)..(135): Xaa can be any naturally occurring amino acid
SAGTPGEAEQKGKKEDXRADHNDPPDDFYIITHHSGMXASIPTINFLLHKGAKVILPIHLGRPKGVTPNYSLKPLVPRLTELLGVELVMANDCIAXEFQKLAAALPQRLVLLLXNVRFYNEKEKNEPEFPKNLTXVPHLYLNYAQGTTHISYASTERLTNY

SEQ ID NO: 69041 - protein, 541 aa, Oenococcus oeni
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDNQGLLFDDDPDLTPEQKPFAAKRSDFKNANQLTDLQAAVEAVHPTILVGISTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWEPKY

SEQ ID NO: 69042 - protein, 246 aa, Zea mays
  misc_feature (230)..(230): Xaa can be any naturally occurring amino acid
  misc_feature (238)..(238): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTIGGKPIFHFVGTSTFSEYTVIHVGCLAKINPEAPLDKVCVLSCGISTGLGATLNVAKPKKGSTVAIFGLGAVGLAAMEGAKMAGASRIIGVDLNPXKYEQAKKXGCTDFVNP

SEQ ID NO: 69043 - protein, 333 aa, Clostridium acetobutylicum ATCC 824
MGYLKNRNFLSLMDFTPQDINYMLDLAKKLKEDKRNGLEEQYLKKKNIALIFEKDSTRTRCSFEVAAHDQGAHAVYIGSTGSQISKKESIKDTARVLGRMFDAIEYRGYGQEVVEILAEHSNVPVWNGLTDEEHPTQVIANFMTLKEKFNKPLNEIKFVYCGDARNNVSNALMIGAAKMGMDFRIAAPKSLFPSSELVKKCMDIAELTGGKITLSDEVDEAVFGADVLYTDVWVSMGEDREVWKERLKMLKPYQINMEMISKTKNPNVKFMHCLPAFHDFSTDAAKEIYDEFNEIPFEVTDEVFESDYSLAFDEAENRLHSIKAIMVATLGDI

SEQ ID NO: 69044 - protein, 541 aa, Oenococcus oeni
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDGEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISDQKLTDQTYMSFGAGTAGMGIVKQLHEEMVEQGLSDEEAKKHFFLVDKQGLLFDDDPDLTPEQKPFAAKRSDFNNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWEPKY

SEQ ID NO: 69045 - protein, 994 aa, Rhodopseudomonas palustris CGA009
MYRIVRREQFSDATFLWDVEAPDIAASAEPGHFVMLRLYDGAERIPLTVADFDRDKGLVTVVVQALGKTTREMRDKFKEGEAFEDFVGPLGLPQHIDKVDHVVFVGGGLGVAPIFPQLRAFKQSGARTTAIMGFRTKDLVFWEDKFREFADELIICTDDGSYGEPGLVTAALERVITQQKPDKVVAIGPMPMMHACVETTRPHGVKTMVSLNTIMVDGTGMCGSCRVTVGGEVKFACVDGPDFDGHKVDFHELHARQKRFKTEEDKANEHFAHVCNLEKQLIVEGKRNYKKLATLPPHQTPMPERDAHERATNFKEVNLGYSVEEALQEAERCIQCITPTCVAGCPVGIDIPVFIRNILFRDFDAALETIYQSSIFPSICGRVCPQETQCEAQCIIRKYKKHEPVAIGRLERFIGDNARAPKSKPIDLSKAIGKVAIVGSGPAGLAAAADLTRYNVETTVYEALHVLGGVLQYGIPSFRLPRDIIDREIQRLKDIGVKFETNKVVGKTFTIEQLMNGRGFDAVFVAAGAGAPTFLGIPGEFAGRVYSANEFLTRINLMGGDRFPYLDTPVSVGNSVIVIGAGNTAMDCLRVARRVGAATVRCVYRRSEAEAPARIEEIRHAKEEGVDFFFLHSPVEILVTESGDVRAVRLQKMELGEADERGRRKPVPLDEFIELECDTVIYALGTKPNPIIGQATPGLALNKWGNIAADDDTQSTNMPGVFAGGDIVTGGATVILAMSAGRRAAKSIAAWLRLNKTKWPITAQDADDFVAGKLAPAIEEDGVAHCPKCHQPLEGSEEYICCADSELQWRCDDCAKVSEGFAFPYGMCPHCGGKLQPLDRAGVSDEAGLGAIRTAFEIELGGRAFYARAAKETSDPTLQELFLSFAAMEEEHMTTLANRYHVAIPQATEGFHLGTAAIMAGVKGRIGDPTTLFEAAIEFERRAASFFKTRVGETPDGSVERQLYRELAAEEDEHVSVLQTEFARWKEGKRGLLT

SEQ ID NO: 69046 - protein, 308 aa, Aspergillus oryzae
MEKYQKIEKIGEGTYGVVYKARELAHPNRIVALKKVRLETDDEGVPSTTIREISLLKEMNHPNIVRLFNIHTEGYKLYLVFEHLDSDLKKYMDALPVNDGGRGRSLPNGLSMDMGLGEAMIKKFMSQLIEGIYFCHSRRVLHRDLKPQNLLINRDGSLKLADFGLARAFGVPLRTYTHEVVTLWYRSPEILLGGPQYSTSVDMWSCGAIFAEMCTRKPLFPGDSEIDQIFKIFRLLGTPDEDSWPGVTSFPDYKPSFPKWKRDSDEHLIPGLERHGLRLLDALLEFDPARRMSAKQARSHPYFRHRSS

SEQ ID NO: 69047 - protein, 375 aa, Moritella sp. PE36
MSKRDYYEVLGVSRDASEKDVKKAYKRMAMKYHPDRTKGDKAMEEQFKEVKEAYEVLNDAQKKAAYDQYGHAGLNQQGGHGGQGDFGDIFGDVFGDIFGGGGGRGRQQRAARGSDLRYNMELTLEEAVRGVSKTIRIPSQCHCEVCNGSGAKSGTKATTCSTCHGQGQVQMRQGFFAVNQACPTCHGKGKIIKDPCRKCHGEGRYERSKDLKVTIPAGVDTGDRIRLTGEGEAGDMGAGSGDLYVQVSVRQHAIFERDGSNLYCEVPISFAHAAIGGEIEVPTLDGRVKLKVPAETQTGRMFRLRGKGVKSVRGGATGDLLCKVTLETPVKLSAEQKELLQQFEASLNNASAKKHKPKSEGFFDGVKSFFDDFTK

SEQ ID NO: 69048 - protein, 387 aa, Acinetobacter sp. ADP1
MNITIVGTGYVGLSNAMLFAQQHQVIALDIDPARVDLLNHKTSPIHDTEISQYLQKEINFQATLDSTVAYANAEVIIIATPTNYDEQTNYFDTSSIEQVLSDLSNQSSQAIIVIKSTIPVGFTQKMQLQYPSLKIVFSPEFLREGKALLDNLYPSRIVVGDTSEIGQKIGALFKAGSLKEDVDVLLMDATEAEAVKLFSNTYLAMRVAYFNELDTYCASRGLNSKDIISAVGKDPRIGTHYNNPSFGYGGYCLPKDTKQLLANYQDVPQTLISAIIQSNTTRKDFIAEQIVKKAPETVGIYRLVMKAGSDNFRQSAIQGIMKRLKAKGIRVVVYEPVLQESSFFGSDVVNDLVEFKQQSDIIIANRIVSDLDDVLEKVFTRDLFGDN

SEQ ID NO: 69049 - protein, 545 aa, Chlamydomonas reinhardtii
MPVIAPACPILRGRAVATSSAPVARKRSALRGAVIAKAATVDAPRKFQQPGQGVKQVNVVYKFGGSSVRDAERMREVADIICSFPQYLPCVVLSAMGKTTNMLLECGELALKTPTDQIGDLAPLKNIRKLHLDTCDELGVEAAVRTEVDRMVNELQQLLIGISIMQDLTPRAKDSLVSFGERLSTRIFASYMRVNGVAARQHDAWELGMTTTDDFTNADVIYEASLPAIKKALAPAPGTAQPEVPIVTGFLGRGQNTGAVTTLGRGGSDLTATVLGAALELPEVQVWKDVDGVLTSDPRIVPSTKPVNELTFEEATELAYFGAQVLHPQAMQPAIRSGKMNVRVKNSYNRTAPGTIISATRPMDCTVVTSIVLKSNVTLVDIISTRMMGQYGFLSTVFDAFRRHKISVDVVATSEVSVSLTLDPKKVAGAVEDELTQLSQELEKIAAVSFRKNLAILSLICNVEKTSEILMRAFSVFQRENINVLMMSQGASKTNISLVVDGARGVEAVQALHREFFDGPSVCSTNSGVTVGLGNGNGNGNGSHN

SEQ ID NO: 69050 - protein, 288 aa, Vibrio sp. Ex25
MWQAISQQLSDTLLFEYQITEKVRLSGGDISESYMINDGEQRYFVKINDREFLSKFEVEAESLHLLRETSTLFVPEVVLVGKTKNASFLILNYLPTKPLEDGPNSFKLGQQLAHLHQWGEQKEFGFDTDNYLGSTLQPNKWHKKWCVFFAEQRIGWQLQLLKEKGVTLVDIDDFIDVVKQLLANHAPEPSLLHGDLWNGNAALTACGPICYDPACYWGDRECDIAMTELFGGFQPEFYQGYESVMPLSAGYQERKDIYNLYHVLNHCNLFGGHYLEQAQQVINKIISY

SEQ ID NO: 69051 - protein, 327 aa, Anaplasma phagocytophilum HZ
MKFQDVSKGSRKENGPWLEGGQLSEEDQWLNEARVLSESIKSIHQFSGETFVIKYDGTALQDKRLADSFASDIVLLKQVGIHPIIVHGGNYRVEEVLEKFGKKEGVFVNDFRVVDSEVLEITEMVLSGLVNKEIVQTINENGGYAVGISGKDACLVEAKKVCFTARNGQPNNVEKIMDIGFVGEPQSVNTELLFFLEESDFIPIVSPICRGPNGMTHVVNPDLVAGAIASSLSAAKLVILTDSAEDIKNMQHDDELLVGTVEQAEKLLNDGKVCETMVQRLQTCIKFARETCGTAHVVDGSIPHILLMELFTINGTGTSICGDFSKD

SEQ ID NO: 69052 - protein, 462 aa, Ustilago maydis 521
MAPTATASVGAAVASIPTTLKTVAHAVSATASTSASTLSTSEVIHKEAEYGAHNYHPLPVVFDRAQGAHVWDPEGNQYLDFLSAYSAVNQGHCHPAIVGALVAQAQKLTLSSRAFYNSAFAPFAEKVTKTFGYEMVLPMNTGAEAVETALKLARKWGYMKKRIPEGKARLLSVSGNFHGRTLGVISMSTDPESRTGFGPFLDRVGPGVDDMTIRYDNADDLEKVLDKYGHEVAAFLVEPIQGEAGIVVPSDGYLKRVQELCRKHNVLFICDEIQTGLGRTGKMLCHQHDNVRPDIVTLGKALSGGVYPVSAVLADKEVMLCIKPGEHGSTYGGNPLGCAVASAAIDVLVNENLCDRAEQLGARFRAQLRDIQHPLLASVRGRGLLNAIVIDEQKSTKRRSAWQLCLLLKSKGLLAKPTHVNIIRLAPPLVITEADLDRGVEIIKQALDELDSLDSIPGDDQH

SEQ ID NO: 69053 - protein, 200 aa, Zea mays subsp. parviglumis
VAKINPQAPLDKVCVLSCGISTGLGASINVAKPPKGSTVAIFGLGAVGLAAAEGARIAGASRIIGVDLNPSRFEEARKFGCTEFVNPKDHNKPVRRVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEIN

SEQ ID NO: 69054 - protein, 350 aa, Moritella sp. PE36
MIDEIQFYEPNDDFGFLSNFALAAVKIDGVVWPSSEHFYQAQKFNDPQLQDFIRTATTPDEAFSLSREYAQLVKSDWMAVRDGVMRDVVMEKFSQNPFYAYQLVATGEQVLTEHSHKDAYWGDGGDGQGRNELGKILMNVRHQLASQAPYNLVSYIDSAKLPTEFGTFQVNGFIEHATGKEHLALVYGQLDTSKPVLIRLHSECLTGDALFSARCDCGFQLAKAMQNIVAKGSGVIFYLRQEGRGIGLLNKIRAYHLQDDGADTVEANERLGFAADMRDYTFCQGMLGYLNINTVNLMTNNPRKVNALMKAGINIAERVPLQEGHNPHNAGYLKTKANKLGHMFESNFIN

SEQ ID NO: 69055 - protein, 272 aa, Saccharomyces cerevisiae YJM789
MSRVGVMVLGPAGAGKSTFCNSIISHMQTVGRRAHIVNLDPAAEATKYEFTIDIRDLISLDDVMEEMDLGPNGALIYCFEYLLKNLDWLDEEIGDFNDEYLIFDCPGQIELYTHIPVLPNIVRHLTQQLNFNLCATYLLEAPFVIDSSKFFSGALSAMSAMILLELPHINVLSKLDLIKGDINKKKLQRFLNPDAMLLMETEGMNQASNPKFLRLNQCIANLVDDFGMVQFLPLESNNPDSIETILSYVDDITQWAEGQEQKEPNDQIDVEE

SEQ ID NO: 69056 - protein, 482 aa, Vicia narbonensis
MAKLLALSLSLCFLLFSNSFALREQSQQNECQLERLDALEPDNRIESEGGLIETWNPNNRQFRCAGVALSRVTLQRNALRRPYYSNAPQEIYIQQGNGYFGVVFPGCPETFEEPQESEQRERRRYRDSHQKVNRFREGDIIAVPTGNVLWMYNDQDTPVIAISLTDTGSSNNQLDQIPRRFYLAGNQEQEFLRYQREQGGKQEQENDGNNIFSGFKRDFLEDALNVNRHIVDRLQGRNEDEEKGAIVKVKGGLSIITPPERQRGSRQEEDEDEKEERQPSRRRDESQKGESRRHGDNGLEETVCTAKLRVNIGSSPSPDIYNPQAGRINTVTSLDLPVLRWLKLSAEHGSLRKNALIVPHYNRNANSVIYALKGRARLQVVNCNGNTVFDGELEAGRALTVPQNYAVAAKSLSERFTYVAFKTNDRDGIARLAGTSSVINDLPLDVVAATFNLQRNEARQLKSNNPFKLLVPPRESEKRASA

SEQ ID NO: 69057 - protein, 628 aa, Phanerochaete chrysosporium
MRSALALLAAVSPALAGVHEVWWNITYVQQANPDGLQPRRVIGINGTWPPPPIDVQSTDDLLVHAYNSLDQPMTLHHHGMFFNSTSWMDGALAISQCGVPPGQSFDYTVPISTSGQHGTYWVHSHASGQYVDGLRAPVVIHPPQEKHQYDEEFTVVLGDWYHDEHEVLLKQFISVANPGGAEPVPDSALIYFAQNASYLGPISGTHPDPVTAAVGFNENATLPFQPGKTYRLRIVNTSAFAMFYFWIDGHDMRIIEVDGTDVEESPTDLITVTVAQRYSILVTARNDTSQNWAIHANMDTDMFDTVPPALNPNITSSVTYDPSKPVTDLGTIDTYHDIDDMALVPLDVEPMLPSTRTIPLEVTFDTMDDGTNRAMFNGQTFVSPLVPTVMSEMSLGDNATVAQAYGPFSFVLNHLEVVDILLQNGDAGKHPFHLHGHKFQIVQRSTDYTSDDPTLNPPINETQVNPIRRDTVQVPAGEGVTLRVVADNPGAWIFHCHIEWHLQAGLAVTFIEAPLEAQARNAIPQVMYDQCAMLNMPSSGNAAGHPASDLLDLSGWKLGPFQQVLGWRPKGIGAMAGCVLTAVLGMLTVTWYSLGGHISEEEMEHEARLHEEAKRRRGKFFGLYKPKN

SEQ ID NO: 69058 - protein, 430 aa, Ginkgo biloba
MSGEQRELNSWVFMVTARAPTNIAVIKYWGKRDEKLILPINDSISVTLDPDHLSATTTVAVSPSFSSDRMWLNGKEVSLGGERYQNCLREIRSRGRDVVDEKSGTLIKKEDWQTLHLHIASHNNFPTAAGLASSAAGFACLVYALAKLMDIEERYAGELSAIARQGSGSACRSLYGGFVKWDMGKERDGSDSIAVQLATEEHWEELVILVAVVSSRQKETSSTTGMRESVETSELLHHRAQEVVPKRIVQMQEAIANHDFASFARITCVDSNQFHAVCLDASPPIFYMNDTSHRIINCIEKWNRFEGTPQVSYTFDAGPNAVICAPSRKVAGLLLQRLLYYFPPDSSKELSSYVIGDTSILGEIGLKSMKDVESLIAPPEFRSQNSSSIHPGEVDYFICTRPGKGPIILRNEDQAFFNNKTGFPFRISET

SEQ ID NO: 69059 - protein, 229 aa, Vitis vinifera
MRDDRERSRGRGGGGGGSSGKDKIDALGRLLTRILRHMASELNLNMRSDGYVRVQDLLKLNMKTFANIPLRSHTIDDIREAVRKDNKQRFGLLEENGELLIRANQGHTVTIVESESLLKPILSAEEVTVCVHGSYKRNLESILESGLKHMKRLHVHFSCGLPMDGEVISGMRRDVNLLIFLDVRKALEDGMKLYISDNKVILTEGFDGVVPVKYFEKIESWPDRQTIPF

SEQ ID NO: 69060 - protein, 228 aa, Vitis vinifera
MRDDRERSRGRGGGGGGSGKDKIDALGRLLTRILRHMASELNLNMRSDGYIRVEDLLKLNMKTFANIPLRSHTIDDIREAVRKDNKQRFSLLEENGELLIRANQGHTVTIVESESLLKPILSAEEVTVCVHGSYKRNLESILESGLKRMKRLHVHFSCGLPMDGEVISGMRRDVNLLIFLDVRKALEDGMKLYISDNKVILTEGFDGVVPVKYFEKIESWPDRQTIPF

SEQ ID NO: 69061 - protein, 275 aa, Triticum aestivum
  misc_feature (21)..(21): Xaa can be any naturally occurring amino acid
  misc_feature (35)..(35): Xaa can be any naturally occurring amino acid
  misc_feature (46)..(46): Xaa can be any naturally occurring amino acid
  misc_feature (100)..(100): Xaa can be any naturally occurring amino acid
  misc_feature (110)..(110): Xaa can be any naturally occurring amino acid
GLQTPLFGKKGVSVFASKNPXEKIPWAPAGAEYVXESTGVFTDKDXAAARIKGGAKKVIISAPSKDAPMFVCGVNEREYKSDIDIVSNASCTTNCLAPLXLRVINDSFGXVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 69062 - protein, 135 aa, Zea mays
  misc_feature (68)..(68): Xaa can be any naturally occurring amino acid
  misc_feature (94)..(94): Xaa can be any naturally occurring amino acid
  misc_feature (111)..(111): Xaa can be any naturally occurring amino acid
  misc_feature (124)..(124): Xaa can be any naturally occurring amino acid
MARFILSLMELGVSATVHMLFGLYVFSTAVAADISQAAAASGCLLLRRPPPAAAGSTGGALVDVAAAXGESDELRGAAPVILDASPPAIVLGHXGFFGFGQGRPGGLSYFXGAKRRTNRLLVPXLGSLTSIMKQA

SEQ ID NO: 69063 - protein, 270 aa, Vitis vinifera
MASDDVSGSETDETEENSSSDEPGNPNNGETQAISEYEKQRLSRIAENRARLEALGLPKMASSLMGSDYTPPVAEEGSSSSNGDDDDDEKEFAGGRSSGARVQKVVLLSQCLDTEKIEGKENNIFSIMSNVPVQKISSNSEFVDDDDALKQAIALSLKDCPVATDRLQSGPSQSSDAGITSRVQMTEDELVIHFFQFDEAGKGGITLRDLQRMAYTHDFTWTDKEMADMIHCFDSDGDGKLSLEDFQKIVSRCNMLQRSETDNAGMGSKS

SEQ ID NO: 69064 - protein, 188 aa, Physcomitrella patens subsp. patens
MATERVSQETTSQAPEGPVMCKNLCGFFGSQATMGLCSKCYRETVMQAKMTALAEQATQAAQATSATAAAVQPPAPVHETKLTCEVERTMIVPHQSSSYQQDLVTPAAAAPQAVKSSIAAPSRPEPNRCGSCRKRVGLTGFKCRCGNLYCALHRYSDKHTCTYDYKAAGQEAIAKANPLVVAEKVVKF

SEQ ID NO: 69065 - protein, 458 aa, Pseudomonas putida
QQTIQTTLLIIGGGPGGYVAAIRAGQLGIPTVLVEGQALGGTCLNIGCIPSKALIHVAEQFHQASRFTEPSPLGISVASPRLDIGQSVAWKDGIVDRLTTGVAALLKKHGVKVVHGWAKVLDGKQVEVDGQRIQCEHLLLATGSSSVELPMLPLGGPVISSTEALAPKALPQHLVVVGGGYIGLELGIAYRKLGAQVSVVEARERILPTYDSELTAPVAESLKKLGIALHLGHSVEGYENGCLLANDGKGGQLRLEADRVLVAVGRRPRTKGFNLECLDLKMNGAAIAIDERCQTSMHNVWAIGDVAGEPMLAHRAMAQGEMVAEIIAGKARRFEPAAIAAVCFTDPEVVVVGKTPEQASQQGLDCIVAQFPFAANGRAMSLESKSGFVRVVARRDNHLILGWQAVGVAVSELSTAFAQSLEMGACLEDVAGTIHAHPTLGEAVQEAALRALGHALHI

SEQ ID NO: 69066 - protein, 705 aa, Vibrio vulnificus CMCP6
MSEQKAFNLKIDEQNIAWLGIDVPNEKMNTLQAAFADEMKAIFAQLKDSSGLKGLIVHSLKPDNFVAGADVRMLEACKTAPEAEALARQGQELFQQLSDLPYPVVAAIHGPCLGGGLELALACDFRVCSDDDATRLGLPEVQLGLLPGSGGTQRLPRLIGLLPSLDLILTGKQLRANKAKKLGVVDACVPQTILLDVAKQFVEKGKKRAKQKVTTKEKLLSGSGLGRKFVFEQAAKKTHEKTRGNYPATVAILQVIQHGLEKGMKQGLELEAKRFGELVMSNESKALRSIFFATTEMKKETGSEAKPSKVGMVGVLGGGLMGAGISHVSVAKAKVPVRIKDVSNDGVLNALKYNYKLFDKQRKRRILSKAQLQSKMLQLSGGTDFTSFNRTDVVIEAVFEDLSLKQQMVADIEANAKPETIFATNTSSLPIHKIAEKAQRPENIVGLHYFSPVEKMPLVEVIPHESTSEETIATVVALAKKQGKTPIVVKDQAGFYVNRILAPYMNESAHILLANEPIDKIDTALLDFGFPVGPITLLDEVGVDIGAKIMPILVAELGARFKGPDVFDVLLNDGRKGRKSGKGFYTYKGKKKEVDKSVYKLLKLTPESKLSDNDIALRCVLPMLNEAVRCLDDGIIRSPRDGDIGAIFGIGFPPFLGGPFRYMDQFGLKELVEKMNQFAEKYGDRFAPCDGLLTRAGEGRRFYDN

SEQ ID NO: 69067 - protein, 392 aa, Prochlorococcus marinus subsp. pastoris str. CCMP1986
MKAMILAAGKGTRVQPITHIIPKPMIPILQKPVMEFLLELLKEHGFKEIMVNVSHLAEEIENYFRDGQRFGVEIAYSFEGRIEDGEMIGDALGSAGGLKKIQDFQNFFDETFVVLCGDALVDLDLTEAVKNHKKKGAIASLITKKVTREQVSSYGVVVSDENGRIKAFQEKPDVEDALSDSINTGIYLFEPEIFNYIPSGDKFDIGADLFPKLVEMDLPFFALPMDFEWVDIGKVPDYWSAIRNVLLGKVRQVEIPGKEIKPGVFTGLNVAANWDKVNIKGPVYIGGMTRIEDGATIIGPSMIGPSCCICEGATIDNSIIFDYSKIGKGVQLVDKLVFGRYCVGKNGDHFDLKDASLDWLITDSRRLDLTEPSPQQKAMAELLGTDLINIPD

SEQ ID NO: 69068 - protein, 359 aa, Saccharomyces cerevisiae YJM789
MALVSRRSTRSESTSITKEEHTGEGSLTKLFFRWLVTLEGDQDINDGKGYISIPNVSNYIFFLGGRFRTVKGAKPLWLGVLFAIICPMVLFSIFEAHKLWHTQNGYKVLVIFFYYFWVITLASFIRTATSDPGVLPRNIHLSQLRNNYQIPQEYYNLITLPTHSSISKDITIKYCPSCRIWRPPRSSHCSTCNVCVMVHDHHCIWVNNCIGKRNYRFFLIFLLGAILSSVILLTNCAIHIARESGGPRDCPVAILLLCYAGLTLWYPAILFTYHIFMAGNQQTTREFLKGIGSKKNPVFHRVVKEENIYNKGSFLKNMGHLMLEPRGPSFVSARKPHEAGDWRFMDLSPAHSFEKIQKI

SEQ ID NO: 69069 - protein, 791 aa, Oryza sativa Japonica Group
MAAAAAAAAPRHHHHHVVVGSSRSAPVSVSVCVRRWCGGASSSALLRVGMIGGASASSAEGRGRRRWWRRGRRALRVRAAAGMDIASAVEVINDLGFDTLTFLGVTVLVVPAFRVVKASPILGFFCAGVVLNQFGLIRNLTDVKLLSEWGILFLLFEMGLELSLSRLKALARYAFGMGLPQVLLSTLAFTAFELPPNGAIGTKILQFLFDSRPDLVNIRSVDEAIVIGAALSLSSSAFVLQLLAEKGELPTRFGSATLGILLLQDIAVVPLLVILPVLESQNVVEQSVWPMLLAESLKALGGLGLLSLGGKYLIRRIFEFVAESRSSEAFVALCLLTVSGTSLLTQWLGFSDTLGAFLAGAILAETNFRTQIEADIRPFRGLLLGLFFVTTGTSIDMELLIREWPNVLSLLGGLIAIKTLIITAIGPRVGLTLQESVRIGLLLSQGGEFGFVVFSLANRLGVLPLELNKLLIIVVVLSMALTPLLNEIGRRAAGIIDEKSETKEKPAEMVNYDATEPIVILGFGEMGKVLAKFLSAPLSFGLDKDAEGWPYVAFDLNPAVVKSARKSGFPVLYGDGSRPLVLQSAGVSSPKAVMVMYTGKEKTIEAVNRLRQAFPGVPMYARAQDMSHLLDLKKAGATEVVLENAETSLQLGSMLLRGLGVMSDDVSFFSKLVRDSMELQAQEALNNIENREIDIMKPLEIRISDLVERNGNGSRMIAQEDSLRLSSRPNIPLIEATLEDRIPETTGENDQTGYDFNNIDSEDGVKYCLLEASDDESEASNSSKEMIDQSV

SEQ ID NO: 69070 - protein, 197 aa, Anaplasma phagocytophilum HZ
MNLVPMVVEQTGRGERAYDIYSRLLKERIIFVTGPIEDEMASLIVAQLVFLEAEDPEKDISMYINSPGGVVTAGLSIYDTMQYIKPNVATLCLGQAASMGSLLLCAGAPGMRCALPNSRVMIHQPSGGFRGQATDIEIHAREILEIKRRLNEIFVRHTGKSLEEIESSMERDNFMIAEKARDFGIIDKVIEKRIEEK

SEQ ID NO: 69071 - protein, 474 aa, Escherichia coli CFT073
MQHKLLINGELVSGEGEKQPVYNPATGDVLLEIAEASAEQVNAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTAACRIYAQKGIYDTLVEKLGAAVATLKSGSPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 69072 - protein, 396 aa, Prochlorococcus marinus str. MIT 9303
MIFAYCLLSRRLSRTAVSGPLVFVALGLVLGPANLGWLNISLDSALLRRLAEITLGLVLFTDAAALDWAVLRNSARLPMRLLLLGLPLSILMGFVVARLILPELGLIEAVLLAVVLAPTDAALGEAVTTNLEVPEAIREDLNVESGLNDGICVPMLLCFLGISTGHLDQINGPKDALQSFGQLLVSEIGIGLVIGAFIGLLGSWLRDQAEQRKWIAEDWRPLITVALALSAYTLAQTLHGSGFISCFIAGLLYGICSRKELKDGEMVASLAMGDMLALLTWVLFGSAMVPDAWSNITVASVVYGALSLTLVRIVPVALATSGLGLDHWTKLFVGWFGPRGLASIVFVVMVVDAALPNAQAILTTTTVTIVLSVIAHGITANRFSMFYGRWERSHAG

SEQ ID NO: 69073 - protein, 472 aa, Acinetobacter sp. ADP1
MTTKILPVIMAGGSGTRLWPLSRTQYPKQFLKLSPDGYTLLQATLLRLKNLDCADPLLICNEEHRFLAAEQMREIGISAKIILEPEGKNTAPAITLAALYQIQQAQDSDTIMLVLAADHVITEQDKFEQSITQALELAKLDKLVTFGIVPTHAETGYGYIEKGNSELNGFQVQRFVEKPDAATAQEYLESQKFLWNSGMFMFKADIYLNELQQHAQDIYNSCVASMQDTKADLDFIRIDKEAFKQCRSESIDYAVMEQTKDAVVVPLDANWNDVGSWSALWDIQDKDDQGNVIQGDVITVKSQNNYVFSESRLVSLLGVDNLVVIETKDAILVADKSKVQDIKKIVESIKEQGRTEHFCHREVYRPWGKYDSIDHAERYQVKRITVKPGQKLSIQMHHHRSEHWIVVNGTAKIHKGKESFLLTENQSTYIPLGEIHALENPGKVPLELIEVQSGSYLGEDDIVRFEDLYGRC

SEQ ID NO: 69074 - protein, 200 aa, Phanerochaete chrysosporium
MVAQVQKPAPTFKAQAVVDGVFQDVSLSDYLGQWVVLFFYPMDFTFVCPTEILAFNDSLEAFKELNTVVLGVSTDSAYSHFAWASQPRNQGGLGPNLKLPLIADRNMKISRDYGVLLEEDGVALRGLFIIDPKGVLRQITVNDLPVGRSVDETIRLIKAFQFVEKYGEVCPANWKEGGKTMKADPKGSLEYFSTVNTNAQ

SEQ ID NO: 69075 - protein, 499 aa, Triticum aestivum
  misc_feature (38)..(38): Xaa can be any naturally occurring amino acid
AADGAGAAAGFTVVMKFGGSSLASAARMRDVADLVLSXFPEETPVVVLSAMGKTTNNLLLAGEKAVSCGAPKASEIYELAVIKELHLRTIDELGLDSSIVSGFLDELEQLLKGVAMMKELTLRTRDYLVSFGECMSTRIFSAYLNKLGKKARQYDAFDLGFITTDDFTNADILEATYPAVAKRLHGDWIDDPAIPIVTGFLGKGWKSCAVTTLGRGGSDLTATTIGKALGLREIQVWKDVDGVLTCDPNIYANAVPVPYLTFDEAAELAYFGAQVLHPQSMRPAREGGIPVRVKNSYNRHAPGTVITKTRDMRKSILTSIVLKSNITMLDIVSTRMLGQYGFLAKVFSIFEDLGISVDSVATSEVSISLTLDPSKLWSRELIQQELDHVVEELEKIAVVHLLQHRSIISLIGNVQRSSLILEKAFNVLRRNGVNVQMISQGASKVNISLVVNDSEAKQCVQALHSAFFENGFLSEVEEADLAQKRAPVLVSSNGAINGN

SEQ ID NO: 69076 - protein, 424 aa, Blastopirellula marina DSM 3645
MKLQMIGLSHHNASVEIRERLAFSPDQAQEALKTFRSRFPDIESVLLSTCNRTEIYTAALDGNLCPTHHDMVQFWAEFHQLEAKDVFDNVLERTGEDVVRHLFTVAASLDSMVVGEAQILSQVKQAYELSTQIDSAGTLTHSCFQAAIRVAKRVSNETTIHKKRVSIPSVAVSDFASNVFDRFDDKNVLIIGAGEMAEETSRYLLDVGAKEFTVVNRSLERAERLAATFAGKALHWDQLHEAVIAADLIVSTTGATEPIIRLEEYKQLEAARFQRTLFVLDLAIPRDFDPRIAERVGVYLFSIDDLRQTCDKNRAAREREWPKAERIIEDETAKFMADLNHRATAPTIRRLKQRSDELKDEELKRLLNKLGDIDPRIADEIIRSFDRLVNKLLHPPLESLRDEAGSASSDSLLDALKRLFRLYD

SEQ ID NO: 69077 - protein, 430 aa, Acinetobacter sp. ADP1
MSCRMPLDLQNLRIAIIGLGYVGLPLAVEFGKHVSVVGFDIHQKRVAELQQGQDHTLEVTPEELKQAQLLSYSCDLSDLKDCNFFIVTVPTPIDQFKQPDLTPLIKASQSIGKVLKKDDIVVYESTVYPGATEEVCVPVLEQVSGLTFNQDFFTGYSPERINPGDKAHRVTNILKITAGSTPEVADYVDAVYQLIIEVGTHKAPSIKVAEAAKVIENTQRDVNIALINELAIIFNKMGIDTQDVLEAAGTKWNFLPFRPGLVGGHCIGVDPYYLTHKAQAIGYHPEIILAGRRLNDNMSMYVANQLIKSMNKKRIQIEDAKVLILGLTFKENCPDIRNTKIVDIISELKDFNMQVDVYDPWADAEETRHEYAIDLIAEPAQGSYDAIILAVAHQQFKAMGAAAIHALGRSNHVIYDLKYVLDRQQSDIRL

SEQ ID NO: 69078 - protein, 132 aa, Helicobacter pylori
SNIKYELDKESGALMVDRVLYGAQNYPANYGFVPNTLGSDGDPVDALVLSDVAFQAGSVVKARLVGVLNMEDESGMDEKLLALPIDKIDPTHSYVKDIDDLSKHTLDKIKHFFETYKNLEPNKWVKVKGFEN

SEQ ID NO: 69079 - protein, 343 aa, Acinetobacter sp. ADP1
MTAYQKQCITLQAAPKTWLITGVAGFIGSNLLETLLKLDQRVIGLDNFATGHQHNLDEVQGLVSREQWNNFKFIRGDICQLQDCQAACEGVDYVLHQAALGSVPRSLVDPITTNSVNIGGFLNMLVAARDAQVKSFTYAASSSTYGDHPALPKLEDHIGKPLSPYAVTKYVNELYADVFARSYGFYCIGLRYFNVFGQRQDPNGAYAAVIPKWTAAMIQGEDVFINGDGETSRDFCFIENTVQANLLAATTQDAAAKNQVYNVAVGDRTTLNQLFATLQSALAENGIHYNKPAVYREFRAGDVRHSQADIGKISQLLGYQPEYRFAQGVHKAMHWYVQDLTSA

SEQ ID NO: 69080 - protein, 109 aa, Zea mays
MLRTGGRWLLAPGLWWRGLGTGATTYVDLATTTAGVSAYHEQVMDHYNNPWNIGSFNKDDPNVDTGLVGASACVDIMKLQIYVDKDSNKIVDACFKTFGCGSTIVSSPH

SEQ ID NO: 69081 - protein, 540 aa, Gibberella zeae PH-1
MPQKSENQNKSVMATTAQDHLEFGGKISWLASLDTAFRPERNYRRSSIICTIGPKTNSVEAINKLRDSGLNVVRMNFSHGSYEYHKSVIDHARESEATHAGRNVAIALDTKGPEIRTGNTPGDEDIPISVGHEMNITTDDAYATASDDKNMYVDYKNITNVIEPGRIIYVDDGVLAFDVLKIVDEKTILVKARNNGAICSKKGVNLPNTDVDLPALSEKDKADLKFGVENNVDMVFASFIRRAQDIYDIRDVLGEQGKRIQIIAKIENRQGLNNFREILEATDGVMVARGDLGIEIPAAEVFAAQKKLIAMCNLAGKPVICATQMLESMIKNPRPTRAEISDVGNAITDGADCVMLSGETAKGSYPSEAVKEMHEACLKAENTIPYVSHFEEMCTLVKRPVSTVESCAMAAVRASLDLGAGGIIVLSTSGESARMLSKYRPVCPIFMVTRSPTTSRFAHLYRGVYPFLFPEQKPDFAQVNWQEDVDRRIKWAVNNALELNVLTPGDTVVVVQGWKGGMGNTNTLRIVKADPEHLGIGQLQ

SEQ ID NO: 69082 - protein, 278 aa, Magnaporthe grisea 70-15
MSTAAPQTNGVPPASGSQQTQTTNAFSSQQSSSQQPPAAGQPPQPAGATGASQSQQPQADSTPAPRPRDARTIELLLTAQGVTAFEPRVPLLLLDFAYRHTAAVLSDALHLAGDPYTTHAGAKPSAAQNATASAPSGGDASVSASAIQVAIASRLAFQFRGGGSTSKEFLLETARERNKAALPRILPHEWGVRLPSERFVLSGNAWGLTDTWGPGEAGIDDDDDDDSEDADAEMRDAMEGVETQGGDQVDEEVGGEPVEGGTVDDVFGDDVDEEMAEE

SEQ ID NO: 69083 - protein, 283 aa, Leccinum brunneogriseolum
  misc_feature (144)..(159): Xaa can be any naturally occurring amino acid
INIVAVNDPFIDLEYMVYMFKYDSVHGRFKGDVHAKDGKLYINGKAITVYAERDPANIKWGAVGAEYVVESTGVFTTIEKAGAHLKGGAKKVIISAPSADAPMFVCGVNLDKYDPKYTVISNASCTTNCLAPLAKVINDKFGIXXXXXXXXXXXXXXXXTVDGPSAKDWRGGRAVNGNIIPSSTGAAKAVGKVIPTLNGKLTGLAFRVPTNDVSVVDLVVRLEKSASYDEIKAAVKAASESPDLKGIIEYTDEALVSTDFTGHPASSIFDASGSIMLNPNFVK

SEQ ID NO: 69084 - protein, 476 aa, Oryza sativa Japonica Group
MGKAAAMEVSASAAAEAGMMVGHGEWRDDDGRARRMGTVWTASAHIITAVIGSGVLSLAWAIAQLGWVAGPAVMLLFAFVIYYTSTLLAECYRSGDPCTGKRNYTYMDAVRANLGGSKVRLCGVIQYANLFGVAIGYTIAASISMLAIKRADCFHEKGHKNPCRSSSNPYMILFGVVQIVFSQIPDFDQIWWLSIVAAIMSFTYSTIGLSLGIAQTVANGGFMGSLTGISVGTGVTSMQKVWRSLQAFGDIAFAYSYSIILIEIQDTIKAPPPSEAKVMKRATMVSVATTTVFYMLCGCMGYAAFGDKSPDNLLTGFGFYEPFWLLDVANAAIVVHLVGAYQVFVQPIFAFVERWAAARWPDGGFISRELRVGPFSLSVFRLTWRTAFVCATTVVSMLLPFFGDVVGLLGAVSFWPLTVYFPVEMYIAQRGVRRGSARWLCLKVLSAACLVVSVAAAAGSIADVVDALKVYRPFSG

SEQ ID NO: 69085 - protein, 511 aa, Solibacter usitatus Ellin6076
MSNTEKLELKREHLKLGGGAQRIEKQHQSGKLTARERVTLLADRDSFQEAGLFARHNGKHFGMNDKVLPADGVVTGRARVHGRPVHLASQDFTVAGGSAGEVHANKIADTMKASMKTGTPFIFINDSGGARVQEGVSSLSGYAKIFHQNVMLSGVVPQISLICGPCAGGAAYSPALTDFIIQTRDGLIFITGPTVIKQVTGEMVTAQELGGARAQMNKSGVVHFVAENDVEAMQICKRLLSFLPSNNMEDPPRIESSDDRTYEHRLNHVVPPEPKCGYDVRDVINLVVDYGDFLEVQSEFARNLVVGFGRMRGATVGIVANQPSVLAGALDIDASDKGAGFVRFCNAFNIPLITFVDIPGFLPGVDQEYGGIIRHGAKLLFAYSAATVPKITVILRKAYGGGYIAMCAKDLGADCTLAWPGSEIAVMGAEAAVEIVFHRELVEARDPAAARQELIQEYRETFYTPYEAAALRLVDDIIEPARTRGYLADALETLSTKRDWRPQKKHGLIPL

SEQ ID NO: 69086 - protein, 286 aa, Arabidopsis thaliana
MATNAGYLRCKEERKNESFFKVVQSINVSSENKRALPHDFSRSFTDKELSRKMKIRAQWGNSWEVGISKNPRFYFMEKSGWEKFVRDNALGNSELLTFTHKGKMHFTVNIFKLDGKEMMQPPQSRSFFASSKQEENDIKEEVVVSSNRGQTTAAESKGRKLNLGKRAAKESQSSKRTEKVVRARSDYAGASSSTAAAFTILFKQGYLVFLRIPNSVSKDQVPDEKTVFKIHHPNGKKSWNVVYLERFGAFSGGWRRVVKEYPLAVGDTCKFTFIKPKELLLVVSKP

SEQ ID NO: 69087 - protein, 321 aa, Xanthomonas axonopodis pv. citri str. 306
MTILVTGAAGFIGAYTCRALAARGETVVGLDNYNNYYDPQLKHDRVATLCPGLDIRTLDLTDREGLAALFDEIQPTRVVHLAAQAGVRYSLENPHAYVDSNLVGFVNMLELCRHRGVQHLVYASSSSVYGDSATPPFSEDQRVDQPRSLYAATKAANELMGHTYAQLYGLRATGLRFFTVYGPWGRPDMAPLIFSRAVLAGRPIEVFNHGKMQRDFTFVDDIVAGVLGALDTPSDAPVPHRVFNLGNHTPVELEYFIDVIAQAAGRPAEKVYRPMQPGDMIRTMADTQRAQAAFGFDPATPVERGLPQVVEWCRQYFGERA

SEQ ID NO: 69088 - protein, 156 aa, Catharanthus roseus
IGWIYGSVTEDILTGFKMHARGWRSIYCMPQRPAFKGSAPINLSDRLNQVLRWALGSVEILFSRHCPIWYGYGGRLKWLERFAYVNTTIYPVTAIPLLLYCTLPAVCLLTGKFIIPQISNIASIWFISLFLSIFATGILEMRWSGVGIDEWWRNEQ

SEQ ID NO: 69089 - protein, 285 aa, Leccinum holopus
  misc_feature (69)..(69): Xaa can be any naturally occurring amino acid
  misc_feature (143)..(156): Xaa can be any naturally occurring amino acid
  misc_feature (263)..(263): Xaa can be any naturally occurring amino acid
NIVAVNDPFIDLEYMVYMFKYDSVHGRFKGDVHSKDGKLYINGKAITVYAERDPANIKWGAVGAEYVVXSTGVFTTIEKAGAHLKGGAKKVIISAPSADAPMFVCGVNLDKYDPKYTVISNASCTTNCLAPLAKVINDKFGIXXXXXXXXXXXXXXQKTVDGPSAKDWRGGRAVNGNIIPSSTGAAKAVGKVIPSLNGKLTGLAFRVPTNDVSVVDLVVRLEKSASYDEIKAAVKAASESPDMKGIIEYTDEALVSTDFTGHXDSSIFDASGSIMLNPNFVKLIS

SEQ ID NO: 69090 - protein, 246 aa, Candidatus Pelagibacter ubique HTCC1002
MTNKYMYFVANWKMYGNLSSLNTLDKVIRFSKSKEIKGGRLIYCPPNTLISSFAKKFNNCQIGIGGQNCHESKDYGAHTGHVNSRMLKNIGAHFVIIGHSENRKQGESDKLINLKIKSALEAKLKVIFCIGETLSEKRKKKTRSILSKQIKIGLKNIKNKSNIFIAYEPVWAIGSGIIPKSYDLFKTIEFIKSKFRDKLPKVLYGGSVNPENITNLKKINNIDGFLIGGASQSAKKFIDIVKKTYS

SEQ ID NO: 69091 - protein, 330 aa, Brucella melitensis 16M
MATFDVLCIGNAIVDILARTDDVFLETNGIIKGAMNLIDAERAELLYSRMGPATEMSGGSAGNTAAGIASLGGRSAYFGKVATDHLGRVFAHDIRAQGVAFDTRPLEKGSPTARSMIFVTPDGERSMNTYLGACVELGPEDVETSKVADARVTYFEGYLWDPPRAKEAIVMASKIAHESGRQMAMTLSDPFCVDRYRDEFLQLMRSRTVDIVFANEDEAKALYKTKSLETAIAAMRMDCRLSVITRSEKGAVVVTPDQTLTVPAIEIDDLVDTTGAGDLYAAGFLYGYTKDRSLEDCARLGSLAAGLIIQQMGPRPQISLEAAASQAGLI

SEQ ID NO: 69092 - protein, 219 aa, Zea mays
MKLNIANPTTGCQKKVEIDDDQKLRNLYDKRISQEVVGDLLGEEFKGYIFKIMGGCDKQGFPMKQGVLTSGRVRLLLHRGTPCFRGFGRRNGERRRKSVRGCIVSQDLSVINLVIVKKGENDLPGLTDTEKPRMRGPKRASKIKKLFNLGKDDDVRSYVSTYRRTFLNKKGKKVSKAPKIQRLVTPLTLQRKRARIADKKKRIAKKKSEAAEYQKLLAQ

SEQ ID NO: 69093 - protein, 140 aa, Oryza sativa
HASGRLVEEADFKSTTELFGKKDGSEKSLDTFIPKSESDFAEYAELIANKLRPYEKSFHYMGLLKNVMRLSMASLKGADAKDISSSIAAIANEKIKAEKEAAAGKKKQGAKKKQLHIENKDDDFIPGKGNFDDPDEYDFM

SEQ ID NO: 69094 - protein, 169 aa, Oceanobacter sp. RED65
MANERVDRNNDGELQEKLVQVNRVAKVVKGGRVFGFTALTVVGDGKGKVGFGRGKAREVPTAIQKAMEQAKRNMIDVQLDGDTLQYPVKATHSGSKIFMQPASQGTGIIAGGAMRAVLEMVGVHNVLAKCYGSTNPINVVRATVKGLREMRSPEQVAAKRGKSVEEILG

SEQ ID NO: 69095 - protein, 485 aa, Gibberella zeae PH-1
MSYRIPIGSTAGQHLLDPWTHGIGIMRDVCSRWSELDITQIGSLIAIAGTVPTAWRFLNTLWHEAYGTIRRFFLASVTVPGGDPLNRSVVKWIMANRERHYRSFHGRTDVGQNGDRAAALKKTRHSIQYSPHWNTRWLFWGGNLFLVTRRVDDFSSSLSDPSYDGIGGEEITVSCFGWSAEPIKSFIESCREYSDRQTQFFVIIYARDRYGLSWKPKARKPIRYLETVHFDNETKQDLLGDIRNYLDPKTQKRYQSRSMPYRRGYLFYGPPGTGKSSLSVAIAGEFGLDLYEVKIPSVATDADLEQMFQEIPPRCVVLLEDIDAVWTDRSNSDNGQENSSAPNCTLSGLLNVLDGVGSVEGRIIIMTTNHPEQLDSALVRPGRVDMKVLLGNISRKSAEEMFIRMFSPDLGCTAHMDMDEIKELAAQFAKEVPDDTFTPSLLQGFFQLHLESPHDAASSIGAWVKKELERSSEKEFEVITGKRRV

SEQ ID NO: 69096 - protein, 516 aa, Escherichia coli CFT073
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFLSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETSS

SEQ ID NO: 69097 - protein, 500 aa, Oryza sativa Japonica Group
MATNGSSPRARETESSLEKVKRQLSSGSGRYLLQGPLLKRSETLRKWNERWVILDPTSGKMEYKIRRNETAIKGTIIFDASSTITLSPVNFQGMPKYDGCCFYIGTPQKKDYFLCAETPGAAKAWVSTLLATQLVLQAHKEAVNSLAGNGSPATLGTVATAVANANATALEATKEIEAAMKVSMRAALGLGANNPKEGQLDDLTIMKETLRVKDEELQNLAKDIRARDATIKEIANKLTETAEAAEAAASAAHTMDEQRRLLCSEIERLRQAMERQMEQSMLKLRQSEEKVISLSKEKDQLLKERDAALQEAHMWRTELGKAREQAVIQEATIARADEKVRASEADAAARIKEAAEKLHAVEKEKEELLSLVGILQSQVQREQSSTKQVCEERSESCSGTDNSPPLTKHVDASDDDVDKACVSDSRSVLVSNDNTEVQLAVDGVDIRPIGDAEWGSFQQSEALIADVREVSPESEGGSLDIPVVNPPPVSDHIQGGATHP

SEQ ID NO: 69098 - protein, 543 aa, Blastopirellula marina DSM 3645
MTAAPSLTQTAAWQALQSHYDQLADVQLRDLFANEADRGEKFSLDAVGIYLDYSKNRITAETVSLLIALAEASGLRQRIDAMFRGDKINVTEDRAVLHTALRAPQGATIDVDGENVVPAVHAVLDKMAAFAAKIRGGDWRGQTGKPIKNIINVGIGGSDLGPAMAYDALKHYSDRNLTFRFVSNIDGADMAEAIHDLDPAETLFIIASKTFTTQETLTNAHTARLWCLETLKDEAAIAKHFVALSTNEKEVAKFGIDTANMFEFWDWVGGRYSFDSAIGLSLMIAVGGDHFREMLAGFHEMDEHFRTAPLDQNIPVLMALLNLWYNNFFGAQTQAVLPYDHYLGKFSMYLQQLDMESNGKRVTLDGSPVDYQTGPIVWGTPGTNGQHAYYQLIHQGTKLIPCDFIGFCQSLNPLGDHHDKLMANFFAQPEALAFGKTAAEVKADGVADFQISHRTFPGNRPTNSLLIDKLTPAALGKLIALYEHKVFTLGTIWRVNSFDQWGVELGKVLANRIVPELTSKSEPALEHDSSTNALIARYRKLKR

SEQ ID NO: 69099 - protein, 597 aa, Oryza sativa Indica Group
MAPMPAPAVALAVLVLLSAVPGYFSDDLNTDAQALQALRSAVGKSALPSWNSSTPTCNWQGVTCESGRVTELRLPGAGLMGTLPSNVLGNLSALRTLSLRYNALTGPIPDDLSRLPELRAIYFQHNSFSGEVPASVFTLKNLVRLDLAGNKFSGEISPDFNKLNRLGTLFLDGNSFTGEIPKLDLPTLSQFNVSYNKLNGSIPRSLRKMPKDSFLGTGLCGGPLGLCPGETALTPAGSPEGQNGSAAGNGAHVGAAAAAPAAATSAAVAAAAAAAKTGGATGGSKKLIFFGPMAAAPPFDLEDLLRASAEVLGKGAFGTAYKAVMESGSAVAVKRLKDVDLPEPEFRERIAAIGAVQHELVVPLRAYYFSKDEKLLVYDYMSMGSLSALLHGNRASGRTPLDWETRSAIALAAARGVAHIHSTGPTASHGNIKSSNVLLTKNYEARVSDHGLPTLVGPSFSPTRVSGYRAPEVTDIRRVSQKADVYSFGVLLLELLTGKAPTHAVVNEEGLDLPRWVQSVVREEWTAEVFDQELLRYQNVEEEMVQLLQLAIDCSAQHPDRRPSMSEVAARIDEIRRSSLGDRPATDSAGEGEEPSL

SEQ ID NO: 69100 - protein, 300 aa, Prochlorococcus marinus str. MIT 9303
MSKRHPVVAVTGSSGAGTSTVKRAFEHIFSREKITPAVVEGDSYHRFERMAMKEAMADALAKGENFSHFGPEANLFDKLEELFRTYGQTGGGKKRYYLHSTEEAAEHNSRLGTKLDPGQFTPWEEIPTKTDVLFYEGLHGGVVGDGYDVAACADLLVGVVPITNLEWIQKIHRDNAERGYSAEAIVDTILRRMPDYINHICPQFSRTDINFQRVPTVDTSNPFICRNIPTPDESFVIIHFRKGAREKWGIDFGDLLNMINDSFMSSPTSIVVNGGKMGFAMELILTPIIHRLIEDKHKLS

SEQ ID NO: 69101 - protein, 357 aa, Prochlorococcus marinus str. MIT 9303
MRQHRIVLLPGDGIGPEITAVAKLLLDAAGEQHGFKLNFEQHPIGGVAIDASGSPLPASTLEACQASDAVLLAAIGSPRFDALPREQRPETGLLSLRAGLKLFANLRPVTILPALIDASSLKANVIKGVDLMVVRELTGGIYFGQPKGRIEADGDERAFNTMTYSRTEVDRIAKVAFDLARDRSGKLCSIDKANVLDVSQLWRDRVDALAANYGDVELSHMYVDNAAMQLVRNPRQFDVLLTGNLFGDILSDEAAMLTGSIGMLPSASLGSEGPGLFEPVHGSAPDIAGQDLANPMAMVLCAAMMLRIGLKENDAATALEGSVERVLAAGFRTGDLMSEGCTQLGCAGMGEQLLQAL

SEQ ID NO: 69102 - protein, 295 aa, Acinetobacter sp. ADP1
MVDKMIKKAILPVAGLGTRFLPASKSIPKEMVTVVDRPAIEYVVREAVEAGITQIILVTHSSKASIENYFDRNFELETTLEQKKKHDLLAEISNIVPAGVTIVSVRQPQPLGLGHAVLCAKDVVGDDDFAVLLPDVLVKAKQATHDLTQMIARFDAAQAAQIMVEAVPDHLVDQYGIVDVAQIPAEGQSEVMKGIVEKPKQDQAPSNLSVVGRYILPAKIMQLLEQTPKGAGNEIQLTDAIALLQKTNVVEAYRMQGQTFDCGSKLGYLKAVLHYGLEHPKLGHDFKQLINELDL

SEQ ID NO: 69103 - protein, 490 aa, Merremia aegyptia
  misc_feature (488)..(490): Xaa can be any naturally occurring amino acid
MRINPTTSGSEVSAVDKKNLGRIVKIIGPVLDVAFPPGKMPNIYNALVVQGRDNEQTNVTCEVQQLLGNNRVRAVAMSDTDGLMRGMEVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYEIAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNXXX

SEQ ID NO: 69104 - protein, 280 aa, Leccinum schistophilum
  misc_feature (128)..(140): Xaa can be any naturally occurring amino acid
VNDPFIDLEYMVYMFKYDSVHGRFKGDVHAKDGKLYINGKAITVYAERDPANIKWGGVGAEYVVESTGVFTTIEKAGAHLKGGAKKVIISAPSADAPMFVCGVNLDKYDPKYTVISNASCTTNCLAPXXXXXXXXXXXXXGLMSTIHATSATQKTVDGPSAKDWRGGRAVNGNIIPSSTGAAKAVGKVIPTLNGKLTGLAFRVPTNDVSVVDLVVRLEKSASFDEIKAAVKAASESPDLKGIIEYTDEALVSTDFTGHPASSIFDASGSIMLNPNFVKLI

SEQ ID NO: 69105 - protein, 470 aa, Escherichia coli
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATMMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 69106 - protein, 486 aa, Merremia vitifolia
PTTSGSEVSAVEKKNLGRIVKIIGPVLDVAFPPGKMPNIYNALVVQGRDNEQTNVTCEVQQLLGNNRVRAVAMSDTDGLMRGMGVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMTLKT

SEQ ID NO: 69107 - protein, 178 aa, Prochlorococcus marinus str. MIT 9303
MTAPGPNINGEVPTVLVRDDEGRDLLCFLEQLIPLDDKDYALLTPVDTPVSLFRLIEGNDPELIETIASSEPILSVADVVLQEHDLTLVRSAVTLTVNGELDEPDPEELEDEETDDDSETYELLVSFMVQEQEYGLYIPLDPFFVVARMTDGQAKLVEGEEFDQIQPRIEVELEDREL

SEQ ID NO: 69108 - protein, 337 aa, Lentinula edodes
MAVKVGINGFGRIGRIVLRNALLNPEVNVVAVNDPFIALEYMVYMFKYDSVHGRFKGTVETKGGKLIVDGKEISVFGEKDAGAIPWSSVGAEYIVESTGVFTTIEKASAHLKGGAKKVIISAPSADAPMYVCGVNLDSYDSQHAVISNASCTTNCLAPLAKVIHDKFGIVEALMTTVHATTATQKTVDGPSNKDWRGGRSVNGNIIPSSTGAAKAVGKVIPSLNGKLTGLAFRVPTLDVSVVDLVCRTEKSATYDEIKAAVKEASKGPLKGILGYTEDHVVSTDFIGDNHSSIFDATAGIQLNKNFVKLIAWYDNEWGYSGRVVDLLVFAAKKDGAL

SEQ ID NO: 69109 - protein, 200 aa, Magnetospirillum magnetotacticum MS-1
MPFAVQDNVDHPVSLYAATKKANELMAHSYSHLYRLPTTGLRFFTVYGPWGRPDMSPFLFVRAILEGKPLKVFNYGKHRRDFTYIDDIVDGVIRVLDHVAAPNAQWSGLKPDPASSAAPWRLYNIGNSQPVELLDYIKHIEQALGKTTHKELLPLQPGDVEHTYADVEQLKIDTGYAPDTPIESGIQRFVNWYKDFYNIS

SEQ ID NO: 69110 - protein, 132 aa, Helicobacter pylori
SNIKYELDKESGALMVDRVLYGAQNYPANYGFVPNTLGSDGDPVDALVLSDVAFQAGSVVKARLVGVLNMEDESGVDEKLLALPIDKVDPTHSYVKDIDDLSKHTLDKIKHFFETYKDLEPNKWVKVKGFEN

SEQ ID NO: 69111 - protein, 180 aa, Triticum aestivum
YLPCALAPPVMALSGTSVAPFQGVKSTAGLPVSRRSNGGSLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 69112 - protein, 661 aa, Oryza sativa Japonica Group
MGARWGPRRATVGPHLRDALRHLLFVFLVLLQAQAGRGGATLNGEGMALLELRERVEADPHGALRDWDPADATPCRWSGVHCFDGKVEILNLTGRELVGTLAPEIGRLQLLKSLILRNNNFRGKIPKEFGGLTALEVLDLSSNNLDGTIPEELMAMPLLKQLSLHDNQFQDDISSLHIQDISDEQAGCLSRKLGCWYVGYFGLGEPHIMQNLQSFASAVGRRLLGEVGNLPALSGNYAKSSGPVNSEEIQRAIDVLSLGSGSFSAFPNSEAEVLESAVNTDAAAMQSGAANQSTDEVSGSKHSKWAYFMIIPAAILLISLIVAPILVWRKRGRAAIGPWKTGLSGPLQKAFVTGVPKLNRPELEAACEDFSNIINTFPSCTVFKGTLSSGVEISVVSTAILSLKEWPKSSETCFRKQIDTLSRVNHKNFINLLGYCLENQPFMRMMVFEYAPNGTLSEHLHLKEFEHLDWAARMRIIMGVAYCLQYMHHDLNPPVAITDMRSDTIFMTDDYAAKIADVGIWKEVAIKAKTAKEDSSSRSECPPDIASNVYCFGTLLIEIISGKLPEADDQKSMCNWAAEYLKGKSYSKLVDASLKEHNANELEAVCEVIQECIDPDSDQRPTMRDATRKLRQALNISPEAATPRLSPLWWAELEILSAEAT

SEQ ID NO: 69113 - protein, 261 aa, Chlamydomonas reinhardtii
MPVPEALKDSPHHRYLEVAIDAAVAAGDVIKGSFKGPKQVEEKLNHADLVTATDKAAEDLIFGRIRAAFPDHAFIGEESAAAAGGAAALTDAPTWMVDPLDGTTNFVHGFPFVCTSIALVVGRRVVVGVVYNPVLGELFAAAAGGGACLNGAPLATSAATELAGALMGTEVGTARDEETVDSTFGRVRALTSKMRSVRCGGSCALGLCNVAAGRLDAFYEINFGGCWDSAAGALMVSEAGGTVLDPAGGPWDVMSRRVLAA

SEQ ID NO: 69114 - protein, 97 aa, Arabidopsis thaliana
  misc_feature (31)..(31): Xaa can be any naturally occurring amino acid
  misc_feature (37)..(37): Xaa can be any naturally occurring amino acid
  misc_feature (39)..(39): Xaa can be any naturally occurring amino acid
  misc_feature (43)..(43): Xaa can be any naturally occurring amino acid
  misc_feature (47)..(47): Xaa can be any naturally occurring amino acid
  misc_feature (49)..(49): Xaa can be any naturally occurring amino acid
  misc_feature (56)..(57): Xaa can be any naturally occurring amino acid
  misc_feature (60)..(60): Xaa can be any naturally occurring amino acid
  misc_feature (62)..(63): Xaa can be any naturally occurring amino acid
  misc_feature (65)..(65): Xaa can be any naturally occurring amino acid
MASSMLSSATMVASPAQATMVAPFNGLKSSXAFPATXKXNNDXTCMXSXGGRVNCXXVWXAXXKXKGLVWIGGPLSPFRAPVAWVVSDAKARGEGTA

SEQ ID NO: 69115 - protein, 581 aa, Aspergillus oryzae
MSSSKSEDYKVGAYIGYRMEELGVSDYFVVPGDTNLTLLDSLLENPRLRMVECCNELNTGYAADGYARASECKTAVAVIPYIVGGLSILNAISGACSERLKVIVISGCPPTSVLTSSKPTHHTPSPTNKDVALHAFQGVTAASVRVNTAESATDVIDNAIIKCIQQSLPVYIELPNDIAGAPCPFPIPFTRKVEEATQLNRNGEALEAVTDLWNSSHRPVLLLGSQARVSLPRDIVQRLSEKLGCPVLCQPDGRWLSESHPQYWCTFWPGLLNPEGEKLVLDSDLWLAIGVSWSDLHTHSIDPKEENHRLIALQHDGVELPEDKVISPVNLRELVSAMIDSNIIRRSESLPSSKPSHPAGIQTEIKTSDDALTVRSLLSGVQAMLQENSKLVVDTGDTWFAASHVELPDGVDIYMQLPYASIGWSVPATLGAQVAHPHGRVVLMVGDGAFQMTAQEISTMVRMKLNPIIFLFNNLGYKTETAVHEGSYNYIANWDYTKLATSFLDKPHAHPPSPYATDKPGDDEMPVFAEKVRTQADLLRAMERVSAESDKLAFLECCIQPDNMTPELRALGEKVSKGVSK

SEQ ID NO: 69116 - protein, 352 aa, Haemophilus somnus 2336
MSINFVKEGNIMSKYVRSVCLVEPKKVDIKTVLYPKKGECDVLIKVESIGICGSDIGAFRGTNPLVTYPRILGHEIVGTVIEAGVGMPKNINIGDRVILEPYIYCGHCYPCSISRTNCCEALKVLGVHIDGAMQEIVRHPAHMLIKAPDIPIHELALAEPLTISLHAIRRTKVKAGEHVAIIGAGAIGLMAALVAKAYGATPILIDILDKRLDYAKSIGIPNIINPAKENDLEAIKSITNGRMAEVVIEASGANIAVQNTLKYTSFAGRIALTGWPKNETPLPTNLITFKELNIYGARTSKGEFEEALKLLESRKIEPKNIISKVITFDEIPHYIEELSENPDDYLKIIAVF

SEQ ID NO: 69117 - protein, 423 aa, Acinetobacter sp. ADP1
MKIAIFGTTLHAGVMAALLAERGNDVFWCADHDYKGLEEQIVCQTYQEQDVNRLLVKQRQLGFLKDCRFSSIPLDIEAYLFCFSPTELQFALEVTQLLNIRPIIHPRLMINGSTFGLHGTEKLKQNLPKDHWVYFPDMIQEGNAINSVLTVKHVIVGVESDYTKTIMHEMLRPFFRFNHQYLFMPILDAEFTKLSISGMLATRISYMNDMALVAEKLGIDIANVKEGMAADTRIGSAYLSAGVGFGGENFSHDILTLSNVVSDTGARSRLLEQVWEINEQQKEVLFRKLWNYYHCDLKDKVVAIWGAAFKENTSNIHNAPIHSMLTALWAQGAIVKLHDPQALEEIQARYGKRNDLILCTEQYEATRGAHALCVMTVWKQYLSPDYKKLQQLMAHPFILDGRNVYDPVYIKQQGFAYEGIGRL

SEQ ID NO: 69118 - protein, 557 aa, Acinetobacter sp. ADP1
MNKNIEQFPRKTTLTPQQKLEQLMEQHKTVHLTELFDKEQDRFAKYCVGCEDLVFDFSKQRINQPILDALVQLAESKQLNKWIDTLFSQNKINYTEQREAMHWALRLPADNQVYPELAKQVSDQLERMYQLVNKIHEGQYRGATGEVIQDVVNIGVGGSDLGPLMVSHALSDFKVKTAKPLNIRFVSTMDGSQLSDILHQLRPETTLFIVSSKSFSTIDTLSNAHTARKWLEKALGRESSILKSHFIGVSTKPDKMTEWGIHPDNQFLLWDWVGGRYSLWSCIGLPIALTIGVEGFKAFLAGAHGIDEHFRTTEFHQNIPVLMGLMGIWNTNYLNLKTHAVLPYDGRLKYFTSYLQQLEMESNGKSTQRNGQKVENTTCPIVWGEVGPNAQHAFYQLLHQGTQKVSCDFIAPMHRYNANHFTYVENADALIDQHLLALSNCLAQSRLLAFGNDALKVDQREQLPAYKQYEGNQPSTTMLLKELSPRTMGKLIALYEHKVFVQSVIWDINPFDQWGVEKGKEIANDLLPILNGESSDLSHLDDSTQGLIQFLLGKSNG

SEQ ID NO: 69119 - protein, 339 aa, Acinetobacter sp. ADP1
MAKILVTGGAGYIGSHTCVELLNANHSVVVVDNLSNSSEEALFRVQQLTGKSLDFVQGDIRDSTLLDQVFAQYSIDAVIHFAGLKAVGESQQIPLAYFDNNIAGSISLVKAMERAGVFKLVFSSSATVYDEANTSPLNEDMPTGMPSNNYGYTKLIVEQMLEKLAIADTRWSIALLRYFNPVGAHQSGQIGEDPQGIPNNLMPYVTQVAVGRRQKLSIFGDDYDTIDGTGVRDYIHVVDLANAHLCALNNRLNAVGCRAWNIGTGNGSSVLQVKDTFEQVNGVAIAFEFAPRRLGDVATSFADNQRALDELGWVPRYTLEDMLKDSWNWQKQNPQGYSN

SEQ ID NO: 69120 - protein, 181 aa, Vibrio vulnificus CMCP6
MTTNTIAQIQASIKSIPDYPKPGILFRDVTSLLEDAQAYQATIQLLVDKYKDMGFTKVVGTEARGFLFGAPLALQLGVGFVPVRKPGKLPRNTIAQSYELEYGVDTLEIHTDAIVEGDKVLVVDDLLATGGTIEATTKLIRQLGGVVEHAAFVINLPEIGGDKRLEGLGLNVYSICEFEGH

SEQ ID NO: 69121 - protein, 734 aa, Vibrio vulnificus CMCP6
MSYLALARKWRPRQFKEVVGQGHVLTALENALEHNRLHHAYLFSGTRGVGKTSIGRLFAKALNCETGITSAPCGQCDTCREIEEGRFVDLLEIDAASRTKVEDTRELLDNVQYKPARGRFKVYLIDEVHMLSRHSFNALLKTLEEPPEYVKFLLATTDPQKLPVTILSRCLQFHLKPITVDAIHQQLDFILAKEGVTAQARALGMIAHAADGSMRDALSLTDQAIALGNGQIETDLVSHMLGTIDTDQAIHLLEAISSKQPQVAMDKIQQLAQNGAEWDGLLQQLATQLHRIAMYQLLPSSLDKAQPDAEKIELLSRALSPQDVQLFYQIALKGRDDLSLAPNGRIGMEMIVLRMMAFRPADVSQANIISAQGADLASAPAAQSAAPQVSTSPAQTAPAMSAKPSAERVAPAERPQAVSHAPSRPTSSMNAPSSVAPQPVQTEMPPQYDAPPMDYADYPPMDDMPPMGYGYEDAAALQPEPQPAPQPAPQHTPESASPASGGLTGLRHQLRSQRQGLAQNGGSKKSKAASAEKESVLDRVAQKQATAAQVSPRQSLAPSEPEVKEDEPYQWRPSQPVVQSKSKELTPTEIKRALEHEKTPEMAEKLVAESLEQSEWAKLITQLETAKLVEQLALNSAFNKDGSTIALTLRSHQQHLNTDKAQKELLSALNETLGETCHLSVEVGEQGETPLELRERLYQQKLQQAMSSLENDTHVQFILRRFSAELDRDSVRPV

SEQ ID NO: 69122 - protein, 436 aa, Yarrowia lipolytica CLIB122
MTQGNIGAWQKSVGDALAPGEVLVEIETDKAQMDFEFQDDGYLAKILLDAGAKDIAVGTPIGVYVEDEADVAAFKDFTIDDAGGVPKPPKTEEQKEEEEYEAEKAEKAEKEAEASKETASPAPSSQSSAPAAPTPPSSRIFASPMAKTIALEKGIKLSEIKGSGPGGRIIKRDVENWTPPAAPAAKAAPAKGAAPAAAAAAGSAYTDIPLTNMRKTIASRLTQSKNTSPDYIVSSTVSVSKLLKLRAALNASSDGTYKLSINDLLVKALAVANTKVPQVNSQWLESEGVIRQFTNVDVSVAVATPTGLITPVVKNANLKGLAEISKEIKALGKKAKDGKLAPEEYQGGTVTISNLGMNHAVSFFTAIINPPQAAILAVGTTERKAIEDVDSEAGFVFDDVVTLTTSFDHRVVDGAVGGEWVKALKQVVENPIEMLL

SEQ ID NO: 69123 - protein, 132 aa, Helicobacter pylori
SNIKYELDKESGALMVDRVLYGAQNYPANYGFVPNTLGSDGDPVDALVLSDVAFQVGSVVKARLVGVLNMEDESGVDEKLLALPIDKIDPTHSYVKDIDDLSKHTLDKIKHFFETYKDLEPNKWVKVKGFEN

SEQ ID NO: 69124 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYREHNSSPGYYDGRYWTMWKLPMFGCTDGTQVLAEVQEAKNAYPQAWIRIIGFDNVRQVQCISFIAYKPEGY

SEQ ID NO: 69125 - protein, 381 aa, Clostridium perfringens str. 13
MTKDELLKQRELAHGLISINPNFDINNREQLSQIYTPGVSTICKEVEHHHNMVKTLTSVGNSIAVITDGTAVLGLGNIGTLAGYPIVEAKALVYKDLAGVNAIPLCVDQIGCNELIKTIKSISPSFSGIHLEDIKAPECFYIEEELKKTLNIPVYHDDQHGTAIAVLGALYNGAKVVNKDFLKLKVLILGAGASGIATAKLLLKAGIEDIILVDKNGALVNGDETLNAPQKEMAKITNKEFKKGTLKEVIKGRDVFIGLSEGNLVTKEMVESMNEDPIIFALANPTPEIKPEIAKEAGARVIATGGPSYPNQINNILVFPGLFKGLLEAKATDVTCDVMIAVGKKLASLVENPTAEKIIPGVFDGDIVKSVSETVVKNIEN

SEQ ID NO: 69126 - protein, 490 aa, Operculina pteripes
MRINPTTSGSEVSAVEKKNLGRIVKIIGPVLDVAFPPRKMPNIYNALVVQGRDNEQTNVTCEVQQLLGNNRVRAVAMSDTDGLMRGMGVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMTLKT

SEQ ID NO: 69127 - protein, 226 aa, Archaeoglobus fulgidus
MENFEIWVEKYRPRTLDEVVGQDEVIQRLKGYVERKNIPHLLFSGPPGTGKTATAIALARDLFGENWRDNFIEMNASDERGIDVVRHKIKEFARTAPIGGAPFKIIFLDEADALTADAQAALRRTMEMYSKSCRFILSCNYVSRIIEPIQSRCAVFRFKPVPKEAMKKRLLEICEKEGVKITEDGLEALIYISGGDFRKAINALQGAAAIGEVVDADTIYQITATA

SEQ ID NO: 69128 - protein, 413 aa, Triticum aestivum
  misc_feature (223)..(223): Xaa can be any naturally occurring amino acid
NKFVQKSRLVPVRNSRDIVDPRVRELQDKVAKMVLEVFGTILYYPEEEHPKELPSPESLKGRVLLSTKPPKEYLEAKDGGAAKDGDAEQNPGKGTDDDAAWGTEVPDFKTEIQSAKQEDDASENRRDGDEDDDDEDEQKMQQHLAPQYKRLITIRAGKPKGGTTSDALKCDPNKVRRLSLSEQQLAKAVVYHGTEIVRFTQRNLLRIYPKGTRVTSSNYNPFXLGWVHGAQMGAFNMQGYGRALWLMHGFYKANGGCGYVKKPDFLMQSEPEVFDPKKPQPVKKPLKVKVYMGDGWRMDFKQTHFDQYSPPDFYARVGIAGVPADSVMKKTKAVEDNWVPVWGEEFSFDLTVPELALLRVEAHEYDMSEKDDFAGQTVLPVSELQPGIRAVALFDRKGNKLPNVKLLMRFEFV

SEQ ID NO: 69129 - protein, 490 aa, Operculina turpethum
MRINPTTSGSEVSAVEKKNLGRIVKIIGPVLDVAFPPGKMPNIYNALVVQGRDNEQTNVTCEVQQLLGNNRVRAVAMSDTDGLMRGMGVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMTLKT

SEQ ID NO: 69130 - protein, 809 aa, Oryza sativa Indica Group
MASSSRVRVGNLVPLNEGNASSSNGSVSSIPIYLGANVVGRNHLVVVDKRVSRKHLSLHASADGSIEAVVEGPNPIIVRSEGQRRKVCAQERVKIAHDDVLELIPGEYFVKYLNVGDNHKSSTSMGSSDFKKGKRLCEDDTVVIKRNRQIMEDEALARSLQKSFAEESSTISGLGCDQMLSSLDSAGSSERNNERIHSVDYLKDVLSLTFRLMRVQGLPSWTNTSSVTIQDVIQGEVLLAVLSNYMVDMEWLLTACPSLRKVRHVLVIHGEDGASVELLKKVKPANWILHKPPLPISFGTHHSKAMLLVYPQGIRVVVHTANLIHVDWNNKTQGLWMQDFPWKDAKDVNRIVSFENDLVDYLSAIKREILELLATCCKLIWPEFRVNLPVVGDVNINAAFFRKFDYKSSLVRLIGSVPGYHVGPNIKKWGHMKLRSVLEGCTFEQQFCKAPMIYQFSSLGSLDEKWMSEFACSLSAGKSDNGSPLGIGKPLIVWPTVEDVRTSIEGYAAGSCIPSPQKNVEKDFLRKYWARWKADHLGVLFLPKTHQSVPQFSCTGKNNSNLFLTQNNLAPGKEIKTKLVTLCWKSDEEKEQSTEIIRLPVPYQLPPKPYGTEDDPWSWDKRYTKKDVYGSVWPRHGGIQAKKRESTKDTRLAEAERPPSRSISSGRVLGRSLPSSTSSSQVLGVACHFHQQSFMSDLDIQIPTAFDPFAEANAGDSGAAAGSKDYVHVRIQQRNGRKSLTTVQGLKKEFSYNKILKDLKKEFCCNGTVVQDPELGQVIQLQGDQRKNVSNFLVQAGIVKKEHIKIHGF

SEQ ID NO: 69131 - protein, 173 aa, Lemna gibba
MMVSTAAVARVRPAQTNMVGAFNGCRSSVAFPATRKANNDLSTLPSSGGRVSCMQVWPPEGLKKFETLSYLPPLSVEDLAKEVDYLLRNDWVPCIEFSKEGFVYRENNASPGYYDGRYWTMWKLPMFGCTDASQVIAEVEEAKKAYPEYFVRIIGFDNKRQVQCISFIAYKPT

SEQ ID NO: 69132 - protein, 388 aa, Oryza sativa
  misc_feature (90)..(90): Xaa can be any naturally occurring amino acid
  misc_feature (114)..(114): Xaa can be any naturally occurring amino acid
MAGGLSKSKSMATSPRSPPGAPPPPEFEISRQSRLLAALSKKVIDLDELRMLAAQGVPDGAAVRPTVWKFWGCRNSARGLGYLPSDRALXWEQELAKKRSQYAAFKEEFLSNPXMEIARQQELEGQGSENAGSINNGLLHRSEVTQEEHPLSLGKTTAWNQFFEYSEIIEQIDRDVKRTHPDMHFFCGDSSFAKSNQESLKNILIIFAKLNAGIRYVQGMNEILAPLFFVFRNDPDDKNANFAEADSFFCFMELLSGFRDNFCQKLDNSAVGIQGTLSKLSQLVAKYDGELQRYLEITTEINPQFYAFRWITLLLTQEFNFADTIHIWDTLLSDPDGPQETLLRICCAMLILVRKRLLAGDFTSNLKLLQNYPPTNISHLLYVANKLH

SEQ ID NO: 69133 - protein, 490 aa, Merremia umbellata
  misc_feature (426)..(426): Xaa can be any naturally occurring amino acid
MRINPTTSGSEVSAVEKKNLGRIVKIIGPVLDVAFPPRKMPNIYNALVVQGRDNEQTNVTCEVQQLLGNNRVRAVAMSDTDGLMRGMEVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIXRFLSQPFFVAEVFTGSPGKYVGLAETIRGFQLILSGELDGLPEQAFYLVGNIDEATAKAMNLKT

SEQ ID NO: 69134 - protein, 466 aa, Brucella melitensis 16M
MPASTPKGNISERAPTASEKEALDFHAQGRPGKLEINPTKPMTTQRDLSLAYSPGVAVPVKAIAEDAARAYDYTAKGNLVAVISNGTAILGLGNLGALASKPVMEGKAVLFKRFADVDSIDLEIDTTDIDAFINAVRYLGPSFGGINLEDIKAPDCFIIESRLRELMDIPVFHDDQHGTAIIAAAGLINALHLTGRDMKTTKLVCNGAGSAGIACIELIKAMGFAPENVILCDTKGVVYQGREEGMNQWKSAHAVKTDRRSLANAMKDADVFFGVSAKGALTQDMVRSMAPNPIIFAMANPDPEITPEEVERIRDDAIVATGRSDYPNQVNNVLGFPYIFRGALDVRATTINDAMKIAAVNALAELAREDVPDDVVAAIRAAARALGRTISFRCRSIRACLPPFPPPSPRLRWKPAWPGAPLPILKATSANCWRAATRSPRRCAAFTSVCAASQSASYLPKARKNR

SEQ ID NO: 69135 - protein, 759 aa, Vitis vinifera
MGVMGDAFTQLLIPVAALVGIGFALLQWLLVSKVKVSADSDLNNGYSDRLIEEEEEGIDHEDVAAKCAEIQNAISVGATSFLFTEYRYLSIFMGVFGAIIFLFLGSVKGFSTKSEPCTYNTGSLCKPALANALFSTIAFLLGAMTSVFSGFLGMKIATYANARTTLEARKGVGKAFIVAFRSGAVMGFLLAASGLLVLYVSIHLFSLYYGDDWEGLYESITGYGLGGSSMALFGRVGGGIYTKAADVGADLVGKVERNIPEDDPRNPAVIADNVGDNVGDIAGMGSDLFGSYAEASCAALFVASISSFGISHDYTAMSFPLIISSVGIVVCLGTTLFATDFVEIKNVSEIEPSLKRQLLISTILMTAGIAVVSFFALPSEFTLFNFGSTKTVKNWHLFFCVSIGLWAGLVIGYITEYYTSNAYSPVQDVADSCRTGAATNVIFGLALGYKSVIIPIFAIAIAIYVSFSMAAMYGIAVAALGMLSTIATGLAIDAYGPISDNAGGIAEMAGMSHKIRQRTDALDAAGNTTAAIGKGFAIGSAALVSLALFGAFVSRAGIETVDVLTPKVFIGLIVGAMLPYWFSAMTMKSVGSAALKMVEEVRRQFNTIPGLMEGRAKPDYATCVKISTDASLREMIPPGALVMLTPLIAGTLFGVETLAGVLAGSLVSGVQVAISASNTGGAWDNAKKYIEAGASEHARSLGPKGSDPHKAAVIGDTIGDPLKDTSGPSLNILIKLMAVESLVFAPFFAAHGGLLFKLL

SEQ ID NO: 69136 - protein, 371 aa, Brucella melitensis 16M
MPFDPRLLASVSAAVAKAAMETGVAGRAIADIEGYKRELLARRDPIASTLRGIYERVRRQPKRIVFAEGEEEQVMRAAVSYVNQGLGTAILVGREEHVEETARAAGLDLNRPGIEVINARLSSRNAAYADYLYEKLQRRGYLARDCLRLINNDRNHFAACMVALGDADGMVTGVTRNYATGLDDVRRVIDSKPGHRMVGVSIALCRGRTVFIADTAVHEMPTAAELADIAVEAAGMARRMGYVPRVALTAFSTFGHMGGERSARIQEAVRILATRHVDFEFDGEMSTDVALNPKLMEQYPFIRLSGPANVIVTPDNHSASIAADMLQELGGATIIGPLLVGLDKPAQIVTIGAKDSDIVNMAAITAYNATN

SEQ ID NO: 69137 - protein, 240 aa, Haemophilus somnus 2336
MTMEGKKVPQVTFRTRQGDQWVDVTTADLFDNKTVVLFSLPGAFTPTCSATHLPRYNELACEFKALGVDDIICVSVNDTFVMNAWKADQESENVTVIPDGNGEFTSGMGMLVDKTELGFGKRSWRYSMLVKNGVVEKMFIEPQEPGDPFKVSDADTMIKYLNPNWTEKPSVSIITKPGCPFCAKAKTLLKEKGYTFEEIILGRDASTISVRAITGKTSVPQVFIGGQYIGGSDDLAQYFA

SEQ ID NO: 69138 - protein, 638 aa, Nostoc punctiforme PCC 73102
MVKSAPSPIASRKPSKVEGIKENSNFLREPVATEILQDTTHFTENAVQLLKFHGSYQQDNRDNRTKGQEKDYQFMLRTKNPGGLVPPQLYLALDKIADEYGNHTLRATTRQGFQLHGILKKNLKSAIATIVKNLGSTLGACGDINRNVMAPPAPFKNRPEYQYAWEYAQNIADLLTAQTGAYYEIWLDGEKAISAEENPEVKAARQRNGNGTIIHDNEEPIYGTYYMPRKFKICVTVPGDNSIDLYSQDLTLVVITNKKKQLEGFNIFAGGGLGRTHGKEETFARLADPIGYVAKDDVYDIVKAIVATQRDYGDRTDRRHARLKYLINDWGLDKFRAQVEEYFGKSVEAFKPLPEFKYYDFLGWNEQGDGKLFLGISIDNGRIKDEGSFQLKTALREIVEQFNLHIRLTANHNLIFYDIEPDSKQAIQDILSRHGIVDDPSKIEPLVRYAMACPALPTCGLAITESERAIPGILERVRALLDKVGLQNEHFVVRMTGCPNGCARPYLAELGFVGSAPESYQLWLGGSPNQTRLAQPYTEKLHHNDLEIFLEPIFVYFKKSRKSKEKFGDFCDRVGFDAIREFAASYDPNTANGANKSRHRVNLKEEVYSKLKEVAESQGKPMTQLVTEALEAYFQNLS

SEQ ID NO: 69139 - protein, 176 aa, Myxococcus xanthus DK 1622
MVTDLTRLPLRGKQGAFHVIVESPRGSTLKLKYDTALKAFSLSRPLPRGLSYPFDWGFIPSTQGPDGDPLDAMVYWDDASFPGVVLPCHALGVLQVEQNTGDGGRERNDRILAVPITPSRAGHLTDYQQLPQREREELEHFFLAAVRFEDKDARILGWEGPEGVERMLRQHGRTEE

SEQ ID NO: 69140 - protein, 297 aa, Escherichia coli CFT073
MKPQVYHVDAFTSQPFRGNSAGVVFPADNLSEAQMQLIARELGHSETAFLLHSDDSDVRIRYFTPTVEAPICGHATVAAHYVRAKVLGLGNCTVWQTSLAGKHRVTIEKHNDDYRISLEQGTPGFEPPLEGETRAAIINALHLTEDDILPGLPIQVATTGHSKVMIPLKSEVDIDALSPDLAALTAISKQIGCNGFFPFQIRPGKSETDGRMFSPAIGIVEDPVTGNANGPMGAWLVHHNVLSHDGNVLRVKGHQGRALGRDGVIDVTVTIRDNQPEKVTISGTAVILFHAEWAIDF

SEQ ID NO: 69141 - protein, 231 aa, Vibrio vulnificus CMCP6
MNKYLAELFGTFWLVLGGCGSAVLAAAFPDVGIGLLGVSLAFGLTVLTMAFAIGHISGCHLNPAVTIGLWAGGRFEAKEIVPYILAQVIGGVIAGGVLYTIASGQMGFDATSSGFASNGYGEHSPGGYSLTSALVTEVVMTMMFLLVILGATDQRAPQGFAPIAIGLCLTLIHLISIPVTNTSVNPARSTGVALYVGDWATAQLWLFWVAPILGALLGAVAYKLISGSNKD

SEQ ID NO: 69142 - protein, 824 aa, Oryza sativa Indica Group
MAPPCSSALVLPCLLVIAMAALQSAVVFADTVTAKRPLSGSQSALVSKRRKFALGFFQPENSQHWYLGIWYNQISKHTPVWVANRGTPISNPDTSQLTIATDGNMVLLDNSTTAIWSTNISKIASNSTVGVILDTGNLVLADESNTSIIHWQSFDHFGNTWLPGGKLGRNNKLAGVSTRLVAWKARNDPSPGVFSLELDPNGTSQYLLEWSITQQYWTSGNWTGRIFADVPEMTGCYPSSTYTFDYVNGENESESYFVYDLKDESVLTRFFLSEMGQIQFLTWIYAAKDWMPFWSQPKVKCDVYSLCGPFSVCTENALTSCSCLRGFSEQNVGEWLQGDHTSGCRRNVELQCSSNASVMGRTDGFYTMANVRLPSNAESVVVIGNDQCEQACLRSCSCTAYSYNGSCSLWHGDLINLQDVSAISSQGSSTVLIRLAASELSGQKQKNTKNLITIAIVATSVLVLMIAALFFIFRRRMVKETTRVEGSLIAFTYRDLKSVTKKFSEKLGGGAFGLVFKGSLPDATVVAVKKLEGFRQGEKQFRAEVSTIGNIQHVNLIRLLGFCSEKSRRLLVYEYMPNGSLDKQLFDNKKHVLSWNTRYQIALGIARGLDYLHEKCRDCIIHCDIKPENILLDGSFAPKVADFGLAKLMGRDISRVLTTARGTVGYIAPEWIAGTAVTAKADVFSYGMTLLEIVSGRRNVQGRRRRQEQQDDGGAAADRPFPLVAAGRLVGGGGGRREEMVSAVVDCRLGGDADMGEVERACRVACWCIQDDENARPAMATVVQVLEGLVEIGVPPIPRSLQFLAELADQSNYLQFFSDLLPSN

SEQ ID NO: 69143 - protein, 198 aa, Prochlorococcus marinus subsp. pastoris str. CCMP1986
MFLVIDNYDSFTYNLVQYLGELSVEHNITKELLVKRNDEITLEEIRHINPDGILLSPGPGNPDQSGICLAILQNLSKEIPILGVCLGHQALAQAYGGKVIVGKELMHGKTSKIIHNKKGLFKDIDSPFVATRYHSLIVDSESLPSCFEITATLEDSTIMAISHKEYKKLHGVQFHPESVLTQFGHKLISNFLNMAEQK

SEQ ID NO: 69144 - protein, 466 aa, Yarrowia lipolytica CLIB122
MLNQMAFRTARVGGGLRTSFLQRRALHACHIARAVIPFKLADIGEGIKECEVIQWFVEPGARINEFDQICEVQSDKASVEITSRYTGVIKKLHYDAGDMALVGKPLVDIDTGEGGEGASEVAAESSDAAPSTAAATPATPLTASASVASSTATTVSSDPSKAYQKALATPAVRRLTRELGIDIASIKGSGKGGRVMKEDVLSYQKGGSAVSDSATGSVTAATTTSTAGSRLVPLTPTQMGMFKTMTNSLSIPHFLYTDEVCLDKLMELRASVNSLLAKSPSNGVSKISYMPFFIKALSLALKDYPMVNAKVDLSGDKPAVLMRDYHNISIAMDTPNGLLVPTIKNVQDKTIVEIAADLQRLQELGMAGKLSRDDLTGGTISISNIGNVGGTYLSPVIVSEQVAIVGLGKARKLPRYNSQGDIVPEQIINASWSGDHRVLDGMTMALMADKWKAYVVDPKAMLLQLR

SEQ ID NO: 69145 - protein, 181 aa, Nicotiana sylvestris
MAFLIMSSAAAVATGTNAAQASMIAPFTGLKSATSFPVSRKQNLDITSIASNGGRVQCMQVWPPINKKKYETLSYLPDLSEEQLLREVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 69146 - protein, 137 aa, Glycine max
  misc_feature (77)..(77): Xaa can be any naturally occurring amino acid
  misc_feature (96)..(96): Xaa can be any naturally occurring amino acid
ARSMISFPAVTTVNRAGAGMVVPFTGLKPMAGSPTINTNNDITFIASRGGRVQCLHVCPPADKNNLETLSYLPDLDXAQSSKREEYLLTTGWLRCXGIRIKHGFVIREHTTLPGFYNGLLGTMWILPIDSCSHASNV

SEQ ID NO: 69147 - protein, 3734 aa, Streptomyces sp. KCTC 0041BP
MADLHEAREQISRTESARHEPIAIVGMGCRLPGGVSSPEGLWDLVASGVDAVSPFPTDRGWDVAGLFDPEPGVPGRTYVREGGFLHGAGEFDAGFFGISPREALAMDPQQRLLLETSWEALERAGIDPHSLRGSRTGVYAGVMYHDYGSTVAGSAAPDDETAGFLGIGTSGSVASGRISYVLGLEGPAVTVDTACSSSLVALHLAVRALRSGECDLALAGGVTVMAEPGVFVEFSRQRGLAADGRCKAFSDSADGTGWAEGVGVLAVERLSDAVRHGHRVLAVVRGSAVNQDGASNGLTAPNGPSQQRVIRQALADARLGVGDVDVVEAHGTGTRLGDPIEAQALLATYGQRDAGRPLWLGSLKSNVGHTQAAAGVAGVIKMVMAMRDGVLPKTLHVDEPSAEVDWSAGAVSLLTEQEPWPEVGRPRRAAVSSFGLSGTNAHVVLEEAPAPKVGEVGVGVSPAVVPVVVSGRSAGVVRELAGQMGGVAGSGRLVDVGLSSVVSRSVFEHRSVVLAENTTELNTGLDAVAAGVPSSGVVSGVVSGEGGRSVFVFPGQGTQWVGMAVRLWAESGVFAESMARCEAAFEGLVDWRLSQVLDDEAALERVEVLQPASFAVMVSLAALWRSLGVVPDAVVGHSQGEIAAAVVAGGLSLEDGARVVVLRARLIGRELAGHGGMASVALPVGVVEERLARWAGRLGVAAVNGPSATVVAGDTDAVAEFVTTCEAEGVRARRLPVDYASHSAHVETLAAELEEVLADVRPVSGEIPFYSTVEAGLVDTASLDAGYWFGNLRRPVRFQETVEQLLADGFPVFVEASAHPVLTAAVQETAESVGRQVCAVGSLRREEGGLRRFLTSVAEAFVQGVDVTWPALFDESGARLVDLPTYPFQHQRYWLESRPSAAVVPSGTQDGLSYGVTWKSLSLPESVRLDGRWLLVVPEHLDADGTRVAHDVEQALTTHGATVHTLALDPATADFDGRFSRMFEEATDVTGILSLLGLAVGPHPEHGEVPLGVATSLTLTRQALRAGFGVPVWAVTRGAVSVVPGEVPETAGAQLWALGRVAALELPDRWGGLIDLPADTDARSVGLAVRALAAGIAAGEDQLAVRPSGAYGRRLVRATARRGRKDWRPQGTVLLAGDLDAVAEPLVRWLLTDGADHVVLADPALTELPAALADVAQRVTTAAAPDLADRAVLAALVTEYAPAMVVVVPPAVELAPLESTSPADLAAAVAAKSATAAHFDALLDGPHAPELVLISSVAGIWGGVRQGAYAVGAAHLDALAARRRAQGLPTVSVAWTPWAGSVIADGSAAESMRQYGIAPLEPQTALAELNRALGSGTGDAAVADVDWEQFLASFTSVRPTVLFDELPEVRRLRQAEAAAMADQAARIGAPGGTELARSLRDKPRNAQRKALLELVTAHVAAVLGEGAPDAIDQSRAFKDIGFTSMTAMELRNRLKEATGLTLPASLVFDHPHPRALADHLREELLGEDDAERTDSEPNTPSGPPPAGQDEPIAIIGMACRLPGDVGTPDELWELLETGRDAITDLPVNRGWDVAGLYDPDPDAAGRAYVREGGFLHDAGEFDAGFFGISPREALAMDPQQRIILELAWESFERAGLDPAGRRGSRTGVFMGTNGQHYMPLLQNGSESFDGYLGTGNSASVMSGRISYTLGLEGPALTVDTACSSSLVALHLAVRALRSGECDLALAGGATVMSTPEVLVEFSRQRAVAADGRCKAFSASADGFGPAEGAGVLLVERLSDAVRHGRRVLAVVRGSAVNQDGASNGLTAPNGPSQQRVIRQALADARLGVGDVDVVEAHGTGTRLGDPIEAQALLATYGQRDAGRPLWLGSLKSNVGHTQAAAGVAGVIKMVMAMRHGVLPKTLHVDEASPHVDWSAGAVALLTEQEPWPEVGRPRRAAVSSFGLSGTNAHVVLEEAPVPEEGQFVGDAPLAVVPVVVSGRSAGVVRELAGQMGGVAGSGRLVDVGLSSVVSRSVFEHRSLVLAEDSAELNTGLDAVAAGVPSSGVVSGVVSGEGGRSVFVFPGQGTQWVGMAVRLWAESGVFAESMARCEAAFEGLVDWRLADVLGDEAALERVEVLQPASFAVMVSLAELWRSLGVVPDAVVGHSQGEIAAAVVAGGLSLEDGARVVVLRARLIGRELAGHGGMASVALPVAVVEERLARSAGRLGVAVVNGPSATVVAGDTDAVAEFVTVCEAEGVRARRLPVDYASHSAHVETLAAELEEVLAGIRPRAGEIPFYSTVEAAAIDTASLDAGYWFGNLRRPVRFQETVERLLADGFPVFVEASAHPVLTAAVQETAESMGRQVCAVGSLRREEGGLRRFLTSAAEAFVQGVDVTWPALFDDTGARAIDLPTYPFQHQNYWYIDPARRKGDVSSFGMAEAGHPLLDAGTELPEGGEHLYTARLTADSHPWLLEHTLLGTPLLPGAAFVDLVLWAGGELGCELVEELTLTSPLLLSDSAAVQLRLVVGATDAEGRRTITIHSRPDAHPGTTRTPAAPPEAGSEAEVRRDAADWTKHAQATVAPAPAAPASVVGADGNPGLPAAEWSSAATESDTFRAEDFYASFAARGYGYGPLFQGVRSGRQDGSDVYAEVALDQGALPPGERFGLHPALLDAAFQTMRLGSFFPDDGQARVPYTFRGIRLYAPGAERLRVRVSAVGDDAVRVECADEQGRLVCEIDALVVSPVSPAQLRPAGQDATQDMLHRVEWPVLPSPAGRATSTAAFRWIVVGPEDDGLGLAEVLSGTGTGIERHRNLADALTALRTPADTPGSPAAADKTPLIAVPVSPSPTMDAVSVRHAVHQALESVQGWLSADEAAGEGGSGAAGADGRLVLITSGAVSTGDADPLRDPVASAVWGLVRSAQSEQPDRFVLVDLDEGAVDGAALSAAIASGEPQLALREGKVHVPRLASLSARDSRMLLPPAGARAWHLVGARTGTLSDLALVPAQADTVPLAPGQVRIAVRAAGLNFRDTLIALGMYPGEGVMGAEGAGVITEVGPDVAGFAVGDRVLGMWTDGFGPYAVADHRMVAPMPRDWSYAEAASVPAVFLSAYYGLKHLAGLRAGQSVLVHAAAGGVGMAAVQLARYFGAEVFGTAGPAKWDVLRAQGLDDRHIASSRTLDFAARFLDATGGRGVDVVLNSLAGDFVDASLRLLPRGGRFVELGKADVRDAAQVAADRPGTGYRAFELMEAGPELIGRMLTELLELFESGALRLLPVTPYDIRRAPDAFRTLSQAGHVGKLVLTMPPAFDPHGTVLITGGTGNLGGTLARHLVTEHGVRHLLLAGRRGAEAEGAAELVRELNGLGASVTVAACDVADRAALRKLLGSVPPERRLTGVVHAAGVLDDGVVTSLTPDRIDGVLRPKVDAALNLHEAALDPELGLDLSVFVLFSSVAALLGGAGQGSYAAANGFLDGLAQYRRARSLPALSLGWGLAGSGRMTSHLDTQALLRRMARGGVLPLSPAESMTLFDAAQGFDEALQMPVHFHTAALSADGNVPPIFRGLIQGGGARNAAARRRNAGPSASGAPVGGDPADLADRLSGLTEDEQRALLLDTVRTHAALVLGHTGADGIQADRAFKDLGFDSLTAVEMRNRLAAATGLHLAATLVFDHPAPADLAEHLRSRLVPEEPNVPPLLAELDRLEAAFKELTAAGLDSVAPDDIVRDEIAVRLAALGSLWDGLHGSGSGRAQKHGGSIVDDIDSAADDEIFAFLDESFGDS

SEQ ID NO: 69148 - protein, 136 aa, Pisum sativum
NTDITSNGERVKCMQVWPPIGKKKFETLSYLPPLTRDQLLKEVEYLLRKGWVPCLEFELLKGFVYGEHNKSPRYYDGRYWTMWKLPMFGTTDPAQVVKEVDEVVAAYPEAFVRVIGFNNVRQVQCISFIAHTPESY

SEQ ID NO: 69149 - protein, 1456 aa, Yarrowia lipolytica
MKHGKQKLANNNTDHDSLSSLDRALATRRDMFGRTLLHNACICGDAQAVEQLFANPHVDVTAVEYESGSSALHLALAAGSLHCAQLLIKHSRELLRLKDRDGCPAFETALYYHKWHTTDPGLPSEYFSFGSNTNHTLGFPDSDDRQTPETVKVLRPATTDIRSSLAPVRVVDCAIGGYHTAILTSDETANLYVCGVSSRGRLGLGPHVSTQFTPTLVASLASEKIVSVGVGKDHTACVTAKGVVYTWGCNRDSQLGYPTGGATGEEQLQISPRRVGGPTLKKAHITHVTCSNVHTVCWRENTSDMYVWGANNGQMGGMAPGQDCAIPTMVALVPGKISAVCASDYYTACIIDESYIQVYMNGGHFRVFLPAPGGTAREESQSGFDVFKPRLLVNRPQQLYASAGGPTICVSSLGHVYELPLQRFLNVKPALVARQMPVTALWVPRRDYMVATHAAVGDDGSVIICTSSGSAWKRERKENRLGGGTLKEYKFSRIPKVTNAYRVACDPLFRSFAALRYATQVDAIDVDMESLEFDVAERHAINRKMAYFTLDGDKESSEEFEDSPNLGALNWLVEAFEGVVSGTAQRTGLEEEAEMMGLNRFEETVMYKAVEMNKSDPHRGYDCELVCENSTVKLPCHSYMLRSSNLKAAVAKNSPLKCSLLTLVILHHYLYNDNVLSVWTLSGGCSIPREYVEAKAELLALAKEFELSSLVCKLSFGETADQLPVDMAKLFSSDTGDVAIEVDGGQILHAHRFILTQQSEFFQSCLSERWSDDTKVVVDLCHLPAASVRLCLRFMYTHNLDSLFDQVSSKVSSKDFIATVSQLLSTADELLLTPLKEFCELILSELVTVKNAASLLFLASAYNCDKLMTFMFSYICVNMECLLEGGFLGAILADGELFGAIDHHYRVMTGREIVLKEVPESSAVVGVTQLGEGISEDAAEQEEVEEEVKPKTLALASRPSGWVESFLSDFDGHNELLCRVAPGSVQAPDAAAALTPHRQSFAALHRNSKSEETRPSISPMSSPDLRGHNQTDDVFEFELDECPAEQRKRHDSRHDDRRCSHSEWREVKTGSSVRTAQFSSSPFGKSPMAGSPLSVSPNHASGDRRRSSFATAASGVPLTPGEIRFNLKQQIEKDSDAVYWPTLGGLGSPGGAGSVGAAGATPGSHPRGSPGPSATPSGSSTPWGKGAGVSNATPGSAGSASTWGNSSANGASAPSASATSAGSALSDLFSVTPPSSKLSQKERRRLLKQQQEETLMRAQEKEKQAAEGPWKVKKKAPVGVSPFESTSSPASSKTPSKTPSRAPPRAPSRAGLPGPNVGVGISTVGNSSATATSSFASDFYAASQPVTALSLAEIRERQERSTQKAKNVKTIEEIQQEEMFQKWWDAEVARNKGEESRGPEGGPRGTPSKSSRRPNKKKNNNKGPANGSSNGGGGGSGSQDDNGKRHRPRPREQIKA

SEQ ID NO: 69150 - protein, 242 aa, Oryza sativa Japonica Group
MRNYISYGMSLLEENGHDEIVIKAMGRAINKTVMVVELIKRRIGGLHQITSTESIDITDTWEPLEEGLLPLETTRHVSMIAITLSKKALDTLSPGYQPPIPAEEVRPAFDYEHEESFPTNRGRGRGGGRRGRGRAMSNGPPAYDYGEEWEEEGDYYNYRGRGRGRFRGRGRGRGRGGYYGGGRRGGYGYDYGYGGRGDYYEDQGEYFEEPEDYPPPGRGRGRGRRGGGPGPFRGRGRGRGRF

SEQ ID NO: 69151 - protein, 444 aa, Moritella sp. PE36
MNEALKERLIQAVESIDAGAVAKVYGRLVRINGLTLEVTGCRLSIGQRCFIETLNNGSLAAEVVGFNRDISYLMPLQHAVGLFSGARVSPQSGIENIVVGEQLLGRVVDGLLQPLDGLPAITGESIPLFSLPNNPLSRQPISEPIDVGIRCINAVLTPGKGQRLGLFAGSGVGKSVLLGMMTRYTEAEIIIVGLIGERGREVREFIEHSLGEEGRKRAIVVAAPADATALMRLRAAQVCHRLAEHFRDQGKHVLLLMDSLTRYAQAQREIGLAMGEPPATKGYPPSVFSLLTQLVERAGNGLGSGSMTAIYTVLVEGDNQQEPIADAARAILDGHIVLSRDLAEQGHYPAIDISASISRVMPQVVKKDYLAHAIKLKKLYSSYQQIRELIPLGGYQPGKDMQVDYAVQKFPAIAAFLQQGLDEQSGLSDSMNQLIHLMDNEHAK

SEQ ID NO: 69152 - protein, 490 aa, Merremia peltata
MRINPTTSGSEVSAAEKKNLGRIVKIIGPVLDVAFPPRKMPNIYNALVVQGRDNEQTNVTCEVQQLLGNNRVRAVAMSDTDGLMRGMEVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 69153 - protein, 283 aa, Yarrowia lipolytica CLIB122
MIRRQARERREYLYRKSLQLQEATKIQKRQQLKAALASGKPLPKDVADDEELRKTIAYDESVQDEIDDEYSAMSGITDPKVVVTTSRDPSTRLSQFAKEVKLLFPTSIRLNRGGTVLPSLVSACKTSASSDLIVLHEHRGVPTAMTVSHFPHGPTAYFSLHNVVLRHDLPDTGNMSEVHPHLIFDNFTTDLGKRVVQILKHLFPPGVKKDSARVITFANRGDFISVRQHVYVKTREGVELAEVGPRFEMRLYDLRLGTLENKDADVEWRMHGFMRTANKKDYL

SEQ ID NO: 69154 - protein, 561 aa, Gibberella zeae PH-1
MASSARMPSRRLFAGGAINRLLDLLLPGGSGITSVAFFAYIAPYLIEVATDVFQRQCVSTIEIQGHDEIFTYLMSWVARNNKLSRNNHRLLASSSTSNEPSHPMRGPPRGNENNEEDDSGDDIDPSASLDVLRSKISLYNARPLHWTPSVGTHWFWYENRVVSFTRTAANETPMPFGLRFETVVLSCLGRNPDILKRIIYNARIEYLEKQRGRTSIFRAVQSHGEMHCWARSMSKPTRPMSTIALEEDKKQSLIKDLARYLNPRTKKWYATRGIPYRRGYLFSGPPGTGKTSLALAAAGLMGLNIYMISLSSPTLSEDSLASLFQTLPRTCLVLLEDIDAAGVAASRVEQQKAKAESAGKPRRPGFGFPMISREPITLSGLLNVLDGVGAQEGRVLVMTSNHTENIDPALLRPGRVDYTIKFGLASFETIKQLFQLMYGTSYAETGIELDSENIEALSTEFAQVVPAHTFTPAAIQGYLLMHQDGPSEAVAEAGVWVEEQKRLKEKAEEIEKVEAKEEEDKNESETENDEKTKDKKNPEAKIKVNGVKMSDLLGDLANDVE

SEQ ID NO: 69155 - protein, 180 aa, Petunia x hybrida
MASSVISSAAVATRTNVAQASMVAPFNGLKSAVSFPVSSKQNLDITSIASNGGRVQCMQVWPPYGKKKYETLSYLPDLTDEQLLKEIEYLLNKGWVPCLEFETEHGFVYREYHASPRYYDGRYWTMWKLPMFGCTDATQVLGELQEAKKAYPNAWIRIIGFDNVRQVQCISFIAYKPPGF

SEQ ID NO: 69156 - protein, 490 aa, Calystegia macrostegia
MRSNPTTSGSEVSAVEKKNLGRIVKIIGPVLDVAFPPGKMPNIYNALVVQGRDNEQTNVTCEVQQLLGNNRVRAVAMSDTDGLMRGMEVINTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSMMLQPRIVGEEQYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 69157 - protein, 439 aa, Escherichia coli O157:H7 EDL933
MSCDMEHAGMKKLKLLNKYSYLHSINGSLIEAELDDVSVGEVCEIYASRQANERIARAQVVGFRNGKTLLNLIGSSVGLTRTAVLKPTGEQLTIQISDAFLGSVLNASGQIMERFVPDTPGDRGNLRLIDELPPSYQERRVINTPLETRIRVIDGVLTCGIGQRVGIFASAGCGKTVLMHMLVNNTEADVFVIGLIGERGREVTECAESLKKSVNAAKCVLVYATSDFSSVDRCNAALMATTVAEYFRDRGKRVVLFIDSMTRYARALRDMKLAAGEPPARRGYPASVFDSLPRLLERPGPTLKGSITEFYTVLLEGEDESDPLGDEIRSILDGHIYLSRKLAGQGHYPAIDVLKSVSRVFGQVTDEKHRDNAARVRKNLTTLEDLQVFIDLGEYRAGQNAENDFAMNARPKLTNWLKQSVNEKMPMSETLKELERIVK

SEQ ID NO: 69158 - protein, 181 aa, Solanum tuberosum
MASSVISSAAVATRTNVTQAGSMIAPFTGLKSAATFPVSRKQNLDITSIASNGGRVRCMQVWPPINMKKYETLSYLPDLTDEQLLKEVEYLLKNGWVPCLEFETEHGFVYRENHKSPGYYDGRYWTMWKLPMFGCTDATQVLAEVQECKKSYPQAWIRIIGFDNVRQVQCISFIAYKPEGY

SEQ ID NO: 69159 - protein, 178 aa, Glycine max
  misc_feature (115)..(115): Xaa can be any naturally occurring amino acid
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPXYYDGRYWTMWKLPMFGCTDASQVLKELQEAKTAYPNGFIRIIGFDNVRQVQCISFIAYKPPGF

SEQ ID NO: 69160 - protein, 402 aa, Clostridium perfringens str. 13
MIILYLEKIIKAKKNIEDVVIKTPLIYSEVFSRKSGNQVYMKCENLQLTGAYKIRGALNKIRSLSDEEKSKGVVCSSAGNHAQGVAFAASQANVKSTIVMPKTTPLLKIQSTKDLGGNVVLSGYVYDDAFNEAKRIEQEQGALFIHPFNDIDVICGQGTVALEIFEDLNDVDIILCPIGGGGLISGVTLAAKALNPNVKVIGVQAEGANAMVKSFKAGEIIALDAVDTIADGIAVKRPGDLTFKFIKEYVDDIITVSDHEIVEAFFTLSEKHKLLAEASGAVSLAASAKLNCKDKNIVSVISGGNIDMVTITSLINSALVAKGRLFGFSLEVPHKPGQILKIAKVLADTNANIVKLEHDHFKARDALKNMVIEVTLETNGHSHIEEIKKALTDQNYVIKQIY

SEQ ID NO: 69161 - protein, 174 aa, Triticum aestivum
MAPAVMASSATTVAPFQGLKSTAGLPVSRRSRGSLGSVSNGGRIRCMQVWPIEGIKKFETLSYLPPLSTEALSKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 69162 - protein, 190 aa, Brucella melitensis 16M
MFIQTETTPNPATLKFLPGKVVMPEGTADFRDPASAENTSPLAAKLFAVPGVTGVFFGYDFITVTKEDGEWQHLKPAILGTIMEHFMSGAPAMAGNANADAAAAHGEEEFFDEADTEIVETIKELIETRVRPAVAQDGGDITFRGFENGTVFLHMKGACSGCPSSTATLKHGVQNLLRHFVPEVQQVEQI

SEQ ID NO: 69163 - protein, 382 aa, Escherichia coli O6
MIKSALLVLEDGTQFHGRAIGATGSAVGEVVFNTSMTGYQEILTDPSYSRQIVTLTYPHIGNVGTNDADEESSQVHAQGLVIRDLPLIASNFRNTEDLSSYLKRHNIVAIADIDTRKLTRLLREKGAQNGCIIAGDNPDAALALEKARAFPGLNGMDLAKEVTTAEPYSWTQGSWTLTGGLPEAKKEDELPYHVVAYDFGAKRNILRMLVDRGCRLTIVPAQTSAEDVLKMNPDGIFLSNGPGDPAPCDYAITAIQKFLETDIPVFGICLGHQLLALASGAKTVKMKFGHHGGNHPVKDVEKNVVMITAQNHGFAVDEATLPANLRVTHKSLFDGTLQGIHRTDKPAFSFQGHPEASPGPHDAAPLFDHFIALIEQYRKTAK

SEQ ID NO: 69164 - protein, 489 aa, Clostridium perfringens str. 13
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNIPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMSRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 69165 - protein, 490 aa, Convolvulus sagittatus
MRINPTTSGSEVSAVEKKNLGRIVKIIGPVLDVAFPPGKMPNIYNALVVQGRDNEQTNVTCEVQQLLGNNRVRAVAMSDTDGLMRGMEVINTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSMMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 69166 - protein, 376 aa, Desulfovibrio vulgaris str. 'Miyazaki F'
MRAFLALEDGFVLEGRSFTGRGESGGEVIFNTGMTGYQEVLTDPSYAGQMVCMTYPLIGNYGVTAEDMESGKVHVEAFIVKECCRTPSNWRAIMSLPDYLAQHGVMGIEGIDTRALTRHLRINGAMRGIISTETDDRDELVRRARALPTMEGQNLVTRVAPATPYRWDGTRPQPVQLAADGAYAWPGTGPRLVVYDYGIKWNILRLLTDQGFDLLVVPPSFTAMQVAASGAEAVFLSNGPGDPATLTDEVREIRVMTERMPVAGICLGHQLLGHALGGTTHKLKFGHHGCNHPVKDLVTGHIEISSQNHGFCVDIESVPDVEITHVNLNDGTLEGFAHKTRPILAVQHHPEASPGPTDSRYFFARFRGMVREAVGR

SEQ ID NO: 69167 - protein, 311 aa, Arabidopsis thaliana
MDQLRDDPTAHAQSLPASQHNLEDTDETCEDSRYHSDQGSGAQAINYNGHNKLMENGKSVDERDEFKETFDVTMDLIGGIDKRPDSIYKDKSRDECVGPELGLSLKRSCSVSFENQDESKHQKLSLSDASAFSRFEESKSAEKAVVALEESTSGEPKTPTESHEKLRKVTSDQGSATTSSNQENIGSSSVSFRNQVLQSTVTNQKQDSPIPVESNREKAASKEVEAGSQSTNEGIAGQSSSTEKPKEEESAKQRWSRSQREAALMKFRLKRKDRCFDKKVRYQSRKKLAEQRPRVKGQFVRTVNSDASTKS

SEQ ID NO: 69168 - protein, 1987 aa, Coprinopsis cinerea okayama7#130
MPRDPTQLMAFKWPMALYNELRKWFPLFNLFSFFCAFIIDAPFGRFAPSASDPSTHSIFPLFNMQALQVDGIRSWIFMELISPFTFIYAFLISPLTFYTPDMPSLTSPITLACTLFMIHYANRALISPLRTPSRSKSHLVVVLLAAGFNLANGYLLGSYFSSPMARIYIGGSYAYMRPSFWIGMTLWLVGFIGNIAHDEILLDIRRKAKARKEKDGEEREDAKKKGKEPKKPAEKGEYYGIPQGLLYDYISFPNYFCEWIEWFGFALATSPPPVELSFASPADFIQSLLHNAIIPLCSPKAWSKMIKGNAYGFAPLLTPPWIFFFGEILVMLPRAYRGHKWYKKRFGESYPKNRKAVSSSFIPFSNASPFLMDDNAQLGVGGLRIARPLPSSSTSQPARAPTTTQRSMEQPPRAEEEDDLHGIEQCVQEIVDGVKDSTEMATLDTAITILRETIEEETDNEMCTSARLALVKALLVRYAHKGWPDDLYEALRYFALEENEDGRPDAVDCALQLIAEHQQSIDQSMLETAICIADETLDPCTEFTTDHAELLLCVGNALVLKYLGGGDIGDLDLARGRFLDVRRSCQGKGALASVALCNLIHAECIKFIEGDPTQRREVHAEIQRHTRIANEEDAEGVAAFQSGIQMMHSGDQAQLDESISQLRLSLSLRPPRHPRRLSSLVHLTIALQMRFESRNNRDDLEESIALGREALSLTPVGHPARCASLDNLVNSLSSRFDRTGNFQNLEESIVYHQEALSLIPKDSPGHSMMLNNLASSLSTRYQFKGNFEDLARSITLHKEVLDLRPKGDPRRFYSLTNLAIALATRFQTKGDIQDIEECVACHREVLTLTPEGHPIRLTPLNNLANSLLLRFEQKGDIDDLEESIKLHREALVLTPTGHPDHFMSLNNLALSLSARFQHKGDFGDLEESIGHHREALAAMPPSHPIRATSLNNLATSLHSRFDHKGETQDLEDCVRSHREALALRPPGSPDRVASLSNLANSLSARFLQKGDIQDLEESISHHREASLLLAPDHPGRSKFLNNFANSLYALFNQKGDFQTLEESIAYYREALDLRPEGHPEHLSSLSNLAVPLFARFTHKGDIQDLAECISYHQRVLEQRPKAHPDRSATLDSLATCLGTRFQRMGEFKDLDDSIAYQKEALALRPQGHPARCSTLNNVATSLTSRFEHRGDFQDLEDAIMCHTEALELRPAGHPERSSSLRNLGGSLSNRFRYKGVSQDLEESIRYQREALALTPKGHPDRSSSLIRLAVSLSTLFQHRKNLEDLEECIQYHREALELREGDHPERASSLNNLGVALYARFESQGDLKDLKDCVSYHGEALHTATAQTESQIHPQRWLGSALNLIIALRALYRKFREPGILDDILHHLKNRPQIEGTSFLLQMQFDMLCTEIGREFDRADVALEGYTRGLALLPLLASLDLTLEQRKNVLVHTKNLLRDAVQCAIAQGELETAAHFLSSSRSVFWSQALQFRASLERLESSHPELAAELDSVNRRLQVATRQTSMDDFEDSLVTPPAPNSVLQASPYVLSKEREVVLARIRQMEGFHDFLIPPSFQGLKAATAKGPIVFLNASYYGCDALIFKSDGSLEHLPLEVELDLLRSLKNAVQRLADGNTLHGEVQHDIDVAFEKRNLRLKARIGKRNRSVDDDFRRVLEILWELVVLPVVERLRLKKVFKVSVAQGSHLTLHQINSQDDNSQDDSDLRRRIWWCPTGPFAFLPVHAAGIYSSQGEGISCLSDYAVSSYCSSPQDLLAPPTKSGPDFKMFAVIEPEKLGPGMSSLPSATLELEKIKSQIPDQRRLTTLVGSKDNPTSTKSVIDEINTSSIVHFGCHGMQDLSNPLNSHLLLSGGQLTVEGLIRECQTSTPALAYLSACETAMGDEERPDESLTLAATMMFAGFRGVVGTMWSIHDQDAPIVANVFYQHLFRHGGSSPPDVTDAAYGLDRAVKELRDLGRPFHHWVPFVHFGV

SEQ ID NO: 69169 - protein, 478 aa, Chlamydomonas reinhardtii
MKIACIGAGYVGGPTMAMVALKCPDIEVVVVDINEERIKAWNSDKLPIYEPGLLEVVQEARGRNLFFSTDTKKHVGEADIIFVSVNTPTKTHGIGAGKAADLTYWEGAARLIASVSTSSKIVVEKSTVPVKTAEAIGKVLRRNCQDPNVNFEILSNPEFLAEGTAIEDLQHPDRVLIGGADTESGQKAIKTLAEVYAHWIPRERILTANLWSAELAKLTANAFLAQRISSINAISALCEATGADVSQVAHAIGTDSRIGPKFLNASVGFGGSCFQKDILNLCYVCETVGLKEVADYWYQVVSMNDYQKQRFVERVIGAMFNTVSQKKIAIYGFAFKKDTGDTRETPAIDVCKGLIRDGAKCCIYDPEVTPEQIFRDLSAPKFEWDRPNYSRSQSHMLENVQVQSDPIAAADGAHAICVLTEWDEFKKYDFAALYEKMVKPAFIFDGRNILDHAKLREIGFIVYALGKPLDQFLQKNYS

SEQ ID NO: 69170 - protein, 510 aa, Oryza sativa Japonica Group
MVSNHDDGKPPAKWKKVCVVGAGMAGLAAARELRREGHAVTVLEQAGDVGGQWLYDPRTDDPLGASPAPVRVHSSMYASLRLISPREAMGFTDFPFLPVDGAGGGGRDPRRFPGHREVLLYLKDFCDAFGLMDAVRLSLNTRVLRVAMAPPQCRAPAVAGGERKWVVRSVRVGERDDTGVQEEVFDAVVVATGHYSQPSVPTIKGMEAWRRRQLHSHSYRLPEPFRDEVVVMVGCGDSGKDIALDLISVAKEVHLTDKSTEEATTPAMSKLLAKYANLHLRPRVEHLCEDGTVVFVDGSRVVADTVMYCTGYVYSFPFLDTDGVVTVDDNRVGPLFEHVFPPALAPSLSFVGVPRKVPAPWFFEAQGKWVAQVLSGRRTLPPVEEMLRAVDEHYRARAAAGVPVKYTHELGGIEPQKYIEFGEKYCGFPRYEDWKREMIVSTISRRDDDDMETFRDRVDDDSDHVRLCLKSWHCSSPARHQASLAVSAADGHPPPPRLAQTAKAIAADAL

SEQ ID NO: 69171 - protein, 328 aa, Haemophilus somnus 2336
MKQNQPHFYRGRFSVAPMLDWTTRHCRFFHRQFSRYTLLYTEMVTTGAIIHAKYDHLAYDVSENPVALQLGGSDPEKLQYCAKKGEERGYQEINLNVGCPSDRVQNGMFGACLMARAALVAECVNAMQSAVNIPVTVKTRLGIDEFDSYEFLCDFIEKVHNIGCQEFIIHARKAWLSGLSPKENREIPPLNYERVYQLKKDFPHLLISINGGIKTLEEIQQHLNYVDGVMVGREAYQNPSLLGYIDQALFDPSCAIITPRQAIENMFPYIEQQLSQGVYLNHIARHLLGAFQQCKGARQWRRYMSENIHKSHAGVEVIEKALTFIEEK

SEQ ID NO: 69172 - protein, 141 aa, Bacillus licheniformis ATCC 14580
MTKETLYCTVLDNVYEAAVKMKDGDVGAIPVVLDDGLELVGIVTDRDLVLRGIAAKKPNSQKITNVMTTDLITVSEDDSIEKAVDLMGDYQIRRVPVTRGKTLAGIITLGDVSTHNKSNRQAGDALTFISENEERPGDFLH

SEQ ID NO: 69173 - protein, 428 aa, Clostridium acetobutylicum ATCC 824
MKMSSLYERSLKVIPPVAGRATKLGVVRGEGAYLYTEDGRKVLDFASGVAVCNLGHNNPAVIKAAKEQMDKLIHGGHNVVYYESYVKLAEKIVELTGNKTMVYFSNSGAEANEGAIKLAKYITKRQAIISFKGSFHGRTLATTSITGSSSKYRKNYEGLLPSVYFAEYPYCFRCPYKQNKESCNMECISQFEDMFKKLIEPESVAAIIMEPVQGEGGYIVPPKKFLKAVREICDKYGICLIFDEVQCGFGRTGKIFAHENFEVEPDIFTCAKAIASGFPLSAVIGKKELMEKWPAGAHGGTFGGNPVACAASLATIKELESGVLDNANNMGNYLKEELLKLKDKYACIGDIRGIGLMIGMEFCKENNNPDGDIVTFIREVAVNNNLILLGCGTEHNVLRFIAPLTVEKSEIDMAISIVEKGIVEYLNK

SEQ ID NO: 69174 - protein, 109 aa, Triticum aestivum
MAQRDKKVEEPTEVHLHAAASPAAPVYMAVDRPAAGPADPKASKSSVNRCHNCRKRVGLTGFRCRCGEMFCGAHRYSDRHDCSYDYKSAARDAIARENPVVRAAKIVRF

SEQ ID NO: 69175 - protein, 230 aa, Blastopirellula marina DSM 3645
MLRSPNLIRCVLFDVVGTLIYPQPSVAAVYQAAGVANGCDLPIETIRARFREALILYSVSPDLRTDETLERERWRQIVAHVFAEANETKAILDRLWKHFAQASSWSVYQDALPTLEKLSDRYQVGLASNFDGRLRAIAGHWPCLSDAMLFVSAEVGWAKPSPHYFGSIANVLQLQPHQILLVGDDPRNDYHGAVAAGYQALFLAREKDVPADIAPEAVIQSLGEVITRLL

SEQ ID NO: 69176 - protein, 528 aa, Glycine max
MAEVAAPKKENPNLLLGRFELGKLLGHGTFAKVHHARNIKTGEGVAIKIINKEKILKGGLVSHIKREISILRRVRHPNIVQLFEVMATKTKIYFVMEFVRGGELFNKVAKGRLKEEVARKYFQQLVSAVEFCHARGVFHRDLKPENLLLDEDGNLKVSDFGLSAVSDQIRHDGLFHTFCGTPAYVAPEVLARKGYDGAKVDIWSCGVVLFVLMAGYLPFHDRNVMAMYKKIYKGEFRCPRWFSSELTRLFSRLLDTNPQTRISIPEIMENRWFKKGFKQIKFYVEDDRVCSFDEKQLQHHDGDDYLATSDSEVEIRRKNSNCNSTSNGNSLPRPASLNAFDIISFSQGFDLSGLFEEKGDEARFVSSAPVSKIISKLEEVAQLVSFTVRKKDCRVSLEGCREGVKGPLTIAAEIFELTPSLVVVEVKKKGGDKAEYEKFCNSELKPALENLGMEDSASSSSSCHQSTHTQSEFQQQHRTFSDSALNRHSDNNECLYDQELGLAEETSIPQLGEPKFEFQQENVPMFTI

SEQ ID NO: 69177 - protein, 402 aa, Prochlorococcus marinus subsp. pastoris str. CCMP1986
MSKLSLSSLDKSKLEGKKVLVRVDFNVPLNDSGQITDDTRIRAAIPTIKYLINNSAKVILAAHFGRPKGKVNEKMRLTPVAARLSDILEQKVNLTESCIGEEALAKSNSLNNGEVLLLENVRFYEEEEKNDLDFAKNLASHADMYVNDAFGAAHRAHASTQGVTKFLEPAVAGFLLEKELKYLQGAIDAPKRPLAAIVGGSKVSSKIGVLDSLLDKCDKIIIGGGMIFTFYKARGLDVGKSLVEEDKLELARNLEAKAKNKGVELLLPSDVLLANEFSPDAESKVSQIDAISGDWMGLDIGPQSIKVFQNALAECKTIIWNGPMGVFEFDKFAEGTNAIATTLADLSSFSEVCTIIGGGDSVAAVEKAGLAEKMSHISTGGGASLELLEGKTLPGVAALKDA

SEQ ID NO: 69178 - protein, 574 aa, Escherichia coli CFT073
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASEMLAQYSPLVLNGEGLVLPELKDIQKVSRAIAFAVGKMAQQQGVAVKTSAEALQQAIDDNFWHAEYRDYRRTSI

SEQ ID NO: 69179 - protein, 708 aa, Yarrowia lipolytica CLIB122
MSKAVKIIAGAAAAGGAYYLYQANGDAQKAKLLAQRDANTVTSKAGVTAPNDHLGEYYGKKLDQKVAGVRESVQDNQSLVEKQLANAKENAIETVNEWAKTTDQSLATTKADVKAKANEISTSANQEWKNVKGNLQNTKEAAQDKIDDASSAINDQATDAEKKAKKSWFGFTNYADEAKEDAKKKAGEVSTEAQQGLANVKENIQGAQDAAQDKINTATKAVSDEADQAKKSAKSSWFGLKDDAAKVKEQAEDKANELSRTVSNKSQEAVDGAKDSWFSLKSSAQDAKDDAVKKAQDAGQTVQDKAHEADKAAKDSWFSLKSDAQQAKDDAVKKAQEAGQTVQDKAAEADKAAKDSWFSLKSSATDAKDQAVEKAQETGQHIHDKAQEADKAAKDSWFSFKSSAADAKDDAVNKANEVGQTVQDKANEADAAAKKSWFSLKSDAQKAKDDAVDKANEVGQTVQDKAAEADKAAKDNWNSLKKDASKAQDDAYETYKGYSDAAVKKGKDLDTQARQYWESLKADVEKASNDASKKVDQLTQDASDQAKSLDKSAKKGWFSFKSDTEKAVDDSQKWLEGASESAIQKGKELDAEAQTYWDSLKKDAEKAWNDAEAKANELGQTLSNKSEEFDKAANETWNNLKSSVNEFQSQGEQFAKDVDNAAAEKWSDAKDKGSDLRADANKKWNQAMDKTAETAKENKGLVNSVFGK

SEQ ID NO: 69180 - protein, 490 aa, Convolvulus assyricus
  misc_feature (10)..(10): Xaa can be any naturally occurring amino acid
MRINPTTSSXEVSAVEKKNLGRIVKIIGPVLDVSFPPGKMPNIYNALVVQGRNNEQTNVTCEVQQLLGNNRVRAVAMSDTNGLMRGMEVINTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYMEMNESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 69181 - protein, 177 aa, Lemna gibba
MASSMMASTAAVARAGPAQSNMVAPFNGLRSSVAFPATRKANKNLSTLPSNGGKVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 69182 - protein, 471 aa, Elaeis guineensis
MKGMVTSAATLLPFSLCLLLLCRPSLAQFERSPRQSVRRSGEQSQCGVEKHNALEPIREVRSEAGVTEYYQNNAQFECAGVAAFRRTIEPRGLLLPSFSNAPRLVYIIQGRGIYGTVIPGCPETFQSFQQSESEKQSEKGQRQRFRDEHQRIHHFNQEDVIAIAAEVAHWCYTDADTPVIAFTVSDISTARISLMKTIGNSYWLGDGVAAGGNLGKNKNRAQRATSLADSIPSYWRPAIGVDREVARKLQCKDDQRGEIVRVEKGLEVLRPSSEKQEREERGRGTNGLEVAMCSMRNRENIDSSRRADVYIPRGGRITNLNSQKLPMLSFIQLSAERVVLYKNAMLAPHWNINAHSVTYCTGGRGGVQVVDNNGKTVFDGELRQGQLLVIPQNFAVIKQAGNEGFEFTSIKTIDNAMVNTIVGKASAFQGMPEEVLMNSYRINRNEARTVKFNRGHEMAIFSPRSEGRADA

SEQ ID NO: 69183 - protein, 180 aa, Solanum lycopersicum
MASSVISSAAVATRSNVTQASMVAPFTGLKSSATFPVTKKQNLDITSIASNGGRVSCMQVWPPINMKKYETLSYLPDLSDEQLLSEIEYLLKNGWVPCLEFETEHGFVYRENNKSPGYYDGRYWTMWKLPMFGCTDATQVLAEVQEAKKAYPQAWVRIIGFDNVRQVQCISFIAYKPEGY

SEQ ID NO: 69184 - protein, 490 aa, Polymeria pusilla
  misc_feature (404)..(404): Xaa can be any naturally occurring amino acid
MRINPTTSGSEVSAVEKKNLGRIVKIIGPVLDVAFPPGKMPNIYNALVVQGRDTEQTNVTCEVQQLLGNNRVRAVAMSDTNGLMRGMGVIDTGAPISVPVGGSTLGRIFNVLGQPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIXILGLDELSEEDRLTVARARKIERFLSQPFFVAEVFTGSPGKYVGLAETIRGFQLILSGELDGLPEQAFYLVGNIDEATAKAMNLKT

SEQ ID NO: 69185 - protein, 217 aa, Desulfitobacterium hafniense Y51
MVKLIFTRHGETLWNIEGRVQGAMDSPLTEKGILQARKVGQRLRKEGITRIYSSDLPRARATADEIRKAVGIEEILLDPALRELSFGEWEGKNWWDLRQLHPELFSLWDTGPHQVQIPGAESMWEVSERAWQFVQELPRLHDGETLCVVTHGMTLQLIVKKALGIPVEQWNDVPWQHNTAVNIFEFYEDGRIHPILLADHTHLDDDIKPASGFTSKK

SEQ ID NO: 69186 - protein, 180 aa, Pisum sativum
MASMISSSAVTTVSRASRGQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 69187 - protein, 180 aa, Petunia x hybrida
MASSVMSSAAVATSTNAAQASMVAPFTGLKSAASFPVSRKQNLDITSIASNGGRVQCMQVWPPYGKKKYETLSYLPDLTDEQLLKEIEYLLNKGWVPCLEFETEHGFVYREYHASPRYYDGRYWTMWKLPMFGCTDATQVLGELQEAKKAYPNAWIRIIGFDNVRQVQCISFIAYKPPGY

SEQ ID NO: 69188 - protein, 175 aa, Triticum aestivum
MAPAVMASSATTVAPFQGLKSTAGLPISCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 69189 - protein, 197 aa, Aquifex aeolicus VF5
MKVLMIDNYDSFTYNLVQYLGSLGADVIVRRNDQIRLEEVREINPDAIVISPGPCTPKEAGISVPLIKTYYKEYPILGVCLGHQSIGYAFGAKIVRAKRLMHGKTSQIFHTGEGVFKNLPSPFTAVRYHSLVIDKNTLPEELKITAWSDDEEIMGIEHKEYPVYGVQFHPESVLSEHGMEILKNFLELAEERKLVKK

SEQ ID NO: 69190 - protein, 639 aa, Avena sativa
MSKLLVIAILLLPLISHGRDLSTIWVWEDKDFFKYCPPSQCSQHGPEIRYPFCLASSNTSSCGCGSRSVRKLVCSGQDTILVHPVLGPYNVSAIDYRHSSMKLIPLVDPCMVLQKKLISSRSSSSSQVYDDNDYDEDYDEYHEFLDPSATLVYCSREFTPSAADRIAGPVSCLSNTTHFLYFVASDEVISLLPLDCKVIPVSDGGGGRTIAMYMYAPVSMLDLYPQSFKESAESILSFAKKTVYWNGYNCRQCELSGGRCAFSAQRLEPFCMPHGSRTKVIAATSSVAAFVVLLLTVATALYLSLRTRYNEEIHLKVEMFLKTYGTSKPTRYTFSEVKKIARRFKEKVGQGGFGSVYKGELPNRVPVAVKMLENATGEGEVFINEVATIGLIHHANIVRLLGFCSEGMRRALIYEFMPNESLEKYIFSHDPNIFQNVLVPNKLLDIALGIARGMEYLHQGCNQRILHFDIKPHNILLDYNFNPKISDFGLAKLCAKDQSIVTLTAARGTMGYIAPELYSRNFGGISYKSDVYSFGMLVLEMVSGRRNSDPSTESQNDVYLPEWIYEKVINGQELALTLETTEEEKEKVRQLAIVALWCIQWNPRNRPSMTKVVNMLTGKLQNLQMPPKPFVTSENQPMP

SEQ ID NO: 69191 - protein, 306 aa, Triticum aestivum
VTRLNKFVQKSRLVPVRNSRDIVDPRVRYSAPHASDVIGDRGLEVVGDTCKKLRRLRIERGDDDPGLQEEQGGVSQLGLTAVAVGCRDLEYIAAYVSDITNGALESIGTFCKNLYDFRLVLLDRQKQVTDLPLDNGVRALLRSCTKLRRFALYLRPGGLSDIGLDYIGQYSGNIQYMLLGNVGESDHGLIRFAIGCTNLRKLELRSCCFSEQALSLAVLHMPSLRYIWVQGYKASPAGLELLLMARRFWNIEFTPPSPEGLFRMTLEGEPCVDKQAQVLAYYSLAGQRQDCPDWVTPVASSCMIGW

SEQ ID NO: 69192 - protein, 653 aa, Avena sativa
MGNPGAFRCSVTLQALIVFSLIAVFAADHVQGGDDGCAPFSCGHLQDISSPFRRQGDPLECGVGAYELGCTSSKATIHINTGTYYVTAINYTNSYFRVMDTNFDTNSSCPLPLWNHLPYVESILDSHGFWDLSIRSGYTACFANCSRAVTNNGAYKPVDCLSADNSHVYIWMSGYFDCRVLDLEPYCGYLAMIPFGEEYSSDMQLQLQGASYADIIQLITKGFTIQFPYEEYREPSLSKDMNICLNHSISYFKELISHASFVNWTRAFFWSDMYFYRCVDRLYTFEHTTSPVVAQLIAVPKFLFVYKYLKTRITIDAVEKFLRIQQMIGPTRYAYTDIVALTSHFRDKLGQGGYGSVYKGVLLPGGAHVAVKMLEGNSSCNGEDFISEVSTLGRIHHVNVVRLVGFCSEELRRALVYEYMPHGSLDKYIFSAEKSFSWDKLNEIALGIARGINYLHQGCDMQILHFDIKPHNILLDTNFVPKVADFGLAKLYPRGDSFVPLSAMRGTVGYIAPEMISRSFGVISSKSDVYSFGMLLLEMAGGRRNADPNAAASSQGYYPSWVYDQLTLQGESGEISPVTANMHELEKKLYESRDRPTMSEVMDMLEAGADGLQMPSRPFFCDEGHIHVEDSYHFTSELTTVSEELTVVSEDEE

SEQ ID NO: 69193 - protein, 596 aa, Pseudomonas putida KT2440
MKFSIPLIRTLCLMAISGSVGADQVLPTPPELASGYRSGLQPVHASRHMVAAANPLASEAGRAMLRAGGSAIDAAIAMQMVLTLVEPQSSGIGGGAFILYWDGKRVQAFDGREAAPAAVTEKLFLQADGTPMPFRVAQIGGRSVGVPGVLRALKQAHEQHGKLPWHALFAPAIALARNGFAVSERLHTLLAGDPYIARSPAMARYFLDEQGRPLAVGTILRNPELAQTLEQIAAQGPEVFYSGEIAEAIVAKVRGHANAGYLSLQDLQQYQAKEREPLCGPYKAWQICGMPPPSSGGVTVLQTLGLLDAVQRTAPQRDLAALRPLATSSPARLEAPPLAVHLIAEAERLAYADRAQYLADNDYVPVPVKALTDSAYLASRAALIGEHSMKRARPGQPQGADLALAPDRSPLRISTSHLSAVDDNGQALAMTTSVEAAFGSHLMVKGFLLNNQLTDFSFIPHEHGKPVANRVQPGKRPLSAMAPTLVFSRATGEFVASLGSPGGSQIIGYVNKALVGLLDWRLDPQQAADLPNFGSRNAGTEVEAGLSSPALIRQLAAWGHEVTPMTMTSGMQIIQRSGEGWSGGADPRREGVALGD

SEQ ID NO: 69194 - protein, 347 aa, Burkholderia xenovorans LB400
MLRERGVRFLMNTTVDGLRRSPHGVEAFSGGAALPADHVVLASGAGAARLLKPIGIRAAIYPIKGYSLTFELQAQSTAPHVSITDSGRKVVYARLELLARNDVDGVVVTHGTDTIEETSYFLHLTLKSAKPVVVVGSMRPPSAMSSDAALNLYDALAVAAHPSSRGLGALVVANSEIHTARDVVKSNSFKLDAFRSPYGALGIVIEGTPRYYRRPARAHTLDTPWSIDTLRTLPKVDIVYAYGALESSAVAAIAKNARGLVFAGTGNGNVAGHLIGPLRDAARRGVRVVRASRTGNGVVLHNAAQPDDEYGWLTVDDQAPLKARLLLTLALTQTDDTNALQAVFERY

SEQ ID NO: 69195 - protein, 495 aa, Avena sativa
MLVHPFLGPCRVTAIYYSRFVIELIPLLASSPCPLQKLYSKTIPVHFAYEEHPRKAHCDIADIYDEKRAILQHNSLLVFVAANQLMTDLPLNCEVVSDGLIWLPYSWDQSGSYWQPTLNTSVERILKSAKTEQGWTGSHIKVIAATSSVATLIVLFLIVATAVYLSLKTNYNKEIHLKVEMFLKTYGTSKPTRYTFSEVKKIARRFKVKVGQGGFGSVYKGELPNGVPVAVKVLENSTGEGEVFINEVATIGLIHHANIVRLVGFCSEGTRRALLYEFMPNDSLEKYIFSPDSNIFQDLLVPEKMLDIALGIARGMEYLHQGCNQRILHFDIKPHNILLDYNFNPKISDFGLAKLCARDRSIVTLTAARGTMGYIAPELYSRNFGGISYKSDVYSFGMLVLEMVSGRRNSDQGIESQNEVYLPEWIYEKVTTGQDPVLTRELTGEERVKIRQLAIVALWCIQWNPKNRPSMHKCGKYVDREVAESTDTTKAFCVI

SEQ ID NO: 69196 - protein, 480 aa, Oryza sativa Japonica Group
MVKICCIGAGYVGGPTMAVIALKCPAIEVVVVDISKPRVDAWNSDQLPIYEPGLDEVVKECRGRNLFFSTDVEKHVAEADIIFVSVNTPTKTRGLGAGKAADLTYWESAARMIADVSKSDKIVVEKSTVPVKTAEAIEKILTHNSKGINYQILSNPEFLAEGTAIEDLFKPDRVLIGGRETPEGKKAVQALKEVYAHWVPEDRIITTNLWSAELSKLAANAFLAQRISSVNAISALCEATGANVSEVAYAVGKDTRIGPKFLNASVGFGGSCFQKDILNLVYICECNGLPEVANYWKQVIKINDYQKSRFVNRVVASMFNTVSGKKIAVLGFAFKKDTGDTRETPAIDVCHGLLGDKAQISIYDPQVTEDQIQRDLSMAKFDWDHPRHLQPTSPTAFKQVSVVWDAYEATKGAHGLCILTEWDEFKTLDYQRIFDNMQKPAFVFDGRNVVDPEKLREIGFIVYSIGKPLDAWLKDMPAVA

SEQ ID NO: 69197 - protein, 275 aa, Mycobacterium sp. KMS
MREVRPFTNRRRVSAVKAGDRRVAIVTAAAAGIGKAIALRWCREGGCCVMADTDGEGLDAAVHELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPDEIAAPAVFLASPEASYITGAVLPVDGGMTAGVTFRAFEAV

SEQ ID NO: 69198 - protein, 653 aa, Avena sativa
MGNPGAFRCSVTLQALIVFSLIAVFAADHVQGGDDGCAPFSCGHLQDISSPFRRQGDPLECGVGAYELGCTSSKATIHINTGTYYVTAINYTNSYFRVMDTNFDTNSSCPLPLWNHLPYVESILDSHGFWDLSIRSGYTACFANCSRAVTNNGAYKPVDCLSADNSHVYIWMSGYFDCRVLDLEPYCGYLAMIPFGEEYSSDMQLQLQGASYADIIQLITKGFTIQFPYEEYREPSLSKDMNICLNHSISYFKEHISHASFVTWTRAFFWGDMYFYRCVDRLYTFEHTTSPVVAQLIAVPKFLFVYKYLKTRITIDAVEKFLRIQQMIGPTRYAYTDIVALTSHFRDKLGQGGYGSVYKGVLLPGGAHVAVKMLEGNSSCNGEDFISEVSTLGRIHHVNVVRLVGFCSEELRRALVYEYMPHGSLDKYIFSAEKSFSWDKLNEIALGIARGINYLHQGCDMQILHFDIKPHNILLDTNFVPKVADFGLAKLYPRGDSFVPLSAMRGTVGYIAPEMISRSFGVISSKSDVYSFGMLLLEMAGGRRNADPNAAASSQGYYPSWVYDQLTLQGESGEISPVTANMHELEKKLYESRDRPTMSEVMDMLEAGADGLQMPSRPFFCDEGHIHVEDSYHFTSELTTVSEELTVVSEDEE

SEQ ID NO: 69199 - protein, 386 aa, Clostridium acetobutylicum ATCC 824
MSCTINPLVKKIELSPIREISDAALKYSDAINLTVGQPDFTTPEHIKLSAKKAIDNNHTSYTANSGICELRKAASNFINKKYNLNYNSDKEIIVTNGATEAIDISLRTILEKDDEVLLPAPIYVGYEPVINFCGAKPVYMDTSSNNFILNAEILEKYLTPKTKCLILCYPCNPTGSAMDKNALTEIVNLLKNKDIFVISDEIYSELTFKKRHFSIAGFEDMRNKTILLNGVSKSHSMTGWRIGFIFAPEYLTSEIFKLHQYGSTCSCSISQYAALEALTNGFNDSEYMKKEYIKRRDFIYKELVSMDFDVVKPEGAFYIFPSIKKFNMTSLNFSLKLLEKEHLAVVPGSAFSHYGEGYIRISYAASMKDLKEGMIRLRRFIQSVKL

SEQ ID NO: 69200 - protein, 641 aa, Avena sativa
MSKLLAIAILLLPLIDHGIDLATAWDDKDFFKYCPPSRCSQHGPEIRFPFCLESINTSSCGCGSRSIRKLACSGQDTILLHPVLGPYNVSAIDYRHSSMKLIPLVDPCMVLQKKLINFRSSPCPQIDDINDNLLVHFYRSTSLVCCSGEFTPSAADRIAGPISCLSNATHFLYFAAGYEDMSLLPLDCKVVPVSDGLYGRIPTYILDDPIVGRYQQSQLFKESAEIILSSAEMTVYWYDGAQNANTMGDTARSTHKGKLHSACLTLTNSTKVPLVAFLSNHIEPTTSSVAVFVVLLLTTVTMIYLSLRTRYSEEIHFKVEMFLQTYGTSQPTRYTFSEVKKIARRFKEKIGQGGYGSVYRGELQNRVPVAVKMLENSRGEGEVFINEVAPIGLIHHANIVRLVGFCSEGTRRALIYEFMPNESLEKYIFSHDPNIFQHLLVPQKLLDIALGIARGMEYLHQGCNQRILHFDIKPHNILLDYNFNPKISDFGLAKLCPRDQSIVTLTAARGTMGYIAPELYSRNFGEISYKSDVYSFGMLVLEMVSGRRNSDPSIESQNKVYLPEWIYEKVINDHELALPAETTEEEKEKVRQLAIVALWCIQWNPRNRPSMTKVVNMLTGSLQNLQMPPKPYVTSENQLMP

SEQ ID NO: 69201 - protein, 392 aa, Synechococcus elongatus PCC 6301
MKLSERVGRVSPSLTLAIAAQAKAMKAEGLDVCSFSAGEPDFETPLHIRNAAAQALAEGKTRYGPAAGEPDLREAIAQKLRADNGLDYQAANILVTNGGKQSLYNLMQVLLDPGDEVIIPAPYWLSYPEMVKLAGGVPVIVETFASDGFKLQPQQLAGAITPRTRLLVLNSPSNPTGMVYSRQELEAIAPIIEAHDFWVVSDEIYEKILYDGADHHSIGSLSPACFERTLISNGFAKAYSMTGWRVGYLAGPSELIAAAASLQSHSTSNVCTFAQYGAIAALQGPQDCVAEMLAAFTERRQLILNGLNQIAGLSCPIPEGAFYVFVDISKTGLDSMTYCRQLLDQHQVAAIPGIAFGDDRSIRLSYATDCQTIEKGLERLQLFQNSLLGVSV

SEQ ID NO: 69202 - protein, 285 aa, Geobacter sulfurreducens PCA
MWDYTEKVREHFLNPRNVGEIPDADAVGEVGSLACGDALKLYIKLDEAKEKIVDAKFQTFGCASAIASSSALTEIIKGKTLDEALATTNQEIAEFLGGLPEEKMHCSVMGQEALEVAIAKFRGGPVPTHHDHGHEEAEGEIVCKCFGLTDVFLRKVIETNKLTTAEQVTHFTKAGGACGGCIPKIKEIINEVLGAKPAEEHKRPEKLTNLRKMQLIQETLEKEIRPQLWADGGDLELIDISGSEVQIAFRKACAGCAASGNTAKFVEMKLRELVAEDITVTEVEG

SEQ ID NO: 69203 - protein, 763 aa, Nostoc punctiforme PCC 73102
MSNIKRRHFLQFSASTLAMLGLSQFDIMQQANSVGKVLAQSTGRKLALLVGINDYPASNGLDPLKGCENDVKLQEYLLIHRFGFKQEDIRILLNQQATRQGILTAFENHLIAQAKRGDVVLFHYSGHGSQVQDPDRDSPDGLNSTLVPIDSPLPTGFPAFGGAVKDIMGHTLFLLMSALKTDNVTFVLDSCFSGGGTRGNLRVRSRSGGEKLQPSQEELDYQRQWLNKLGLSQQEFIQKRRQNVAKGVVITSAKRDQYAADVPFSGFHAGAFTYSLTQYLWQQTGNESVNRAIANIGRSTKELASENGNDQDPEFESNLSEENANTPIYFIPVQAIPAEAVVTQVTENQAQLWLGGIDSQSLEAFNSNSVFSIVDGLGNEIGQVQLQSRQGLVGRGTLKYTTSKGKLHPGNLLQERIRIIPRNATLKIGIDESLDNKTAQQAIQAMKALKRVEPKSLTKEELQYIFGQMTKTKHQELQKKGVSKLPVVGSFGLFLPSQDQIIPASFGAASEPITEAVKRLQPKFKSLLAARVIKQILGNTNSSRLNVTVSMNIAGSNELLAETFPIRGVAKKPQQPNSSTPVSSIKFSDAGLRQLPVDTQIAFQIKNNESQPLYVSILVIDAEGEMTIIFPNKWSDSENAALVEAKQTQLIPQADDEFTLTIVTPLGVSEALIIASTTPLKTALQALQTIASRSTDTKSRNVPLPVTNELLDVTNNLLDDLDAGTRSGNSVNNIQLPSSDRGVDTTKLAAMAIAFEVIASSSS

SEQ ID NO: 69204 - protein, 111 aa, Glycine max
MDPQLWHKVAAISGVAALGLGTYGAHVFKPQNPAYKDVWHTASLYHLVHTAALVAAPITKHPNVFGGLLTAGILVFSGTCYTVAFLEDRKYSTMAPFGGFAFIAAWGSLFF

SEQ ID NO: 69205 - protein, 222 aa, Zea mays
MAATAAALRCCFPGSSGVGSGFVKPNSSRRGWCAAAVAAPSREAEPVSSLGHRTRVDFPILHQEFDDAKLVYFDNGATSQKPCSVMKTLDEYYRSYNSNVHRGIHALSAKATHAYEDARRKVANFVNAADSREIVFTRNATEAINLVAYSWGLSNLKEGDEIVLTVAEHHSAIVPWQFVSQKTGATLKYVGLTKENVPDIEQLKGFLSNKTKIVVVHHVSNV

SEQ ID NO: 69206 - protein, 489 aa, Escherichia coli CFT073
MHLLTLSINPTFLMRSNHFKEFKMDKKQVTDLRSELLDSRFGAKSISTIAESKRFPLHEMRDDVAFQIINDELYLDGNARQNLATFCQTWDDDNVHKLMDLSINKNWIDKEEYPQSAAIDLRCVNMVADLWHAPAPKNGQAVGTNTIGSSEACMLGGMAMKWRWRKRMEAAGKPTNKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 69207 - protein, 710 aa, Arabidopsis thaliana
MVGLDSSHLLRDKILCFSSRSHINNQHKKTSYALSLNHMKLPIQRTLAFALARGKGEAESFSRLEATFGDNTSTECTWSFDFPDSKDAMSHLKSEADLSGSNGANNVASVIEKLNALRSHLLAAEKWNASQLHLCDSKYLECATNLVHYMALRSLDIEQLNSHLASLGLSSLDNNNLDVLAHLNASINLLMNDQNAVTESWTNVYPKGKSTKKNDKGRVLSYKESLLGKLREGRSTHIMVTIGEEATLSETFITDILKAGTSVIRINCAHGDPSIWGEIIKRVRRTSQMLEMPCRVHMDLAGPKLRTGTLKPGPCVMKISPKKDAYGNVVSPALVWLCLTGTEPPAHVSPDATISVQGQDFLAGLQIGDSIRLCDARGRKRRLKISKEFHVFNSTGFVAECFDTAYIESGTELSVKGKKGRRLVGRVVDVPPKESFVRLKVGDLLVITREGSLDEPSVTVPGAHRLTCPSGYLFDSVKPGETIGFDDGKIWGVIKGTSPSEVIVSITHARPKGTKLGSEKSINIPQSDIHFKGLTSKDIKDLDYVASHADMVGISFIRDVHDITVLRQELKKRKLDDLGIVLKIETKSGFKNLSLILLEAMKCSNPLGIMIARGDLAVECGWERLANMQEEIIAICKAARVPVIMATQVLESLVKSGVPTRAEITDAANAKRASCVMLNKGKNIVEAVSMLDTILHTKLIYKKSDSENLH

SEQ ID NO: 69208 - protein, 430 aa, Prochlorococcus marinus subsp. pastoris str. CCMP1986
MKETIDFLIDTIEARQVLDSRGNPTVEAEVFLECGAIGRAIVPSGASTGAHEAHELRDGGTKYMGKGVLNAVNKIHETISPALCGLSALDQTSIDNLMIEIDGTPNKSSLGANSILAVSLANARAASNALDLPLYRYLGDPLSNLLPVPLMNVINGGAHAPNGLDCQEFMLVPHGVKTFSEALRIGTEIFHSLKSLLEKKGLSTAVGDEGGFAPELSSSEAAGDLLLEAIQKAGFIPGEQVSLALDVASTEFYKDGFYKYEGKSLTSSQMISYLSNLVSNYPIVSIEDGLAEDDWEGWSALNKEIGNKVQLVGDDLFVTNTERLRKGILEKSANSILIKVNQIGTLTETLEAMDLAKSAGFTSVISHRSGETEDTTIADLSVATRAGQIKTGSLSRSERIAKYNRLLRIEEELGDQARFAGDLGLGPKNI

SEQ ID NO: 69209 - protein, 545 aa, Blastopirellula marina DSM 3645
MQPTTVEQVVLDLIVILTAGAISGAVCRRFQISSLVGYLMIGAICGSGGLGFFTSESEVLAHLAEIGALFLLFSIGMEISLDEVQEFAFRLLVGGPTQLLLVSIPSALLIRALGLDWPAAILLGSAIALSSTVLVFRALKEGGVQSTAAGVSSISVLIFQDMAIVPLMLMAPLLAGASDKSSMDLLKLGLYSLMFLAIIPISGAIVRRIGVPVLQRLRSRELLVLFALAVLGGMCYLAHELGLPAALGAFAAGLILSGNRLTQQVDALILPFRETFAAIFFISLGGLLHFQEAMQDPWLILIGLPVILALKTLGGAVALRAVGVRWPVAFCFGLGLAQVGELSFLLLSEGMRLDLINAAQYNQMLVLAIATLLLTPAMISYGIRAVGDHLAEVVRHVKKLKRPPSDVKEAVVIGVGPIAKQVASRFEMMGILVCFVDMNAVNTYPLEQMGFRTVTGDATKLKTLQQAEVDRAQLVLVSVPSDEAAVAIVRTIRRLNKKATIMARCRYLETRARLLSSGADLAIDEESHVASALLSMVDSLDLSPH

SEQ ID NO: 69210 - protein, 289 aa, Oryza sativa Indica Group
MATPPEPSSWLSLKVFFLRVSRCEVNESMLDSVTVTHAPLTPDTVLEVSGGSVASNGHVSLRLDRAGGVGAAATEGGDSCTFVSTADVRVSGSARFDVQCGGERLVVGILDTRDAGAGGGGWVMKCQVAAQRGSGLVRRGSKEAKPPVVEVYVAGLARGAPVVFTRAMQLRFRRRRHVKAFMEPIPEHGEPAEDSKETLPPKHETEVSEYRCYKPEQDAGDADYDGFYVKPAGEEDDDGDFSWFTAGVRVGVGISVGICLGIGIGAGLLARSYHSTSRSLRSRLISSLF

SEQ ID NO: 69211 - protein, 810 aa, Zea mays
  misc_feature (237)..(237): Xaa can be any naturally occurring amino acid
MTSQGEPSSSDPKGKKDYSTAILERKKSPNRLVVDEATNDDNSAVALHPDTMERLQLFRGDTVLIKGKKRKDTVCIVLADETCEEPKVRMNKIVRKNLRVRLGDVVSVHQCPDVKYGKRVHILPIDDTIEGITGNLFDAFLKPYFLEAYRPLRKGDLFLVRGGMRSVEFKVIETDPAEYCIVAPDTEIFCEGEPIKREDEERLDEVGYDDVGGVRKQMAQIRELVELPLRHPQLFRXIGGKPPKGILLFGPPGSGKTLIARAVANETGAFFFLINGPEIMSKLAGESESNLRKAFEEAEKNAPSIIFIDEIDSIAPKREKTHGEVERRIVSQLLTLMDGLKSRAHVIVMGATNRPNSIDPALRRFGRFDREIDIGVPDEVGRLEVLRIHTKNMKLAEDVDLELIAKDTHGYVGADLAALCTEAALQCIREKMDIIDLEDETIDAEILNSMAVSNDHFKTALGTSNPSALRETVVEVPNVSWEDIGGLENVKRELQETVQYPVEHPDKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMNAKKTVFIIGATNRPDIIDPALLRPGRLDQLIYIPLPDEQSRLQIFKACLRKSPVAKDVDLHALAKYTQGFSGADITEICQRACKYAIRENIEKDIERERRRKDNPEAMEEDEVDDIAEIMAAHFEESMKYARRSVSDADIRKYQAFAQTLQQSRGFGSEFRFSDQPTAAAGSAGAADPFASAAAAADDDDLYS

SEQ ID NO: 69212 - protein, 526 aa, Moritella sp. PE36
MTTNIHEQKILILDFGSQYTQLIARRIREIGVYCELWTWDVDEAAIREFNPNGIILAGGPESVTEAGSPRAPDYVFNAGVPVLGICYGMQTMSEQLGGKVIKGTGEGEFGYAQIEMQAPSALFNSIEDAVSESGKALLDVWMSHGDKVSAIPEGFVTVANTATCEFAAMANEEKRFYGVQFHPEVTHTRQGERMLAHFAKDICGCDGLWTSSSIIDDAIARMKAQIGDDEVILGLSGGVDSSVVAMLLQRAIGDKLTCVFVDNGLLRLNEGQQVMDMFGDRFGLKIVHVKAEDRFLDQMAGESDPEAKRKIIGRVFVEIFDEESKKLTNAKWLAQGTIYPDVIESAATKNGKAHVIKSHHNVGGLPDDMEMGLIEPLRELFKDEVRKIGLELGLPYDMLYRHPFPGPGLGVRVLGEVKKEYCDLLRRADAIFIEELHKAELYHKVSQAFVVFLPVRSVGVMGDCRKYDWVVSLRCVETIDFMTARWSHLPYDLIGHVSNRIINEIDGISRVVYDVSGKPPATIEWE

SEQ ID NO: 69213 - protein, 490 aa, Aniseia argentina
MRINPTTSSSEVSAVEKKNLGRIVKIIGPVLDVAFPSGKMPYIYNALVVQGRDNEQTNVTCEVQQLLGNNRVRAVAMSDTDGLMRGMEVIDTGAPISVPVGGSTLGRIFNVLGEPVDNLGPVDTNTTSPIHISAPAFIQLDTKLAIFETGIKVVDLLAPYRRGGKIGLFGGAGVGNTVLIMELINNIAKAHGGVSVFGGVGERTREGNDLYLEMKESGVINEENMAQSTVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 69214 - protein, 132 aa, Helicobacter pylori
SNIKYELDKESGALMVDRVLYGAQNYPANYGFVPNTLGSDGDPVDALVLSDVAFQAGSVVKARLVGVLNMEDESGVDEKLLALPIDKIDPTHSYVKDIDNLSKHTLDKIKHFFETYKDLEPNKWVKVKGFEN

SEQ ID NO: 69215 - protein, 490 aa, Odonellia hirtiflora
MRINPNTSSSEVSAVEKKNLGRIVKIIGPVLDVAFPSGKMPYIYNALVVQGRNNEQTNVTCEVQQLLGNNRVRAVAMSDTDGLMRGMEVIDTGAPISVPVGGSTLGRIFNVLGEPVDNLGPVDTNTTSPIHRSAPAFIQLDTKLAIFETGIKVVDLLAPYRRGGKIGLFGGAGVGKTVLIMELINNIAKAHGGVSVFGGVGERTREGNDLYLEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIPILGLDELSEEDRLTVARARKIERFLSQPFFVAEVFTGSPGKYVGLAETIRGFQLILSGELDGLPEQAFYLVGNIDEATAKAMNLKT

SEQ ID NO: 69216 - protein, 128 aa, Clostridium symbiosum
AALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIE

SEQ ID NO: 69217 - protein, 132 aa, Helicobacter pylori
SNIKYELDKESGALMVDRVLYGAQNYPANYGFVPNTLGSDGDPVDVLVLSDVAFQAGSVVKARLIGVLNMEDESGMDEKLLALPIDKIDPTHSYVKDIDDLSKHTLDKIKHFFETYKDLEPNKWVKVKGFEN

SEQ ID NO: 69218 - protein, 485 aa, Tetralocularia pennellii
TTSSSEVSAVEKKNLGRIVKIIGPVLDVAFPPGKMPNIYNALVVQGRDNEQTNVTCEVQQLLGNNRVRAVAMSDTNGLMRGMGVIDTGAPISVPVGGSTLGRIFNVLGEPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYLEMKESRVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 69219 - protein, 169 aa, Magnetospirillum magnetotacticum MS-1
MVMTSQPVPPPIDPTSTPSWTALTVHRDTVEPDLRTWFAADPDRARRLTHQAADLTVDLSKNLVTDETLELLVRLAEEVHLDDRLEAMFTGEHINVTEDRAVLHTALRRPTPLGDDEHLVVDGQDVDADVHAELAKVYAFADKVRSGEWTGVTGERVRTVVTSASRSTS

SEQ ID NO: 69220 - protein, 341 aa, Mycobacterium sp. KMS
MEAIVLNGTNDVGLTSVPDPAPQDGEVIIEVAATGLCGTDLHEYVAGPTFSQPPVVLGHEVSGRIVEVGAGVDQSRIGQGAAVIPMDFCGSCHYCHRSLYHLCQRPGWIGFTRNGGLANYVAVPSRLAVRVPDVVDLEEAALTEPTAVAFHAVRRAELLLGETVMVLGAGALGLTVIQCARAAGAARIFVTEPSGVRASLARDLGATLVLDPHDPGTTACILEETRGVGVDVVFHVAGSAEAFTQGLDCLRKQGRFMEMSSWAGAASLDVNRHLLKEIQLRMVFGYDMFDDFPAVLALIADGKLALAPQITARVPLDRAVKEGLGGLLEGREGLVKVLVKP

SEQ ID NO: 69221 - protein, 77 aa, Zea mays
PKVPFKVFRVPKGGPFSPVVKYPPGEFKVPPQTRAFFPKDGIGIPPPQRAGNVFFKHGLEVGFIPPEKVGAGVMFSG

SEQ ID NO: 69222 - protein, 829 aa, Cryptococcus neoformans var. neoformans B-3501A
MSGHSHRPTLKQSNKGFKSKHASKGSLKAAAKGKVSSSAHSHGTKNALGNSKKARLNANAQKRTAKRQAVIQDQKFFSTSSGGGHVPRIVSVVPLLPSISPRTFIANLLPSLGLDESELQEISAALADYGSYLLRAPRYKTSLQINLLPPLSVYPTLDAAFVSDYIVLLMSSVDEVQLQGETILRSLQGQVGGAEIVACVQAPESNPLRPDTRQLIHKSLLSFTRYFFPSVGKIYSSDTPQESLLLARALCEAAPKGMRGDDGRAYIVAENPNSIRWTGSGILTEDGQEKGQLEIIGTVRGGGTLNADRLVHIPGSGDYQVAAILSAPLPSKRQQTQIATNDTLSVPTEDADDLTATNIPDLLANEQTWPTEEEMGGSMEHTVEEPVVKKRVKRVPKGTSAYQAAWIVDDDEEVDAEDLSDDESMAASGDEAASAGERSAAEDEEEFEDVEVDSRQEVAHKDLDPEQEEADYEAYLKERSKADREDAMFPDEVDTPRHIPARTRFQRYRGLKSFRTSPWDPYEDLPIDYAKIFQFENFAATSKRIQLEGAREGVKTGTRVILVLRDVPRSVIEDRETGIPFIVHGLLRHEHKQSVLHFVVQRNTEYAEPVKAKEPLVLCVGPRRYIVRPLYSQHVRGGGKGANNVHKSEKFLRPGTATVMSVFGPICFGKSPCLLMKDRGIKTGKFILSHIDAYSDLHPLSVPDLVAMGSFLSSDPTRIIAKRIILTGHPVKIHKKTATIRYMFFNREDIEYFKSVQLHTKYGKIGNIKEPLGTHGYFKAHFDGPIQQMDTICMSLYKRQYPKWSEEFRPQLAVGAIEEAGEDVMETDE

SEQ ID NO: 69223 - protein, 619 aa, Avena sativa
MSREEMKGATFSCGHLQGISYPFRRRGDPLECGVGAYELGCTSSKATIHINTGAYYVTAINYTGSYFWVMDANFDTYSSCPLPLWNHLPYSGYYGKFDSHGFRNLATQSYYRACFANCSRAVTDNSAYKPVACLSADNSHVYVWVSNYECTVDDLEPYCGYLSMIPLGDDWQIQLQDASYADITQLITKGFTVQFPVDTNAWSVSVSKTISICLNDSISYFKEQISDASMVKRIRAYFWSEMHFYQCVAYRSYNSDYTATSILVVIAIVSAIAIPKFLFAYKYWKTRITIDAVEKFLRIQQMIVPTRYSYTDIVAITSHFRDKLGQGGYGSVYKGVLLPGGVHIAVKLLEGNSSCNGEDFISEVSTIGRIHHVNVVRLVGFCAEEMRRALVYEYMPHGSLDKYIFSADKSFSWDKLNEIALGIARGINYLHQGCDMQILHFDIKPHNILLDSNFVPKVADFGLAKLYPRGESFVPLSALRGTIGYIAPEMISGSFGVISSKSDVYSFGMLLLEMAGGRRNADPNAGTSSLGYYPSWVYDQLTRRDAGEISPVSNMHELEKKLCVVGLWCIQMRSRDRPTMSDVIEMLEAGAGGCRCLRGRFSAMKGTSMWRNLTISLLS

SEQ ID NO: 69224 - protein, 960 aa, Arabidopsis thaliana
MTSMIVKTTPELFKGNGVFRTDHLGENRMVSRSNRLGDGSNRFPRTGTIHCQRLSIAKTGLHRETKARAILSPVSDPAASIAQKLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQVWHLSQCVNLISTRIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMIVCIQMFNVVFGLVFKFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 69225 - protein, 481 aa, Haemophilus somnus 2336
MNIQHLLKTQAYINGEFISAKNHRTFPVINPANQQVICEITCCGKEETELAIKSAKQAQVHWKKYTAKERSKILKKWFELIMQHQESLAYLLSLEQGKPLSESRAEIAYGASFVEWFSEEAKRAYGEIIPQVREENRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 69226 - protein, 999 aa, Malus x domestica
MLLFLPLLLLLLLPPLPTTLSLNQEGLYLRHFKLSLDDPDSALSSWNYADSTPCNWLGVTCDDASSSSPVVRSLDLPSANLAGPFPTVLCRLPNLTHLSLYNNSINSTLPPSLSTCQTLEDLDLAQNLLTGALPATLPDLPNLKYLDLSGNNFSGAIPDSFGRFQKLEVLSLVYNLIENTIPPFLGNISTLKMLNLSYNPFHPGRIPAELGNLTNLEVLRLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIARATNLSLLILAKNKFSGPIPEEIGWVENLMEFSGGDNKFSGPLPESIVRLGQLGTLDLHSNEVSGELPVGIQSWTNLNELNLASNQLSGKIPDGIGNLSVLNYLDLSGNRFSGKIPFGLQNMKLNVFNLSYNQLSGELPPLFAKEIYRNSFLGNPGLCGDLDGLCDSRAEVKSQGYIWLLRCMFILSGLVFVVGVVWFYLKYKNFKKVNRTIDKSKWTLMSFHKLGFSEYEILDCLDEDNVIGSGASGKVYKVVLNSGEVVAVKKLWRRKVKECEVEDVEKGWVQDDGFEAEVDTLGKIRHKNIVKLWCCCTARDCKLLVYEYMQNGSLGDLLHSSKGGLLDWPTRFKIALDAAEGLSYLHHDCVPAIVHRDVKSNNILLDGDFGARVADFGVAKEVDATGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDTSDHGSVA

SEQ ID NO: 69227 - protein, 389 aa, Burkholderia xenovorans LB400
MRALRWHGKHDIRCDTVPDPIIEEGRDAIIKVSTCAICGSDLHLFDGFMPTMESGDIMGHEFMGEVVEVGKDNKALSVGDRVVIPFTIFCGECDQCKRGNFSVCERSNRNKEKADKVFGHATAGLFGYSHLTGGYAGGQAEYVRVPMADTTHVKIPDGLTDEQVLFLGDIFPTGWQAAVNCDIQPEDTVAIWGAGPVGQMAIRSAVLLGARQVVVIDRVPERLVMARAGGAITINFDEESVLDRLKELTNGKGPEKCIDAVGMESHATRSFDAMYDRVKQAVMLETDRPHVLREMIYVCRPAGILSVPGVYGGLIDKIPFGASMNKGLTWKMGQTHVNRWTDDLLHRIQEGQIDPSFVITHTVSLEQGPDMYKTFRDKEDGCIKVVMKP

SEQ ID NO: 69228 - protein, 80 aa, Zea mays
QEFGTSDPFEVLDQRGVGELVKFATERGRKARPNLKVGICGEHGGEPSSVAFFAKAGLDYVSCSPFRVPIARLAAAQVLV

SEQ ID NO: 69229 - protein, 343 aa, Vitis vinifera
  misc_feature (80)..(113): Xaa can be any naturally occurring amino acid
MGSANGLVSVQGKQPLFSFGVISDVQYADIPNGQSFMGVPRYYRHSIHVLQRAVQKWNNLQKLKFVVNFGDIVDGFCPKXXXXXXXXXXXXXXXXXXXXXXXXXXXXXXXXXXDEFKNFDGPSYHMIGNHCLYNLPRNMLLPLLNIPSFEDRAYYDFSPTPTYRFVVLDGYDISAIGWPSDHPKTLEALKFLREKNPNLDKNSPVGLVGLERRFLMFNGAVGKEQMEWLDCVLQDATKLKQKVVVCCHLPLDPGTLSPEALLWNYDEVMDVIHKYNCVKVCLSGHDHKGGHSIDSHGIHHRVLEAALECPPGSDAFGYIDVYDDRLTLSGTDRMESTDMIFNP

SEQ ID NO: 69230 - protein, 201 aa, Vitis vinifera
MATRAFLLTSLLLSCLLQICSGAYFSSLQRTLIVTASPKAGEVLKSGEDKITVTWGLNQSYPAGTDSAYKTVKVKLCYAPISQVDRAWRKTVDHLTKDKTCQHKIVSQPYKASNNSVEWTIEKDVPTATYFIRAYAYDAEDQEVAYGQTTDAHKTTNLFGIEAITGRHASLDIAAVCFSAFSVVSLCGFFWVEKRKSRVAK

SEQ ID NO: 69231 - protein, 397 aa, Streptococcus agalactiae 2603V/R
MTYLSERVLNMEESVTLAAGAKARELRVQGRDILSLTLGEPDFATPKNIQQAAIEAITDGRASFYTPSSGLPELKSAINAYFERFYGYSLKPNQVVVGTGAKFILYTFFMTVLNPGDEVIIPTPYWVSYADQIKMAEGKPVFVTAKEVNHFKVTVEQLEAVRTDKTKVILLNSPSNPTGMIYKAEELEAIGNWAVEHDILILADDIYGRLVYNGNIFTPISSLSESIRNQTIVINGVSKTYAMTGWRVGFAVGNHDIIAAMSKVVSQTTSNLTAVSQYATIEALNGSQESFEKMRLAFEERLNIIYPLLCQVPGFEVVKPQGAFYLFPNVTKAMEMKGYTDVTAFTDAILEEVGLALVTGAGFGAPENVRLSYATDLETLKEAVRRLHVFMGSNEIN

SEQ ID NO: 69232 - protein, 327 aa, Streptococcus agalactiae 2603V/R
MNKEKIIIDCDPGIDDTLALMYAIQHPKLEVVAITITAGNSPVELGLKNTFVTLELLNRHDIPVYVGDNLPLQREFVSAQDTHGMDGLGENNFTLAQPIIFQEESADCFLANYFEHKNDTSIIALGPLTNIARALQTNPKLGKHCKRFISMGGSFKSHGNCSPVAEYNYWCDPHAAQYVFENLDKKIEMVGLDITRHIVLTPNHLSYMERINPDVSSFIQKITKFYFDFHWQYEHIIGCVINDPLAIAYFVNENIATGFDSYTDVACHGIAMGQTIVDQYHFYKKDANSKILTSVNTNLFWNDFMTVLLHAQNSVIIEDLEMLGLNK

SEQ ID NO: 69233 - protein, 261 aa, Oryza sativa Japonica Group
MAAGSGSGSNPKDYQDPPPAPLVDTGELGKWSLYRAAIAEFTATLLLVCISVSTVIGEKRQSGEGGAGVLGIAWAFGGLIFVLVYCTAGISGGHMNPAVTFAMVLARRVSLPRAALYTMAQCVGAVCGAGLARAMHGWAGRVVAEMVGTFVLVYTVFSATDPKRKARDSHVPVLAPFPIGLAVLVVHLATIPITGTGINPARSLGPALVLGLGTTKAWSHLWIFWVGPFAGAAAAMIYHHYILRGAAAKAFASSSYRSPHF

SEQ ID NO: 69234 - protein, 516 aa, Moorella thermoacetica ATCC 39073
MIGENKQLAEIVLVLDFGGQYNQLIARRVREAGVYSEMIPYNTPLEKILARRPRGIIFSGGPASVYSLGAPRIDRALYESGIPILGICYGMQLMAHDLGGRVEGASGREYGKTQLEITAADPLFAGLPESIQCWMSHGDYISAPPPGFQVTARSAYTPVAAMSDPARKLYGVQFHPEVKHTPMGQEILRRFLFQVCGCRGDWSVSSFIEDQVAAIRRQVGNGRVLCALSGGVDSSVAAALVHRAVGDRLTCVFVNHGLLRQGEAEQVQRAFGQAMGMNIVYVDASRRFLEKLTGVTDPEEKRKIIGHEFIRVFEEEARKLGRVDFLVQGTLYPDVIESGTETAAVIKSHHNVGGLPEDMELELIEPLRLLFKDEVRRVGEELGLPEEIVWRQPFPGPGLAIRILGEVTPEKLEILRQADAIVTEEIRRAGLYREIWQSFAVLPSMKSVGVMGDERTYAYPIVLRAVTSDDAMTADWARLPYDLLERISSRIVNEVRHINRVVYDITSKPPATIEWE

SEQ ID NO: 69235 - protein, 446 aa, Blastopirellula marina DSM 3645
MSNDAVAALRAALEVSPHNIPLRLHLAQTLAELGRTAEVEAELKEALTYEPQNAEIKLALARLFVRTAKSSQALVILEEIAQRGEASAEARVVLARLLLAEGEVRSAVAHYKEAIETDPDVEDAELSAQLGVGAAWQDSDVSEGRLREMADAAPEPVDVDAPERPKIKFADVGGMSAVKEDIRMKAIYPLEQAEMFAAYGKKVGGGILMYGPPGCGKTYLARATAGEINASFLSIGINDVLDMWIGQSERNLHAIFEQARGNAPCVLFFDEVDALGARRSDMVSGAARQIINQFLAELDGVDSNNEGVVILAATNAPWHLDPAFRRPGRFDRLIFVPPPDAPARADVLQVQLRDKPQKGIDAAKIAKSTDGFSGADLKAVVDLAVEAKLTEAMRTGVPLPLTTDDLQAAAKRVNPSTKEWFATAKNYAIFSNQGGVYDDILKYMKL

SEQ ID NO: 69236 - protein, 551 aa, Prochlorococcus marinus subsp. pastoris str. CCMP1986
MEIINGFNLKNIRGDILGGITAAVVALPLALAFGNAALGPGGAIYGLYGAVVVGFLAALFGGTPAQVSGPTGPMSVTVAGVVAGLAAVGVPRDLSAGQILPLVMAAVVIGGLLQILFGILKLGKYITLVPYSVVSGFMSGIGVIIIALQIGPLLGISTRGGVVESLSTVFSNFQPNGAAIGVAIMTLSIVFLTPRKISQWVPSPLLALLIVTPLSILIFGDGALDRIGEIPRGVPSLSFPSFNQYFPIIFKAGLVLAVLGAIDSLLTSLVADNISQTRHNSDRELIGQGIGNAIAGLFSGLPGAGATMRTVINVKSGGSTPISGMVHSVVLLIVLVGAGPLAEQIPTALLAGILIKVGLDIIDWGFLRRAHKLSLKTAVVMYGVLLMTVFWDLIWAVLVGVFIANMLTIDSITETQLEGMDQDNPLSEDNEQSKNLLPSDEKALLDRCSGEVMLFRLKGPLSFGAAKGITERMMLVRNYKILILDITDVPRVGVTATLAIEDMMQEAKNNSRKAFVAGANEKVKERLSKFGVDGIIETRKEALEAALNELA

SEQ ID NO: 69237 - protein, 388 aa, Nostoc punctiforme PCC 73102
MKLAARVSQVTPSLTLAIAAKAKALKAEGIDVCSFSAGEPDFDTPAHIKAAAVKALDEGKTKYGAAAGEPKLREAIAHKLKNDNGLDYKSENVIVTNGGKHSLYNLIVALIDLGDEVIIPAPYWLSYPEMVTLVGGVAVIVPTDATTGYKITPEQLRKAITPKTKLFILNSPSNPTGMVYTPDEIKALAQVVVDADIFVVSDEIYEKILYDGAEHISIGSLGKEIFDRTLISNGFAKAYSMTGWRIGYLAGPVEIIKAASTIQGHSTSNVCTFAQYGAIAALQSSQDCVEEMRQAFAKRRQVMLDRLNAIPGLSTAKPDGAFYLFPDISKTGLKSLEFCDALLEKHQVAVIPGIAFGADDNIRLSYATDMATIEKGMDRLEKFVKSRI

SEQ ID NO: 69238 - protein, 779 aa, Candida glabrata CBS 138
MSAPPPPPPPPMAPAASVPKSAMQGRDALLGDIRKGAKLKKAVTNDRSAPILSSGGVSSAPSSAPSGSSAPPVPVSIPGGAPQLGDILAGGIPKLRSVSGSNAPPGGAPPIPGAPPPQQAPKMPSGRPNMPSGRPTNRSHQKKSSISSIASSAPAPPSAPPPPSAPAPPSAPSMPSMRPPKHESKTQNQNSIPSAPAPPVPGAPPAPPTSAPSIPSAPAPPAPPAPPAPPMAAAPPAPPMAAAPPAPPAPPAPPMNSAPSAPPAPPAPPAPPMSSAPSIPALNSQSDNSPASNPPPSIPGGLPFLAEINARRSEKGVVDDKTVSHASNNASTSTNRAPSPPSAPPAPPVASAPSIPSAPAPPAPPISSAPSIPSAPAPPAPPAPPAPPAPPVAAAPPAPPAPPAPPMVSAPPAPPAPPAPPAPSMTSAPPAPPAPPAPALQAAKSMKSSSPPPVSSGPLPFLAEIQKKRDDRFVVGGDSNYSTKVEQTDIQGAAGSAPTTSAPPPPPAGGAGMSFMSEIESKLKHSHHEPAPSSAAPPLPPSAPQIPTSTAPPVPSVKASGDSHGAAPSNSFMSDIAASLAARNSHGADAPDVPSVPPPPSAPPAPSAPAPPSAPAPPSTSAPAAPPAPPPPPSAPMTPAAPPPPSAPSMPAAPPPPSAPAPLTHSAPPPPPASTSSQQTQSTDSAGNIKHRLFSSGTAERKVNQYTNAPEIDVGLVTINGSSSTTGTKIQSGKVTVDDSRFKWTNANQLPKPRPFQGKTKLYPSGKGTSVPLDISSYA

SEQ ID NO: 69239 - protein, 643 aa, Oryza sativa
MRGFVGAAVLLVCNLATASAWKDKDFFSACPAKQCGKVEIRYPFRFEPSNTSSSCGLPCMKLTCSDRQETILDIKNYLGRPYKVTAIDYKRATLTIVPLADDSSLPPTPGCPLPNLISEGALDHRCEPYAMCCSSEFAAPATIPDAADYIAGPISCLSNKTHFFYTLSAYAPMSFLPLDCEAVSGNLIALPRGNTYSPLVDSSTLKDVAERIFSFNETPISWISVMSSPDQIDLATDCRDCETQGRRCAFSSQRNQTFCMPHHHGSRIRIIAGKIQCANFLLSACSATSSAAALVVLLLLGATVLYLSLKTRYNEEIHLKVEMFLKTYGTSKPTRYSFSEIKKIARRFKIKLGQGGFGSVYRGELPNGVPVAVKMLENSKGEGEEFINEVSTIGRIHHANIVRLLGFCSEGTRRALIYEFMPNESLEKYIFSDGYNILQELLVPNKMLDIALGIARGMEYLHQGCNQRILHFDIKPHNILLDYNFSPKISDFGLAKLCARDQSIVTLTAARGTMGYIAPELYSRNFGEISYKSDVYSFGMLVLEMVSGRRNSDPSVESQNVVYFPEWIYEQVNSGQDLALGREMTQEEKETVRQLAIVALWCIQWNPKNRPSMTKVVNMLTGRLQNLQVPPKPFLSADSYPVL

SEQ ID NO: 69240 - protein, 706 aa, Gibberella zeae PH-1
MPPDQSEDVAARQPLLSERDENVSSDASRESRTRGTFTRNLGAAEAFGIVVSIVIGSGVFTSPGSIDTNVPSPGIALAIWLVGGILAWSGATTFAELGTAIPGEGGVQPYLQHIYGDIWGFLAGWTWIVAVMPATLAILSIVFVESAYSAAGVINEDDRIEHKLLSILVLVVMSVANSISTKASTRLNGFFVVLKFLSILVVVVVALAVVGVHVAHPNKEVGGGDWYKKSWFKYRDTYNPNGPDTDWTLWAYSGWDKAIYVSAELSQPARQLPLAINTSIPTAIICFLAANAGYYILLPWNIVSTTDSVAVTAITRLLGQGFGIVTAILICLVVAGSLLGNSFVASRMCVAAARKDWIPSLFTIVGRVGLKPAEEETAAADEQSKDTGDAPINAVILSVILASFYILFGSFRALLTLNGLGEYSFFFLTVLGAIILRYREPDLERPYKTFSINPIVFVIVSGFVVVRGAIFAPVQAVVIMAIWVLGLVFYKARQYWASRSQKRLVGSYKSLVESVISPLLLPSTQLAKHPTQAVDSASLVIYTSIRLPWTTVRGKTVAQFVVLSYGIFLDIRRKTGRPESRGRRWLFRRAAHMWKYDPFDIPDLTSRLLENVKYRLVSPSAESSRFCNNLSSLPQELLGGITDYLQCTTEPLGLQPTYLLPQHLWKQLIVKIPFIWDIDVEQLEQPSYCSIDSDSIRECDWELLFR

SEQ ID NO: 69241 - protein, 254 aa, Oryza sativa Indica Group
MSGVVALMAERRDMSGTARPGCWLRRSGRSSAAAARPGAHLPPAASFFAGQPRQELPAHDARRHSSGTKEDARPVAGEHVRRRRDHGLLTERVGERRPEESPRWLLVHGRKQEAIEALRQIASLNDGEGITMSSFTMLDMCAVEVGDGVAGGEGMLAMLRSICEWWWALQRLATITTASFSIGVVYYGMPLSVGSLSFDLYSVAYNAAAELPSSFLSWLLMGRFNQRSSVVELTAVSGLCSLATNFVERTYLLR

SEQ ID NO: 69242 - protein, 271 aa, Aquifex aeolicus VF5
MEDFKSGDLILGYYKVLEKLGEGNFGKVYKVEALKGRYKGKVFALKVASNPYSVHYLWKEAQTLILFHHQNIVSLQSYLYKKDKKELYLIYEYMDFGTLKDYVEKKGKLSPEEALKVLRHVVNALEYLHSRGYIHSDLKPENVFGKRVLGGVLWKLGDFSLVRIRGDVSIIDVKGTIGFIAPEIFRGEIHRSSDIYSLGCLTLYMLTGKVPFEGKDFKERKEKNKRGEVEIPEEIPGKLKDLLERMLEVDYKRRFRTARELKEYMVKEGLI

SEQ ID NO: 69243 - protein, 566 aa, Synechococcus sp. RS9917
MPTPDESSAAVISDFSQFAERVDYSLLEALRHDPEATNDGNDHRPRQVRSGHYVPVTPTPLPEPEYVAHSPTLFAELGLSDALAHDARFRRLFSGDASVATGPMRPWGWATGYALSIYGTEYIQQCPFGTGNGYGDGRALSIVEGVYAGRRWEMQLKGGGPTPYCRGADGRAVLRSSVREFLAQEFMHALGVPSSRSLTLYMSRAETVRRPWYSPQSRSFEPDVMVDNPAAISTRVAPSFLRVGQLELFARRARSQAHPEAMAELQLIVDHLIERNYRPEIDPALPFSEQLLELARLFRARLTRLVADWMRVGYCQGNFNSDNCAAGGYTLDYGPFGFCELFDPRFQPWTGGGEHFSFFNQPAAAEVNYGMFWRSLRPLLEGNREALAQLDAIHEGFAAVMRQELEAMWARKLGLKAYDEELVTKLLQLLMASRADYSRSFRLLSAIPEQASDLHPGFYGPSSSTLDQQWESWLQQWRAQLAANGTLEETSAAMRRVNPAITWREWLIAPAYQHAEQGDHSLIQELQEVFSAPYADLSEDRAARYDRLRPRDLFNTGGLSHYSCSS

SEQ ID NO: 69244 - protein, 248 aa, Raphanus sativus
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITLITGVFYWVAQLLGSTAACFLLKYVTGGLAVPTHSVAAGVGAIEGVVMEIIITFSLVYTVYPTAADPKKGSLGTIAPLAIGLIVGANILAAGPFSGGSMNPARSFGPAVAAGDFSGHWVYWVGPLIGGGLAGVTYGNVFMTSEHVPLASEF

SEQ ID NO: 69245 - protein, 228 aa, Arabidopsis thaliana
MNALAATNRNFRHASRILGLDSKIERSLMIPFREIKVECTIPKDDGTLVSYIGFRVQHDNARGPMKGGIRYHPEVDPDEVNALAQLMTWKTAVADIPYGGAKGGIGCSPRDLSLSELERLTRVFTQKIHDLIGIHTDVPAPDMGTNAQTMAWILDEYSKFHGHSPAVVTGKPIDLGGSLGREAATGRGVVFATEALLAEYGKSIQGLTFVIQVKPLSANLRSQALLCI

SEQ ID NO: 69246 - protein, 224 aa, Listeria monocytogenes EGD-e
MINQKKIAGEKACEWIKDGMVVGLGTGSTVYYTIEKLGEMVNNGLHITGVATSEETNKQAQNLGIPLKSLNDVTEIDITIDGADEIDTDFQGIKGGGGALLREKMVASASLKNIWVVSEEKLVRNLGKFPLPLEVIPFGWKQVERKLEKEHIQTNLRKQSSGEVYVTNNGNYILDIVNQTFTDAEMWQEKLAQIPGIVEHGLFLHYVDIIICAKANGEIELIKK

SEQ ID NO: 69247 - protein, 336 aa, Brassica oleracea var. botrytis
MSIPMELMSIRNPNSTFLHRPHSHPPATLRSLRFQHLPNQRHHLTSPSLVSCTGLRLRFTSDTKLNRSFVAFAASHEDSEPSDVEVEKEKSVVDGDDNDSTSQEAWKQTLASVKEQVSKIQSVSSEAYNVNSQKAMTILKDTSEQLRIQAEKAKEELGTKAKEVGEEGREYILKAAEESPSDVKEIVEAFSSTEDLRDVSRTQDFHVGIPYGLLLFVGGFLSFMISGSIPAIRFGVILGGALFALSMASLKAQRLGESSAKFLKGQMAIVAIIFLRELKLVLFQRSTFMGFLTTLTSGGVLAFYGYKLVSNKEKGPNKEQGGEEDETSEGFVSREG

SEQ ID NO: 69248 - protein, 248 aa, Myxococcus xanthus DK 1622
MRTQFLTTVLLCLTLTACKDSDKKESMGGGTPPSATTPAKPTAPSAAEVPAAAPPAEAASGEWTKKVQAGQDVYATLETNQGAIVVRLFSKDAPKTVANFVGLATGEKAWTDPKTGQRVEGKPLYDGVIFHRVIPGFMIQGGDPTGTGRGDPGYRFEDEFQSGRTFDKKGLLAMANAGPGTNGSQFFITTSTPDYLNNRHTIFGEVVSGYDVVEKISNVQRDPRDKPLEPVVIQKIAMSDQAPAGSGN

SEQ ID NO: 69249 - protein, 347 aa, Chlamydomonas reinhardtii
MGKRYLVTGAAGFIGYHSAAKLRSRGDVVVGLDNFNDYYPVSLKRARAQALVDMGVPVVELDLNDQEGLGELFRLCSFTHVLHLAAQAGVRYAARNPFAYIQSNIAASVSLMETMRLQKPMPLLVYASSSSVYGLSKRFPFTEDDRADRPASLYAATKRSLELLAHSYFNIYRMSVTGLRFFTVYGPWGRPDMSVMAFSRNIVDGKPIRVFQGPNGTELARDFTFVDDIVAGVCGALDTAAPSNDPHAAPHNRIYNLGNTQVHTVTEMVRTLEELLGIKAIIRYQPLGATGDVLRTNANITTAHNELGYTPQTNLRAGLQAFVEWYFQYYGADGKRRPADEVGYIPD

SEQ ID NO: 69250 - protein, 211 aa, Phaeosphaeria nodorum
MSNPRIEELPDEPEKKNVQIEEDESSDESEGEEGEANIPAGASVAVHSRNEKKARKAIAKLGLKHIDGITRVTLRRPKNILFVINQPDVYKSPSSNTWIIFGEAKIEDLNSQAQASAAQQLAQAEAASHDHSGHDHDHDHKGKGKAVEDKKDDEEDEEEEEEDDEEVDDSGLEAKDIELVMQQASVSRKKAVKALKENDNDIVNSIMALSI

SEQ ID NO: 69251 - protein, 466 aa, Mycobacterium sp. JLS
MIDSRTAPTASEVLARLHAEDIATVILGGTDTHGVMRGKRVPISQLPRMLEHGMPMCDVFWVMHVDESDLVARPDGYRGYFPTERQGYPDILAVPDLTTLRIVPWHNDTALLLCDWELPADHRPVPIAPRSVLRRVVERADAMGYRPLSALELEFYLLREKAGTTHRKRADELVPLQEAPSTYGVVMGSLQEDIGALIRRHMLDYGLPVEACNPETGPGQFEITLRYGNSLKSADDAFLFKSAVKEVAAQNDLLATFMAKPVTDWAGNSCHVHLSLRDIAGGGVFFDQDAPDQLSTALRHFAGGILHTMREFTALMAPTPNSYRRFVPYSWAGTTATWGVDNRSVGLRVIREGDHGTRVEHRQPGGDANPYLATAAALAGGLHGLLNEIEPRELSTTDIYSQPSEDLPVLPATLAEAVDLLADSAAAREWFGDDFVDHYVLMKRAEIAAQSVAVTDWEVARYLEAM

SEQ ID NO: 69252 - protein, 315 aa, Clostridium acetobutylicum ATCC 824
MSEFITIGEPLALFAAEGESEIDKRISEVDHFKKFLAGAEVNVSVGVSRLGHSAQYITKLGEDPFGEFIRRRLNEENVGTDYISSTNKKFTGFQLKSKVSEGDPSIFYFRKNSAAANFSVEDLNKVNLDGVKHVHITGIFPALSESTKEATYKLLELAKERNITTTFDTNLRPQLWNSKEDMISTINDIAFKSDILLPGINEGLVLMGSDKPEEIADFYLNKGVKLVIIKLGSKGAYVKTKDEAYTVEGFKVKHVVDTVGAGDGFAVGVISAILEGISVKEAVRRGNAVGALAVMSEGDNDGYPTHEELEKFLGR

SEQ ID NO: 69253 - protein, 345 aa, Glycine max
MGIYLSTPKTEKFSEDGENDCLRYGLSSMQGWRATMEDAHAAYTDLDESTSFFGVYDGHGGKVVAKFCAKFLHQQLFKSETYLTGDIGASLQKAFLRMDEMMRGQRGWRELSILGDKINKFTGMIEGLIWSPRSSDGNCHVDDWAFEEGPHSDFAGPTSGGTACVAVIRNNQLVVANAGDSRCVISRKGQAYNLSRDHKPDLEIEKERILKAGGFIHVGRVNGSLNLARAIGDMEFKQNKFLSAEKQIVTANPDINTVELCDEDEFVVLACDGIWDCMSSQQLVDFVHEQLHSETKLSAVCERVLDRCLAPSTASGEGCDNMTMIVVQFKRPAQSSVPAEESSSN

SEQ ID NO: 69254 - protein, 770 aa, Synechococcus elongatus PCC 6301
MQEAKVAAILGAGAWGTTLAQLLRSNGLEVRQWSRRSETSLAATLAEADLWIMAVSMAGLASVADQVAALQLGDRAIWVSATKGLADLGWRTPSQVLSDRFPLQPITVLSGPNLSKEISQGLPAATVIASRDRHAAAVVQQAFASDRFRVYTNRDPLGTELGGALKNVIAIAVGVCDGLCLGANARSALVTRALAEILRVGAYFGARTETFFGLSGLGDLLATCTSPLSRNYQVGFRLAQGESLAAALTAIAATAEGVSTARVLAQLASREGLELPIAACVAELLDNRISPTTAIERLMARDLKAELVRENQNVASNTLPLAIAEPLAMKKTYVLDTNVLLHDPMALFRFEDNDLVIPITVIEEIDRFKKDLNERGRNARQISRLLDGFRSKGHLIEGITLDHGGKLRVVMLEKTFLEQLPSGLIANANDNAILAVALALQQQNGQPTILVTKDTNLRIKADATGLCAEDYESDKIDFSELYSGTAEVYLAPDQLQVFRREGGLDLSGEFFPNQALTLVDETNLSHTLLGRYRASDRRVVPLIQPPKMGISRIHARNREQQFALDLLLDDNIQLVTLVGKAGTGKTLLAVAAGLHKVADERHFSRLLVSRPIFPMGRDLGFLPGDLQEKLAPWMQPIIDNLDFILGGANNNGDRPSNKQQNYQDLMGMNLLQIEPLTYIRGRSIPRQFMIVDEAQNLTPHEIKTILTRAGEGTKIVLTGDAYQIDNPYVDASSNGLTYVVEKFKNEAIAGHITLERGERSPLAELSANLL

SEQ ID NO: 69255 - protein, 315 aa, Prochlorococcus marinus subsp. pastoris str. CCMP1986
MQNKYLINFSKKFWFWFWTKLMNGFAPSDLQGNYRRPRGILINKNYEFKVKNENSYLLVGNSCPWCHRTLLIYKLKNLSKKVKVIFLEADINSGQWIFKKKFEECETLHQFYKKAQKHNLFRATLPLLFNFQNDQINILSNESSEIVKFLNSIKVDSSQKTLQIRKCDQDLLEIIHSDINNGVYKCGFARNQISYEKASKNLFEALTIIEKKFDKNVGNWICGEDLTYADIYLFPTIIRWELIYRQLFKCTEKEISDFRNIIKWRLRFFKLTKVSETCFDSEWKKDYYKALFPLNPNQIIPVLPSLKEIMQSLPK

SEQ ID NO: 69256 - protein, 232 aa, Glycine max
  misc_feature (173)..(173): Xaa can be any naturally occurring amino acid
MARIKPQALLQQSKRKKGPSRISAATVIFYFLILALLGFFLFASYRHWSSRSRLQSEDHLSVSEGENTFVDSKKSELPGYAVLNTSKGSIIIELYKESAPEVVDEFIDLCQKGHFKGMLFHKVIKHYVIQAGDNQGSGATEDWNLRGKQHTITSMKHEAFMLGTSKGKHNNKXFDLFITTAPIPDLNEKIIVFGQVIKGEDVVQEIEEVDTDEHYKPKVSIGILDVTLKQKV

SEQ ID NO: 69257 - protein, 459 aa, Staphylococcus aureus
MNIIEQKFYDSKAFFNTQQTKDISFRKEQLKKLSKAIKSYESDILEALYTDLGKNKVEAYATEIGITLKSIKIARKELKNWTKTKNVDTPLYLFPTKSYFKKEPYGTVLVIAPFNYPFQLVFEPLIGAIAAGNTAIIKPSELTPNVARVIKRLINETFDANYIEVIEGGIEETQTLIHLPFDYVFFTGSENVGKIVYQAASENLVPVTLEMGGKSPVIVDETANIKVASERICFGKFTNAGQTCVAPDYILVHESVKDDLITALSKTLREFYGQNIQQSPDYGRIVNLKHYHRLTSLLNSAQMNIVFGGHSDEDERYIEPTLLDHVTSDSAIMQEEIFGPILPILTYQSLDEAIAFIHQRPKPLSLYLFSEDENATQRVINELSFGGGAINDTLMHLANPKLPFGGVGASGMGRYHGKYSFDTFTHEKSYICKSTRLESGVHLPPYKGKFKYIKAFFKN

SEQ ID NO: 69258 - protein, 445 aa, Vibrio vulnificus CMCP6
MSSNTKKIGLIACTGVVAGNMMGSGIALLPSTLASVGSISIFSWAICIVGALSLAFVFARLATKNPQEGGPIAYAGEVSPVFGFQTGVLYYHANWIGNLAIAITGVSYLSVFFPVLNDPIPAGLATIASVWVFTLVNLLGGSWVSRLCTVGLVLILVPVLGTALFGWTHFDSAIYSQNWNVSAGSDGHAIITAVLICLWSFVGVESAAVSSGMVENPKRTVPLATMLGTAIAGVIYVLSTQMISGMFPASEVAASGAPFALATTELFGSWTAPFVSAFTALACFTSLGSWMMLVSEAGKRAANDGNFPKVFGETDKNGVPKKGLVIASSMMTMLMLVLMFFSSETAHASDMFNQLTTDAVLLTMLPYFYSSINLIRFEGMTTRNTFVMLFSGIASLFCMVALAGAEGSTLTATFIMSLIILMFYSKKTGLAQYMAAHPEEASAQH

SEQ ID NO: 69259 - protein, 360 aa, Oryza sativa Japonica Group
MVGGFDKLKVEFIDQDESVQVVADTIRSSGEIPERYARPEMEADPVIIDTDGYNLPVIDMSRLINPEFSEEEIAKLGSACEDWGFFQLVNHGVDGELLQRIKDDITEFFRLPLQEKMSVAIPPNGLQGFGHHFVFSKEQKLDWVDLLFLTTRPVEDRTTEFWPTKPPTFRDSLDKYSLEIANVSAKLFKFMAINLGVDEEALLAAFKPEQPQSVRINHYPPCSQANKVLGLSPHTDGVGMTLLLQVNDVQGLQIRKDGRWFAVKNLPGALVVNVGDVLEILTNGKYKSIEHRAVINPDKERITLAAFQSVPLSSTVGPLQELLMKGEARYKTVDGAEFTKGYFAAKLEGRRYLESLKLGV

SEQ ID NO: 69260 - protein, 455 aa, Geobacter sulfurreducens PCA
MKKRILVVDDEENMRHMLCAMLRKQGYEAVEAADGEAALAQASAAAYDFILCDIRMPIMDGVGFLRTFQKAELPGTVIMMSAYGTVDAAIACMKEGAYDYVSKPFKNDEILLVLRKAEERERLKNENRRLREVVGREYAFGSIVSRNPRMREIFNLIRKVCDVRTTVLILGESGTGKELVARAIHHNGSRSDGPFVAVNCGAIPESLLESELFGHVRGAFTDASSDRAGLFEEANGGTLFLDEIGEMPPALQVKLLRVLQEGEVRRVGGSKAQRVDVRIISATSRDLARDAAEGRFREDLFFRLNVFAITLPPLRERLEDIPLLVNHFLHKYGESFGRSGMVVSPEAMKLLAAYGWPGNVRELENCIERAFILSDGEILDAGSLPDVVRGDSAASAAGFHLPEDTLSIKRAEECLEREFIRRALAKTGGNRTHAARLLEISHRALLYKLKEFGID

SEQ ID NO: 69261 - protein, 300 aa, Prochlorococcus marinus str. MIT 9303
MSWKVADIPDQKGRVALVTGANSGLGLETAKALLNKGARVIMACRSRPKGEAVRQIILESNDSTKLDLIELDLADLASVRRAAEQVERQYSRVDLLINNAGVMATPQTLSKQGLELQFAVNHLGHMALTLKLLPLLAKQHGARVVTVTSGAQYMGRIAWEDLQGIKHYDRWAAYSQSKLANVMFALELDKRVRNAASGIASLLAHPGLARTNLQPKSVAANKSWQEGLAYRLMDPMFQSAAMGSLPQLHAATAPTAQGGEQYGPRFNFRGYPKLCRIAPLALREEDRQRLWSISEKLLEI

SEQ ID NO: 69262 - protein, 533 aa, Bordetella bronchiseptica RB50
MTAPLPLDWTFPYVSQRMPALGENMVCTEQPLANQAAMRMLAAGGNAVDAAIAAAITMTVVGPCMNGIGGDLFAIIWDGRQLHGLNASGRAPQAWTREYFSRHDAMPARGWDAVTVPGAVSGWVALSRKFGKLDFARLFEPALHYARHGFLVTPITARQWADQAEPIMQGPGFRDAFAPNGRTPQPGERFICPGQADTLQDIADTHGESFYRGALAARIAAFARETGGALTKADLAAHQADWVDPIGAQYGELTLHEIGPSGQGIGALMALGMLDGLSGKLGQPDSTDFYHYQIEAMKLAFADINRYVADPASMREVSAEMLLDRAYLATRAGAIDPAEARYPGPGKPHNGGTTYLTAADADGMMVSLIQSNFKGFGSGVVVPGTGIALHNRGWGFNLIEGHPNEVGPGKRPFHTIIPGFLMRDGEPLMSFGVMGGSLQAQGHVQVTVRTAAGQNPQAIVDAPRWRILEDNRTVMVEWNFPDAAVAGLRERGHAVTVAPRFSDEFGGSQAIMRIEGGYLGASDHRKDGQASAL

SEQ ID NO: 69263 - protein, 491 aa, Gibberella zeae PH-1
MASSTPKPTNSLLYKNFQKHPAALIESTEGIFLNTSDGRRILDATSGAAVACLGYNNKDVQQAVVEQLVNVPYCHPGFYKTKAAEDLADFLVESTNGLMSKAVLCGSGSEAVEVALKLAKTHFSHLAIPQPERSHFIARVGAWHGATLGALTLGDFKVRKDPFVQLISQNSSQVSACSEYRGRKEGEDDEAYVQRLAQELDDEFQRIGPEKVCAFVAETVGGSASGCAMPIKGYFPAMKAVCEKYNALLILDEVMCGMGRTGTLHAWEQEDVVPDILVVGKGLGAGYAPVSAVMLNAKLVESFQKSGKGFAHGQTYMAHPQAAAAGLKVQQIIRDENLLAHVQTMGEYLGSRLKERFLPMPFVGDIRGRGLFWAIEFVTDKKTKMPFPYSLGLNSTLHSRGMSAGYEIALFNANGGYDGYSGDHFLICPPFIVTKADVDDIVERTARVVEDTFAELVNSAVWEKVTLQMGIDNKCEVNAVNAPPAVGVAAQ

SEQ ID NO: 69264 - protein, 252 aa, Synechococcus sp. RS9917
MGLIVAVVLGLLILLAQAVFIVPAGNVAVVTTLGKVTGVPRTPGPNLKAPLVQTVSLFDVRTQVRPEQFSTLTKDLQVIEATATVKYAMKPGEAGRIFQTIATDNQQIYPRVIQPSLLKALKSVFSQYELVTIATEWNTISEIVQSKVTEELAKFDYVTVQGLDLTGLKIAEEYRSAIEQKQIAEQQLLRAQTEVKIAEQEAKRYATLNSSLDDQVLYKLFLDKWDGQTSVVPALPSSGAAGGQSVIVNGRR

SEQ ID NO: 69265 - protein, 453 aa, Aquifex aeolicus VF5
MKILILSGGKGTRLWPLSRENFPKQFIRLFSKHSLFQETVKRAKKLAKDEDIVVITGEKYEWIIRSELEEIDANEVRVVVEPEGRNTAPAIALGVKYLIHSETPPSETVLVLPSDHLIKDTEKFVEAVKKGEKYAKEGYIVLFGEKPTYPETGYGYIRLNGKLEEGVYEIEKFEEKPDYEKAKEYVSDGKHFWNCGIFLFTLDRIVKDYTQLMPEIPFHEKWEDFIKDFKNFEEISFDYAILERTKKLAVVKMDAGWSDVGSWKAVYDNLPKDEKRNVLIGDVKAMDTECSLLLSQGKNLIACIGLEDFVVVGTEDATLIVKRDYSQKVKEIVKELEEENDERAIEHVTSFTPFGSITKLDRGERYKIRKVVVKKDKEIPLRMHHHRTVHFVVLKGTAKVKVGDKEEFVHENESFFVPKSTPYKIINVGKIPLEMIEVQSGEYLGEDDVETLE

SEQ ID NO: 69266 - protein, 325 aa, Aspergillus oryzae
MSPSLVAPEPEHCPGPESEQAGQGDACAGCPNQQICASTPKGPDPDIPIIRERLSQVRHKILVLSGKGGVGKSTFSSLLAHAFSANPDSMVGLMDTDITGPSIPKLMGVESETIHVSNAGWSPVWVTDNLGAMSVQFMLPNRDDAVIWRGPKKNGLIKQFLKDVDWGELDYLIIDTPPGTSDEHLSVNSLLKDSGVDGAVVVTTPQEVSLLDVRKEIDFCRKAGIRVLGLVENMSGFVCKNCNTESQIFRATTGGGKRLAKKMGIPFLGAVPLDPRIGMACDYGESFVDGFPDSPAAKAIKQVVRAVGQLVGEDPDTVLPDDTAE

SEQ ID NO: 69267 - protein, 276 aa, Brassica napus
  misc_feature (232)..(232): Xaa can be any naturally occurring amino acid
MNNIIILFVTFLALSSSSRAADETETAFHYKKGALADPSKWSMTKKEWKICGTGKRQSPIDLSPGIARLVHNSTKLIQTYYKPVEATLKNRGYDIMVSWDDDAGKIVINNTDYQLVQSHWHAPSEHFLNGERLAMELHMVHKSEAGHLAVIGVLFREGEPNAFISRIMGKINTIANIQDGEATIGRLHPKDFGWDLTKFYEYRGSLTTPPCTEDVIWTIINKVGTVSREQIXVLVDARRGGYEENARPAQPLNKRVVYLNEQHVRITPSSQKQIHI

SEQ ID NO: 69268 - protein, 44 aa, Zea mays
  misc_feature (18)..(18): Xaa can be any naturally occurring amino acid
  misc_feature (34)..(34): Xaa can be any naturally occurring amino acid
SPTCALLHRAHGCARWAXGGIVVLAAVYGPKPGXRKAENPEKAS

SEQ ID NO: 69269 - protein, 533 aa, Mycobacterium sp. JLS
MSASLLAVLVVAVLLAAVARRADVSAPLALVVAGLAVGLIPGVPDIQLDPDLVLYVVLPPLLWSAGLESSYVALRRNVRSIGMLAVGLPLATTFAVGVVAYWAVPELTIAAALTLGAIVAPPDAVSATAVGRRLGLPRRLMTLLGGESLLNDATALTAYKVALGLAIGGSASWTGGLWTFALAAVGGVVVGGALGAVIVYVRSRLRDPLVESALGLVAPFGIYLLAEEVHGSGVLAVVVAALILGQHSTNASYATRLQDSAVWKAVQLLLESFAFLLIGLQLPKVIEELAGISAAVLVVSSLAVLATVIAVRIVWVYLFAYLPRLVSPALRYREPSPRPAQVFVVAWAGMRGVVSLAAAFAVPATTLSGAEFPGRPQLVFLTFVVVVGTLLLHGLTLPWLIRRLGVQGDEAHTDAVAAAAAQDRAARAAAERLDEVLEQQRTDGTVDDVHERAADVLRGWNTRRRNSAWEQLGRDEADIGESPAAAFRRLRLEMLAAERATLIAERDSGHIDDKVLRSVLHGLDLEEATLNRR

SEQ ID NO: 69270 - protein, 249 aa, Zea mays
MESAKAVAAFHRALGSAWARHGTALAGPAGTVLVLTDLPALSYTPSGSAKWVKHPLSLSSKPRSPILASDAVFAGKREEHLASEELVGAGGRGGRRRRARRRPLLLSGVDAGEEGVDLAELHREAVPERAGLAERAREAVPLKAEVVQRHKRGERRRERPRQAGVLEVEVVDVALLPQLGFAWARHGTTLVGPAGMVLVLTELAALSYTPSGSAKWMKHPLSLPSKPRSPILAPDAVFALCDVDTPWRS

SEQ ID NO: 69271 - protein, 512 aa, Salmonella typhimurium LT2
MTNNPPSTRIQPGEYGYPLKLKARYDNFIGGDWVAPADGEYYQNLTPVTGQPLCEVASSGKKDIDLALDAAHKAKDKWAHTSVQDRAAILFKIADRMEQNLELLATAETWDNGKPIRETSAADVPLAIDHFRYFASCIRAQEGGISEVDSETVAYHFHEPLGVVGQIIPWNFPLLMASWKMAPALAAGNCVVLKPARLTPLSVLLLMEIIGDLLPPGVVNVVNGAGGEIGEYLATSKRIAKVAFTGSTEVGQQIMQYATQNIIPVTLELGGKSPNIFFADVMDEEDAFFDKALEGFALFAFNQGEVCTCPSRALVQESIYERFMERAIRRVESIRSGNPLDSGTQMGAQVSHGQLETILNYIDIGKKEGADILTGGRRKELDGELKEGYYLEPTILFGKNNMRVFQEEIFGPVLAVTTFKTMEEALEIANDTQYGLGAGVWSRNGNLAYKMGRGIQAGRVWTNCYHAYPAHAAFGGYKQSGIGRETHKMMLEHYQQTKCLLVSYSDKPLGLF

SEQ ID NO: 69272 - protein, 252 aa, Triticum aestivum
MSAKGGKALVQSDAGKYVAWSGVDQPELAAEGLGCGLLLLRPLSFALPHYADCHKFGYVLRGSGVAGVLPVATGDASPAARERVVRLEAGDVIATRTGEVSWWYNDSDGDAGDLSIVFMGDTERAVSPGDMSYFFLPGGNSVLGGFDAGLLAGAWPGVTKEQAAAVFRSQPAVLLTGLSKKLPGVRPREDDRKRLLVNARPSPLQEPWKTLPRGRNGRAWPGPGDTRGFSGRVRDPGPDPRGPGMLPKGGPR

SEQ ID NO: 69273 - protein, 106 aa, Oryza sativa Indica Group
MCCKVSGLAPWFFVRHIVNKILNIHAPEWSGEVRSIVYSSDGKSVSVIYRVTLHGTDAEIYREATGTSSADDTGYGDPVQKAEAMAFRRACARLGLGLHLYHEDMS

SEQ ID NO: 69274 - protein, 460 aa, Physcomitrella patens subsp. patens
MSIITRLNGTYGTSFLLLVLLGYFTQGLRCFPWTAMSYWYKDTLKVDPGQMQFLMSTATLPMVAKPVYGIISDSVYIKGAHRVPYLIIAGALQLFAWTAIVVHSGASSSAAMLTAFLTITNLGGAISEVVNDAMIAEAGKNKVGAQQGELQSFAWLALASGGVVGNLTAGYAMKVVPPQVMLAIFIILIATQLLLALTVSEHSFALGPIKKDTDDNPEQKSHERQKDAGAAMREQITKLKESLQKPEIFKPLLWFLSSYAVIPGLGSALFYYQTQYLRLGASVIGLARVIGQVGLLFGSMLYNKCLKDVPIRRMFATVQILLSLCMLTDILLVNRINLEFGIPDKWFVLGASAFVEAIGQFKILPFMVLLAKLCPPGSEASLFAFFMSAQCLASLTNGYLGVVLASSLRISGNDFSGLPLGIFIQAFFALIPVLWIGLIPSEPKTVAVSQSDEIETKKEL

SEQ ID NO: 69275 - protein, 295 aa, Candida glabrata CBS 138
MSEKQVKYPWWYGGAAGIFAVMNTHPLDLTKVRLQAAPIPKPTIVQMLRSILKNEGIVGLYAGLSASLLRQCTYTTARFGMYDALKEHVIPRDKLTNMWYLLGASMVSGALGGLAGNFADLINIRMQNDSALPLDKRRNYKNAIDGMVKIYKAEGAKSLFLTGWKPNMVRGVLMTASQVVTYDMFKNFLVTKYNMDPKKNSTHLTSSLLAGFVATTVCSPADVIKTIVMNAHKKPGHNHDSSFKILMEAINKEGPSFMFRGWVPSFTRLAPFTMLIFFAMEQLKKYRVGMPKEEA

SEQ ID NO: 69276 - protein, 248 aa, Zea mays
MGRQFFVGGNFKMNGTIKSITEIVDNLNKAKLDENTEVVIAPPSLYLLLTREHLRKGIEVAAQNIFDKPNGAFTGEISVEQLKDSGITWTILGHSERRQILQENDDFVASKTKAAVDGGLGVILCCGESLEQREAGETVNVVTKQLKAVADKVKDWSKIVVAYEPIWAIGTGKVATTEQAQEVHAALREWLKKEVSAEASEKTRILYGGSVSEKNCKELAKRPDIDGFLVGGASLKPAFVDIINSHQA

SEQ ID NO: 69277 - protein, 253 aa, Magnetospirillum magnetotacticum MS-1
MERARLFTAAAGDHGVREGAVVVSGLTRPVPASRPAGRAILGPMTSAPSVSSSITARLQVEARPTAVSELTTAIEHTGGIVTALDVTASGHERITVDVTVATRGEEHAGQIVEALRALPGVVVDRVSDRTFLLHLGGKLKIESKVPIRNRDDLSMIYTPGVARVCEAIAAKPDDARRLTIKRNTIAVVTDGSAVLGLGDIGPLGSMPVRTAKRPGQRFADTTRSHRGRRPSHKTRDARLGRVGHNRGSGRGEQ

SEQ ID NO: 69278 - protein, 354 aa, Glycine max
MAEWQSLLQSILVGLIFSYLLAKLISIVVSFKDDNLTVTRASAAETTATRAEQFEDALKRDDAVSSDARPFEEESVVAEHGSVRIDSDGDYDDDWEGVESTELDEAFSAATAFVAAAAADRLSQKVSSDVQLQLYGLYKIATEGPCSTPQPSPLKMTARAKWQAWQKLGAMPPEDAMQKYIDIVTEIYPTWLDGSSLRNKSGDSGGHGSEAKGPMGPVFSTFVYEEEYGSDSQMEAIHGFAREGDMANLLKCIENGVSMNLKDSEGRTPLHWAVDRGHLNVTELLVGKNADVNAKDNDGQTPLHYAVTCEREAIAEYLVKHNADIYSKDNDGSSPRDICESNWPCMQHVGEEVN

SEQ ID NO: 69279 - protein, 625 aa, Candida albicans
MRATLTSLLVSITFLVSLVAAETHTWYFKTGWVNANPDGVYERPMIGFNDTWPLPTLRVKKGDRVQLYLINGFDNLNTTLHFHGLFQNGTNQMDGPEMVTQCPIPPGETYLYNFTVDQVGTYWYHSHTAGQYGDGMRGVFVIDDDDFPYDYDEDVVLTVGDHYHKYSSDIIPSFLSRFNPTGAEPIPQNFLFNETRNLTWKVEPGKTYLVRIVNVGGFVSQYLWMEDHEFTVVEVDGIYVEKNTTDMLYITTAQRYSVLINTKNSTDKNYAFMQRVDTDMLDVIPSDLQLNGTNYIVYNEDASLPEAYDVDSLDNYLDDFYLKPLSKEKLLDDADYTITVDVQMDNLGNGVNYAFFNNITYTTPKVPTLLTVLSAGDAATNELVYGTNTNSFVLQGGDVVDIVLNNLDTGKHPFHLHGHAFQLIERHKEIPEGEDPVTYNATDHADWPEYPMVRDTVYVRPQSYIVMRFKADNPGVWFFHCHIEWHLEQGLAFQLIEDPQGIQKNEKITDNHKQICEKVGVPWEGNAAANSKDYLNLVGENVQVKRLPTGFTAKGIVALVFSCISAFLGLAAISYYDMNDIENMEKRVARDLDVYFDDDDDEEEEEEQSITEQAATGSSSSPSNK

SEQ ID NO: 69280 - protein, 420 aa, Zea mays
  misc_feature (361)..(361): Xaa can be any naturally occurring amino acid
SSRSSRSSRIRLELVRGQASSMLSATTVPLQQGGGLSEFSGLRSSASLPMRRNATSDDFMSAVSFRTHAVGTSGGSRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVXDVPLVSVDFRCSDVSSTIDASLTMVMGDDMVKVISWYDNEWGYSQRVVDLADICANQWK

SEQ ID NO: 69281 - protein, 126 aa, Glycine max
  misc_feature (21)..(21): Xaa can be any naturally occurring amino acid
MAVEIDERSIEDLVAGNGVVXRSVASSLRLRSGMGLPVGKHYVPDKPLPMNEELLWDNGTAFPEPCIDRIADTVGKYEALAWLCGGLSFFASLGLLAVWNDKASKTPVAPKVYPYDNLRVELGGEP

SEQ ID NO: 69282 - protein, 398 aa, Lactobacillus plantarum
MGEHMDFLGILCLLILATTLAGHFAHRAGIPAVIGEILVGVILGPALLNWVHLTTLVQTFSDIGVVVLMFIGGLESNLALLRKYLPPAIIVGIIGVIFPVVIMGLASRFFQFSWFESLFIGVIFSATSVSISVEVLKEFKVLDTKEGATILGAAVADNIIGVILLSIMIAMMGGQSGVAQTNLGNVLLEQVGFFIGVFIVIKWVAPYLMRLSDHLLMAASPTIMAIIICLALAWLAKLVGLSGAIGAFFAGVAIAQTDYQHVVDVSIEPVGYTTFIPLFFVSVGLNMTFKGVWQSLTFIVVMTVLGVLTKLWGCGLGAKLNGFSRHSNYLVGAGMISRGEMALITAQIGFSAHLLSNDYYSDIILVIIVVTMIAPFVLKNAIHRAGQVTATHSIIEEH

SEQ ID NO: 69283 - protein, 142 aa, Triticum aestivum
  misc_feature (91)..(91): Xaa can be any naturally occurring amino acid
  misc_feature (99)..(99): Xaa can be any naturally occurring amino acid
  misc_feature (102)..(102): Xaa can be any naturally occurring amino acid
  misc_feature (109)..(109): Xaa can be any naturally occurring amino acid
  misc_feature (114)..(114): Xaa can be any naturally occurring amino acid
  misc_feature (117)..(117): Xaa can be any naturally occurring amino acid
  misc_feature (119)..(119): Xaa can be any naturally occurring amino acid
  misc_feature (121)..(121): Xaa can be any naturally occurring amino acid
  misc_feature (123)..(124): Xaa can be any naturally occurring amino acid
  misc_feature (134)..(134): Xaa can be any naturally occurring amino acid
  misc_feature (136)..(136): Xaa can be any naturally occurring amino acid
KNAAYIGTPGKGILAADESTGTIGKRFASINVENVEDNRRALRELLFCTPGALQYLSGVILFEETLVPRATRVAKPFLDNPQREGNVLPGXLRVDKGNXELXGNNGETXNQGFXDLXKXCXKXXKVVPRFCKWXGXLKNGPT

SEQ ID NO: 69284 - protein, 147 aa, Triticum aestivum
MQDPRGMGREDFSASKSQKRKVVYRPLPSVQIKTEPELLRRDIPHSLANTQKPPKRSFRSEPRPPTPQFDRGTPDSLPDSGPADEYRALRRKYMMLEEENYTLDAQLGMAEEEAKTLEDEKFALLDQLVVLEGLVEEPSQLQPQRRL

SEQ ID NO: 69285 - protein, 409 aa, Aquifex aeolicus VF5
MAKVKGLKCRECGREYPAEPIHVCEFCFGPLEVVYDYDEIKKNISREKIEKGPKSLWRYVDLLPVENPTVGLTAGFTPLKKAEKLGEVLGLKNLYIKDDSVNHPTLSFKDRVVSVALSKAKEFGFDTAACASTGNLANSVAAHSAQAGMNCFVFIPANLETQKIIGSLVFNPTVVAVEGNYDDVNRLCSEIANDLGWAFVNINIRPYYAEGSKTLAFEVAEQLGWRAPDVVVAPAASGSLYTKIWKGFNELKKVGLIDEVKTRMYGAQAEGCSPIAQAWREGRDFIKPVKPNTIAKSIAIGNPADGIYALQVARESNGAWETATDEEIIEGIKLLAQTEGIFTETAGGTTIAVLKKYVEKGMISPEETVVVYITGNGYKTMEVLEGKLSTPVKIKPTLKDFKEKVLARV

SEQ ID NO: 69286 - protein, 370 aa, Aquifex aeolicus VF5
MGFRLGIVGLPNVGKSTLFNALTKTMKAQAANYPFCTIEPNVGVVEVPDERLYKLAEIEKSQKITPTFIEFVDIAGLVKGASKGEGLGNQFLSHIREVDAVAMVLRAFEDENIVHVEGSVDPVRDKEIVEIELIAKDLESVNRRIEKVQKVAKGGDKKAREEMEHLNALKEILENLEPIRKYADKLPPETLEYAKKTLFLLTVKPVMYIANISEKDLPEGEGNPHVERIKEMANQENAPVVVISAELEAQLAGLSEEEQKEMLEAYGLKEPGLNKVIRTGYRLLDLITFFTAGEREARAWTVKRGTKAPQAAGKIHSDMERGFIAAEVISYEDLIKAGSWAKAKEQGLIRLEGKDYEIQDGDVVYFRFNV

SEQ ID NO: 69287 - protein, 494 aa, Nostoc punctiforme PCC 73102
MARLVARALRLGRSALIQVGAVCGYQGRYRTSFVASALMWHGPVIIVAQEPVQQLLLRIEIPRLQQWLPANKSIRTGDAWPDAEFQGLLLTSPEAWLRGQFAGGDRFPQGIPTIIDGVDDLEDWVRHQLTQDIQPHDWDELILACPNQAEAISEARIQLTHELFQHPVNPYHCYLISQPEIEILSRLCLALESVPSLPEPWKQFWQQFQTLDENLSPPASPAPPPLFWATIAHRQGLFSLHYAPMELREILLPLWQRQPVVLIGSAIEPETEAPLFRQRLGLEDLTCLKFSSESQAEAIQLYVPYKLPLPNTPEFQAAFIHKVRTLVCLSATAPGLTVVLVGDVPLKAQVATILASEFGSRVQVEKTCLDENGILISGWEFWREHQRVLPAPHLLIIATLPLPSLENPLVAGRVALYKRSHQDWFRLYLLPAALNELQRAIAPVRESQGIVALLDSRVVNRSYGAQILTALSPLARINYLDPSLFSNTDEENSA

SEQ ID NO: 69288 - protein, 123 aa, Methanothermobacter thermautotrophicus str. Delta H
MAKAIYVKFDVPKELADKAAEALEIARETGKVSKGTNEVTKAVERGVAQLVLIAEDVEPAEIVAHLPLLAEEKEIPYIYIPTKDELGAAAGLNVGTASSAIVEAGDAEDLIKEIIEKVEELKK

SEQ ID NO: 69289 - protein, 233 aa, Brassica napus
MADPRNGKSFFLTFYFIITLTLLFISPSDANESPAIVDSTEDVTSTDVAASVTEPTREDALLHKLEELVKNLTEIVSNLDAKLSESKNEISKSDDEAFVGGGRAKAFSVTKYSPFWTERFSFTSAVKLDSDATCINVLPFKDFEGSSKYFAIGDSRGRVYVFLRNGDVLIEFFTTVDSPVTAMVSYLSMFKNSSFFVTGHQNGAVLFHRIHEGSSGEDWNSNSVSMEHVGGFR

SEQ ID NO: 69290 - protein, 325 aa, Glycine max
GTTSTYNALMGACMSNGLADNCQSLFCDLKRDPTCDPSIATYNILLSVFGRLMLVDHMEATFREIQKLTFTMNICTYNHMIAGYITAWMWDDMEKVFQMLKLSSVEPNMKTYMLMLRGYANSGNLEKMEEMYSFIRDHVNIKEISLIRCMICAYCRSSHADRLKKIELLLKFIPQKEYRPWLNVLLIKLYAKEDWLAKMENAINEAFEHGTSITTKGILRRIIATYYRCNAVEKLENFVRRAEISGWSICRSLYHCKLVMYGSQMTLLEMHNVLEEMENVKLKCSKKTLWIMYKAYMSRGQISMVLKTLGQMFKHGYEVPLSAFP

SEQ ID NO: 69291 - protein, 68 aa, Zea mays
MTTSRRLADRKTAKFQKNITKRGSVPETTVKKGNDYPVGPIVLGFFIFVVVGSSLFQIIRTASSGGMA

SEQ ID NO: 69292 - protein, 378 aa, Burkholderia xenovorans LB400
MQDGRTTLSKFLIDTLDRQPCSTETARNAGLSALLIDVAAAIKSISAMLTKGALGGNYGSAQSINTHGEEQKKLDVATNEIFVQQCEWDGLLAAMVSEEMESVYAIPPGYPRGDYLLAFDPLDGSSNIDINGVVGSIFSVLRNGEGNGNANEKNGSDPRGTVGESAFLRPGCEQVAAGYAVYGPSTMLVLSVGNGTHGFTLEREIGNFVLTHSNIRIPEDTVEFAINASNERFWEPPVRRYVQECKDGRSGCRASDFNMRWIASMVAEVHRILMRGGVFMYPRDSKTPAMEGRLRLLYEANPMSFLVEQAGGLSITGRERILDVVPRALHGRVPVILGSKHEVERIGRYHGEYDRGEDQPFTSPLFSRRSLFLPGFTA

SEQ ID NO: 69293 - protein, 290 aa, Burkholderia xenovorans LB400
MSVKHPIIAVTGSSGAGTTTVMKSFTHIFRREKINAQIVEGDAFHRYDRNGMREAMKQHERDGAPNFSHFGPEANLLEDLETLFASYGENGTGRLRHYVHDEGETRLYKQDAGTFTPWEEVTPDTDLMFYEGLHGAAVTDDIDIARHADLLIGVVPIINLEWIQKLHRDQTMRGYSHEAVVDTILRRMPDYVNYICPQFSRTHVNFQRVPTVDTSNPFIAREIPQPDESFVVIRFARPKGIDFQYLLTMLHDSFMSRPNVIVVPGGKMGLAMQLIFTPMILQLIDRRARA

SEQ ID NO: 69294 - protein, 712 aa, Haemophilus somnus 2336
MSRTIILIPISTGVGLTSVSLGLIHALEQKGAKIGFMKPISQPSTDEDKLDRTTSIVRTSTTLETAEPFMLSVAENLIGQNQSDVLLEKIVENHQQLAKNNELIIVEGLVPTRKHGYANSINYEIAKALDAEIVLVAAPATETPAELKERIEAAASQFGGKNNPNLLGVIINKFNAPIDESGRTRPDLSEIFDAYQHKQNNLNEVYKLFEKSPIKVLACVPWNAELIATRAIDLVNHLGASILHEGDIKTRRIRSITFCARSLQNMVEHFKTGSLLVTSADRPDVLTASALAATNGIELGGILLTGGYKIDNQIKKLCQPVFENTGLPIFRIEGNTWQSALALQSFNLEVPVDDKERIENIKQYTSQQFKSSFIENLVAASTRPRRLSPPAFRFQLTELARAAKKRIVLPEGDEPRTVKAASLCAERGIAECILLANPDDVKRVADAQGVVLGKGITIIDPVSVRENYVDRLVELRKAKGMTETSAREQLEDTVVLGTMMLEANEVDGLVSGAIHTTANTIRPPMQIIKTAPGNSIVSSIFFMLLPDQVLVYGDCAVNPDPTAEQLAEIAIQSADSAKAFGIDPKVAMISYSTGTSGSGADVEKVKEATRIAQEKRPDLLIDGPLQYDAAVMEDVAKSKAPNSPVAGKATVFVFPDLNTGNTTYKAVQRSADLISIGPMLQGMRKPVNDLSRGALVDDIVYTIALTAIQATQ

SEQ ID NO: 69295 - protein, 185 aa, Triticum aestivum
MAQAKGKVDCQTYTEIDTCSPGWVFDAAVTVAPSDDERLAHGGCRAVVDEEQDTKVKISEALEAAARAVGDDPVERSDAAAIRAAEVRAVGTGVDIPAGIAAQAQAAADANATAAHAEDKITIGDVLKWNATAKLPSGKAVTREDAAAAVEAEAAHAPGKATKPYGVGAALTEAARRNQEGTCRK

SEQ ID NO: 69296 - protein, 239 aa, Burkholderia xenovorans LB400
MRDFLIAPSLLSADFARLADEIRDVTAAGADWIHLDVMDNHYVPNLTVGPLVCAAIRPHTSVPIDVHLMTMPVDSLVAGFAEAGANTISFHPEASLHVHRTIELIKSSGARAGLALNPATPLAVLDHVIERLDVVLVMSVNPGFGGQAFIPETLDKLRALRERVDATMQRTGRLLLIEVDGGVKAANIARIAASGADVFVAGSAVFGADDYAQAIGEMRDELERVSDESEGAGVLAVVR

SEQ ID NO: 69297 - protein, 730 aa, Candida glabrata CBS 138
MLHATVLPILLWLATLAYGFDRKEFLVDGNELPGFTKLKNTKHWTVPKMYAGHLPATRDNDTQYFFWKFENKKTKKNDETPLIIWLNGGPGCSSMAGALMEIGPFRLNKKAEVIKNDGSWHMRGSVLFLDQPVGTGFSYSKEDNEVSELDEVADNFMVFLQNYYATFPDDKDRELILAGESYAGQFIPYFTKAIIKFNEQQRDENSKINIKVMFIGNGWLDPKRQYLSYVPFSLEKGIIKKEDPAFKDILKQHETCQNYINSDHTGHSELSYPPCEAVLGKIISQDKTQCINVYKFDEYDSYPSCGLEWPVDTKFTKQFLTDKKVLAALHANDERSWIECRPDVKLENIKAKPAIELIPSLLESGIELILFNGNKDLICNTLGIDNVLKHLQWEGETGFTDEVQIFDWVYRDDLKSDKEKVAGTVKYERQLTLITIEDGSHMVSYDKALISRGILDMYYDDVLLVHRDGKDTLISSKDGDIDGYLEDDKSQDENKDNESEDESEDENDSDDESDGKEGDKQENKPDDSDDESDEEDDDEDEDDEDDDDDDDDDDGDDEDKKGDQNSHPSHGDMNGGLDNDLETGGEYYQDEDEEGSNFKAFFLILSLVSAFIIVAAFYISDYIKSRRHPILVDGDGRSRLNKSVTWASDIENGSFDIEDDDPEFGTEGMEDNMELEDVFSIDEEDEEQLEGVVPESTRKSKKGSKKKGKYFSVPNDDSAEDIELQDIERH

SEQ ID NO: 69298 - protein, 784 aa, Yersinia pestis biovar Microtus str. 91001
MLWYNQLGMHDVDRVGGKNASLGEMITHLSELGVSVPNGFATTAQAFNDFLEQSGVNQRIYQLLDNTNIDDIAELSKAGAQIRQWVIETPFHPEFEQSIYDAYKQLADGEPEASFAVRSSATAEDMPDASFAGQQETFLNVQGIDAIMVAIKHVFASLFNDRAISYRVHQGYDHRGVALSAGVQRMVRSDLASSGVMFTIDTESGFDQVVFITAAHGLGEMVVQGAVNPDEFYVHKPTLRNGKPAIVRRNMGSKKIRMIYAENQEHGKQVCIEDVPEIQRNRFALSDDEVEALAHQALLIEEHYGRPMDIEWAKDGHTGQLFIVQARPETVRSNEQVMERYQLNNQSNVLVEGRAIGHRIGAGPVKVIHDISEMDRIQAGDVLVTDMTDPDWEPIMKKASAIVTNRGGRTCHAAIIARELGIPAVVGCGNATELLKEGQNVTVSCAEGDTGYVYHELLDFSVQSSQVTELPDLPLKIMMNVGNPDRAFDFARLPNEGVGLARLEFIINRMIGVHPKALLEFDQQEPALQAEIKALMHGYDDPVEFYIGRLTEGIATLGAAFWPKPVIVRLSDFKSNEYANLVGGAGYEPHEENPMLGFRGAGRYVSDHFRDCFALECEAMKRVRNVMGLTNVEVMVPFVRTVAQAEAVVAELARQGLKRGENGLKIIMMCEIPSNALLAEQFLEHFDGFSIGSNDMTQLTLGLDRDSGVVSALFDERNEAVKALLSMAIQAAKRHGKYVGICGQGPSDHEDFALWLMEQGIDSLSLNPDTVVKTWLSLAQHTKH

SEQ ID NO: 69299 - protein, 241 aa, Triticum aestivum
  misc_feature (71)..(71): Xaa can be any naturally occurring amino acid
  misc_feature (86)..(86): Xaa can be any naturally occurring amino acid
  misc_feature (100)..(100): Xaa can be any naturally occurring amino acid
  misc_feature (113)..(113): Xaa can be any naturally occurring amino acid
  misc_feature (125)..(125): Xaa can be any naturally occurring amino acid
  misc_feature (140)..(140): Xaa can be any naturally occurring amino acid
  misc_feature (176)..(176): Xaa can be any naturally occurring amino acid
MAGLSMEHPWAFAFGLLGNIISFTSLLAPIPTFYRIFKSKSTEGFQSVPYVVALFSAMLWIFYALVKTGEXLLITINAAGCVIETXYIVMYLVYAPRKAXFTAKIVLLLNIAXFGLIFLLTVFAXQGETRVNSLGWICVXFSVCVFVAPLSIIGRVIKTKSVEYMPFSLSLTLTLXAIVWFLYGLLIKDKYVALPNILGFTFGMIQMVLYMFYMNATPRGDKRCEGGEGGMERCLQRTKSS

SEQ ID NO: 69300 - protein, 282 aa, Zea mays
MMTGDSVMMDETDDSWFNCHKIKLPADCGYEFQMKYGLIGWLMGALLGYAQGANHKLFSPLTALHPLVVACCDHGSIMDALTTNFMSNNLVQLCGCLLSVAANKGNFSAFPWDPGEDGAVILGVLGCSSYPIKTKWLNYHQKCYRLLSKVAPPPLGSRHTGCVVNAQRGGDQVWMQPLVHDLGQLNGHQQREIQVSSIISDSISATLWKTVEQTNPSHSFTTGLAQSVGFKQPWPPPTKFECLSAWIVHGRRQLSDHGQRLEGKPHFKRWGMLGMAAMWGHC

SEQ ID NO: 69301 - protein, 647 aa, Oryza sativa
MGGGGPLVDGFRRLFHRRTASGSNQSSNAGEEAASSDLEVADDPDLVALRSIRIRVPKRKMPLPVESHKKFGGEMKVSGFLVILDSWPRGVLRLDQIFVAPELLAYCTISLFLFFYDLCKVQYSSSAGLTWSGLCISLVRTVSIGNKSRLAHGMEQNTVEMEFFTEYGEASQYQIQEVIGKGSYGVVAAAVDTRTGERVAIKKINDVFEHVSDATRILREIKLLRLLRHPDIVEIKHIMLPPSRREFQDIYVVFELMESDLHQVIRANDDLTPEHYQFFLYQLLRALKYIHAANVFHRDLKPKNILANSDCKLKICDFGLARASFNDAPSAIFWTDYVATRWYRAPELCGSFFSKYTPAIDIWSIGCIFAELLTGRPLFPGKNVVHQLDIITDLLGTPSSETLSRIRNEKARRYLSTMRKKHAVPFSQKFRNTDPLALRLLERLLAFDPKDRSSAEEALADPYFASLANVEREPSRHPISKLEFEFERRKLTKDDVRELIYREILEYHPQMLQEYMKGGEQISFLYPSGVDRFKRQFAHLEENYSKGERGSPLQRKHASLPRERVGVSKDGYNQQNTNDQERSADSVARTTVSPPMSQDAQQHGSAGQNGVTSTDLSSRSYLKSASISASKCVAVKDNKEPEDPCMD

SEQ ID NO: 69302 - protein, 490 aa, Wilsonia humilis
MRINPTTSGSEVSAVEKKNLGRIVQIIGPVLDVAFPAGKMPNIYNALVVQGRDNEQTNVTCEVQQLVGNNRVRTVAMSDTDGLMRGMEVIDTGAPISVPVGGSTLGRIFNVLGEPVDNLGPVDTKTTSPIHRSAPAFVQLDTKLSIFETGIKVVDLLAPYRRGGKIGLFGGAGVGKTVLIMELINNIAKAHGGVSVFGGVGERTREGNDLYMEMKESGVINEEDIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEIFTGSPGKYVGLAETIRGFQLILSGELDGLPEQAFYLVGNIDEATAKAMNLKT

SEQ ID NO: 69303 - protein, 478 aa, Wilsonia backhousei
SAVEKKTLGRIVQIIGPVLDVAFPPGQMPNIYNALVVQGRDNEQTNVTCEVQQLVGNNRVRAVAMSDTAGLMRGMEVIDTGAPISVPVGGATLGRIFNVLGEPVDNLGPVDTKTTSPIHRSAPAFVQLDTKLSIFETGIKVVDLLAPYRRGGKIGLFGGAGVGKTVLIMELINNIAKAHGGVSVFGGVGERTREGNDLYMEMKESGVINEEDIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEIFTGSPGKYVGLAETIRGFQLILSGELDGLPEQAFYLVGNIDEATAKAMNLKT

SEQ ID NO: 69304 - protein, 490 aa, Zea mays
MVLSKAVSESDMSVHSTFASRYVRSSLPRYRMPENSIPKEAAYQIINDELMLDGNPRLNLASFVTTWMEPECDKLIMAAINKNYVDMDEYPVTTELQNRCVNMIAHLFNAPLGESETAVGVGTVGSSEAIMLAGLAFKRRWQNKRRAEGKPFDKPNIVTGANVQVCWEKFARYFEVELREVKLRDGYYVMDPEKAVEMVDENTICVAAILGSTLNGEFEDVKLLNDLLQAKNRETRWETPIHVDAASGGFIAPFLYPDLEWDFRLPLVKSINVSGHKYGLVYAGIGWCIWRSKEDLPEELIFHINYLGADQPTFTLNFSKGSSQVIAQYYQLIRHGFEGYRNIMENCHENAMVLKEGLEKTGRFDIVSKDEGVPLVAFSLKDRSRHDEFEISDMLRRFGWIVPAYTMPPDAQHVTVLRVVIREEFSRTLAERLVLDIEKVMYQLDALPSRLPPPPPAAPLLRKKTELETQRSVTEAWKKFVLAKKTNGVC

SEQ ID NO: 69305 - protein, 161 aa, Brassica napus
  misc_feature (11)..(11): Xaa can be any naturally occurring amino acid
  misc_feature (19)..(19): Xaa can be any naturally occurring amino acid
  misc_feature (21)..(21): Xaa can be any naturally occurring amino acid
  misc_feature (31)..(31): Xaa can be any naturally occurring amino acid
  misc_feature (36)..(36): Xaa can be any naturally occurring amino acid
  misc_feature (39)..(40): Xaa can be any naturally occurring amino acid
  misc_feature (42)..(42): Xaa can be any naturally occurring amino acid
  misc_feature (45)..(45): Xaa can be any naturally occurring amino acid
  misc_feature (48)..(48): Xaa can be any naturally occurring amino acid
  misc_feature (51)..(51): Xaa can be any naturally occurring amino acid
  misc_feature (55)..(55): Xaa can be any naturally occurring amino acid
  misc_feature (60)..(60): Xaa can be any naturally occurring amino acid
  misc_feature (63)..(63): Xaa can be any naturally occurring amino acid
  misc_feature (67)..(69): Xaa can be any naturally occurring amino acid
  misc_feature (75)..(76): Xaa can be any naturally occurring amino acid
  misc_feature (88)..(89): Xaa can be any naturally occurring amino acid
  misc_feature (91)..(93): Xaa can be any naturally occurring amino acid
  misc_feature (95)..(96): Xaa can be any naturally occurring amino acid
  misc_feature (100)..(102): Xaa can be any naturally occurring amino acid
  misc_feature (105)..(107): Xaa can be any naturally occurring amino acid
  misc_feature (115)..(115): Xaa can be any naturally occurring amino acid
  misc_feature (119)..(120): Xaa can be any naturally occurring amino acid
  misc_feature (139)..(139): Xaa can be any naturally occurring amino acid
  misc_feature (147)..(148): Xaa can be any naturally occurring amino acid
  misc_feature (151)..(151): Xaa can be any naturally occurring amino acid
  misc_feature (153)..(153): Xaa can be any naturally occurring amino acid
  misc_feature (155)..(156): Xaa can be any naturally occurring amino acid
SEKKKKKKSVXASSMLSSXAXVTSPAHATMXAPFTXLKXXAXFPXTRXANXDITXIASNXGRXSCMXXXPPVGKXXVETLSYLPDLTXXEXXXEXXYLLXXXWIXXXEVELEHGXVYRXXGSTPVYYDGRYWTMWKLPXFGCTDSAXXLKXAXNXXGERDI

SEQ ID NO: 69306 - protein, 387 aa, Oryza sativa Japonica Group
MSSCFNGGAGWPEPVVRVQAVSDSCGATIPERYVKAPSERPSSLDGGGGLNNIPVVDMSMPDGEETARAVAAACREWGFFQAVNHGVRPELLRRARAAWRGFFARPAEAREAYANSPATYEGYGSRLGTAKGGPLDWGDYYFLHLLPAALKSHDKWPTSSVPAGGGGLREATEEYAEEVVRLCRRVMRLLSRGLGLDDGRLQAAFGGVGGEGACLRVNFYPRCPQPELTLGVASHSDPGGMTMLLVDDHVRGLQVKNAGHWITVDPVPDAFIVNIGDQIQVLSNAVYKSVEHRVTVSAAEERLSLAFFYNPRSDLPLAPMPELVAPPARPALYPPMTFDEYREHIRRCGLSGKAQLQSQQMATAICGAPPAATAFSSSSSSASSLAR

SEQ ID NO: 69307 - protein, 466 aa, Clostridium perfringens SM101
MLFGKNELGSQFETPIFGTVESNEPIPKYKLAKKSIAPQVAYRLIKDDLLDEGNARQNLATFCQTYMDDEAVKLMSETLEKNAIDKSEYPQTTDMENRCVNILADLWHAPKELNYMGTSTVGSSEACMLGGMAMKFRWRNRAKALGMDVTSKKPNLVISSGYQVCWEKFCVYWDIEMRLVPMDEQHMSINVDKVLDYVDDYTIGVVGILGITYTGKYDDIKALDKKLEEYNKTAKITVPIHVDGASGAMFAPFIEPDLKWDFQLKNVVSISTSGHKYGLVYPGIGWVLWKDKEYLPQELVFEVSYLGGKMPTMAINFSRSASQILGQYYNFLRYGFEGYRQIHQRTKDVAMYLSSELEKTGLFEIYNNGENLPIVCYKLKDDVKVNWTLYDLADRLLMKGWQVPAYPLPEDLQNVIIQRFVCRADLSRNLADLLMRDLKAAIEDLNNARILSKTQVDNKGVQGFTH

SEQ ID NO: 69308 - protein, 201 aa, Escherichia albertii
LKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGFS

SEQ ID NO: 69309 - protein, 572 aa, Listeria monocytogenes EGD-e
MAKELKGIAASDGIAIAKAYLLVEPDLSYEKTEVTDVESEVKRFESALEVSRTELSMIREKAAKDLGEDKAQIFDAHLLVLNDPELTGPIEESIKNSKTNAETALQETTDMFIGMFESMDNEYMRERAADIKDVRKRVLSHLLGVTIPNPALIDEEVVVVAADLTPSDTAQLNRNFVKGFVTDIGGRTSHSAIMARSLEIPAVVGTKEVTASVAKNDIVIIDGLEGNVIIHPTEEQIAHYEKIKSDFALQQAEWDKLKNEKTVSKDGVHVELAANIGTPNDLEGVISNGGEAVGLYRTEFLYMGRDNFPTEEEQFEAYKAVVSGMDGKSVVVRTLDIGGDKTLPYLELPEEMNPFLGFRAIRLCFANEELFRTQLRALLRASVYGNLKIMFPMIATVNEFRQARDILLDEKAKLKAAGTEVSDSIELGIMIEIPAAAVLADQFAKEVDFFSIGTNDLIQYTMAADRMNERVSYLYQPYNPSILRLVKMVIDASHKEGKWTGMCGEMAGDQTAVPLLLGLGLDEFSMSASSILKSRSLIKRLDQSEMVKLAEEALNKSTAEEVVELVEKYTAE

SEQ ID NO: 69310 - protein, 109 aa, Triticum aestivum
  misc_feature (76)..(76): Xaa can be any naturally occurring amino acid
  misc_feature (93)..(93): Xaa can be any naturally occurring amino acid
MAPISKPEITSNIQWVAQMNVDVEPTHGRKTSIIGTIGPKTNSVDMITQLRNAGLNVVRMNFSHGSYEYHQSVIEXTRKSVEIYPGRPVAIAXLDNKGPEIRTGKIWKG

SEQ ID NO: 69311 - protein, 202 aa, Escherichia albertii
LKARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGFSF

SEQ ID NO: 69312 - protein, 331 aa, Cryptococcus neoformans var. neoformans B-3501A
MAAVNYTIEDPNTVPWIKTPLVRSAALSKLAGCEILLKLENIQPSGSFKSRGIGNLVLQSVNSAPPDTPLHFYSSSGGNAGLACVNAASTLGYPSSVIVPLSTKPFMIDKLRTAGATEVIQTGQTWFEADKHLQEEILARDPNGIYVPPFDHSDIWQGAATMVDEIVQELTHVPDAIVCSVGGGGLMIGVCKGLERLDKEKKAKVVAVETLGAESLHKSVKAGQLITLPGITSLATSLGATTVAAKALEYALQPQVRSTVVSDKEALEACIRFLDDERILVEPACGATLAMVYSGKLKDVLKLDAKSKVVLVVCGGSNISLELIEGYKKMF

SEQ ID NO: 69313 - protein, 381 aa, Listeria monocytogenes EGD-e
MTKSIRPELRDIQVSGIRTFNTRVTGIPDMIRLTLGEPDFPTPDHVKQAAISAIEENFTNYTPNAGMPELLEAASIYFHEKYDLSYSNKEIIVTVGATEAISVALQTILEPGDEVILPDPIYPGYEPLITLNKAHPVKVDTTETNFKLTPEQLKAHITPKTKALIIPYPSNPTGVTLSKDELSALAEVLKETGIFVIADEIYSELTYHEEHVSIAPMLRDQTIVINGLSKSHAMIGWRIGFLLAPEILTQEMLKIHQYSVTCASSISQKAALEAITNGKDDAFQMRTEYKTRANFTQDRLEKMGFTVIPPDGAFYFFVKLPDEIAENSFDWAVKLAEEAKVAVVPGNAFSEKGDRYFRLSYATSFNNLAEALDRMAQFVEK

SEQ ID NO: 69314 - protein, 199 aa, Shigella boydii
ARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 69315 - protein, 518 aa, Exiguobacterium sibiricum 255-15
MSILTVSNLSHGFGDRAIFEDVSFRLLKGEHIGLVGANGEGKSTFMNIITSQLEPDEGKVEWAKHVRVGYLDQHAVLSKGLTIRDALKGAFQYLFDIEQEINDLYTKMGEVEPDELEKMLEEVGVLQDILTNNDFYTIDAKVEEIARGLGLDEIGLDRDVQELSGGQRTKILLAKLLLEKPDILLLDEPTNYLDVQHIEWLKRYLNDYENAFILISHDIPFLNSVINLIYHMENQGLNRYVGDYDNFLTVHEAKKKQHESAFKRQQQEISELKDFVARNKARVSTRNMAMSRQKKLDKMDVIELAQERPKPEFHFQTARTPSKLMFEAKGLVIGYDEPLSRPLDLMIERGQKIALHGANGIGKSTLLKSLLGEIPSVSGTVERGENLHIGYFEQEIKEKNSNTCIEEIWGTFPSLTQQQVRAMLAKCGLMTKHIESKIEVLSGGEKAKVRLCKLMNTESNILVLDEPTNHLDVEAKEELKRALQEYKGTVLLISHEPEFYEAVATDLWNCESWTTKVF

SEQ ID NO: 69316 - protein, 332 aa, Bacillus anthracis str. Ames
MNPLIFKENRPFDLIAVGRLCVDLNANETQRPMEETRTFTKYVGGSPANIAIGAARLGLQTGFIGKVSDDQMGRFITGYLKDNKINTDQIPIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEKSNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMETAEELV

SEQ ID NO: 69317 - protein, 310 aa, Ralstonia solanacearum
INGFGRIGRMVFRAAVANFKDIEVVAINDLLEPDYLVYMLKYDSVHGRFDGEVAVDGNTLIVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPELNKKLTGMSFRVPTSDVSVVDLTVELEKAATYDEICAEMKAQSEGALKGVLGYTEDKVVATDFRGDARTSIFDAEAGIALDGTFIKVVSWYDNE

SEQ ID NO: 69318 - protein, 273 aa, Salmonella typhimurium LT2
MPCEELEIVWKNIKAEARALADCEPMLASFYHATLLKHENLGSALSYMLANKLASPIMPAIAIREVVEEAYAADPEMIASAACDIQAVRTRDPAVDKYSTPLLYLKGFHALQAYRIGHWLWNKGRRALAIFLQNQVSVSFQVDIHPAAKIGRGIMLDHATGIVVGETAVIEDDVSILQSVTLGGTGKTSGDRHPKIREGVMIGAGAKILGNIEVGRGAKIGAGSVVLQPVPPHTTAAGVPARIVGKPGSDKPSMDMDQHFNGIHHTFEYGDGI

SEQ ID NO: 69319 - protein, 487 aa, Bacillus anthracis str. Ames
MTVQTAQIVKNYIGGEWVESISTKMEAVYNPATGEVIAQVPLSTKVDVEQAVLAANEAFKSWSKTAVPRRARILFKYQQLLVDNWEELAKLITIENGKSYNEAYGEVLRGIECVEFAAGAPTLMMGKQLPDIATGIESGMYRYPIGVIGGITPFNFPMMVPCWMFPLAIACGNTFVLKPSERTPLLAARLAELAEEAGLPKGVLNIVNGAHDVVNGLLEHKLVKAISFVGSQPVAEYVYKKGTENLKRVQALAGAKNHSIVLNDANLELATKQIISAAFGSAGERCMAASVVTVEEEIADQLVERLVAEANKIVIGNGLDEDVFLGPVIRDNHKERTIGYIDSGVEQGATLVRDGREDTAVKGAGYFVGPTIFDHVTKEMKIWQDEIFAPVLSIVRVKSLDEAIEIANESRFANGACIYTDSGASVRQFRETIESGMLGVNVGVPAPMAFFPFSGWKDSFYGDLHANGTDGVEFYTRKKMLTSRWEK

SEQ ID NO: 69320 - protein, 726 aa, Coprinopsis cinerea okayama7#130
MPFTPFEVTIPHIIYACLGGFIVLFGMFSLFLRSRLYISEACWAFLFGVIIGPFCADIFNPRAWTGNNDEVTNVVVLEFTRVVLAIGVFAIGVELPKAYMARHWKSLFFLLVPVMTWGWVVSAAFIYALIPKLNYVSSLAIAACLTPTDPILAAAVIGGKWADKHVPAHLRHLLAAESGCNDGAAFPFLFLALYLLLDIDAKTAVKDWFLLLWLYQIALAIVMGALLGFGFRHLMKFCERLDLIDRHSYVAQYVSLALFTIGVTTLLGTDDLLAAFACGTAFAWDGFFNRQTEESVFSSVIDLLFNVAAFIFVGAWMPFDKFQDGEIELSVWRLIVIAVLVLVFRRLPVMIALYRWIPDVKNLREATFSGHFGPIGIGAVFISTLALEVIHRQHPTPTTTSNYDQIHRVTEVIHPVVSFMVLCSITVHGLSIPSFSLGRRVHSVSRTWSVHSGRTWSRHATATGTARGAPEWTYHARLVSRGDAGIVINRDRGDEGAGGVGEGVGEEEEEEERRVVGVVDLEKGQTDSEKTKEGSGSEKDGIGGGERLEIYVDHAGEFDEDHRDRRGEDLESGFSGGIGIEGGAGGAPGEVRFAERATEEGGRAKLKAKADADVVSPSPPSGSPSPLSPGSPPSPPTTSISITVPGQEEEERHPHIRLLEPSYPFSPHRLSVTSPSRSVDLGDVPQDRTGLDYREEAYPDGGRLPIRDLGEGEEITEWREGRHSGY

SEQ ID NO: 69321 - protein, 439 aa, Yersinia enterocolitica
MLSLDQIPHHIRHGIVGSRLIQIRGRVTQVTGTLLKAVVPGVRIGELCYLRNPDNSLSLQAEVIGFAQHQALLIPLGEMYGISSNTEVSPTGTMHQVGVGEHLLGQVLDGLGQPFDGGHLPEPAAWYPVYQDAPAPMSRKLITTPLSLGIRVIDGLLTCGEGQRMGIFAAAGGGKSTLLASLIRSAEVDVTVLALIGERGREVREFIESDLGEEGLRKAVLVVATSDRPSMERAKAGFVATSIAEYFRDQGKRVLLLMDSVTRFARAQREIGLAAGEPPTRRGYPPSVFAALPRLMERAGQSSKGSITALYTVLVEGDDMTEPVADETRSILDGHIILSRKLAAANHYPAIDVLRSASRVMNQIVSKEHKTWAGDLRRLLAKYEEVELLLQIGEYQKGQDKEADQAIERIGAIRGWLCQGTHELSHFNETLNLLETLTQ

SEQ ID NO: 69322 - protein, 514 aa, Salmonella typhimurium LT2
MSVSKKPMVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQAHTAHTNLPVPLIYVGEKNVKAVEGGKLSDIAPTMLSLMGMEIPQEMTGKPLFIVE

SEQ ID NO: 69323 - protein, 530 aa, Desulfovibrio desulfuricans G20
MIFSCRRFQRAHSALRCGGCPEKRTADVVRCVRRPDGVCCRSSAHELDHVKTGAAVSFARFSLHPALIEAVSARGFVNPTPIQEKALPPALAGQDILGLAATGTGKTAAFVLPLLHRLLLQGESARGTLRALVVAPTRELVAQIHEEVKTLARFCRLRSATVYGGVGMHAQTVQLRTGVDIVLACPGRLLDHVRRGHADLSHVDMLVLDEADMMFDMGFLSDVREILHCTRVRKQTMLFSATMPAPLRELAEECLRQPVRIELDTCAIAPTVRHSLCPVPKHLKTPLLKYVLRAFARDSVLVFVRTRHGARRLWQQLVKSGIEATCLQGNLSQGRRRAALEGFRRGTFRVMVATDIAARGIDVSQVGYVINYDFPPSVEACVHRAGRTGRASNSGVALTFVTQEDEPQVRTLERVLGGALSRWHAEGFDYSALQRTEAARPARLRREPRPQRVQRVRRLLEDAAREQMAAARKVASHAGHGGDMHQDGQPVKPAFRIVPREAPAPLKPKPGQYVMKPQPPVIIRKRRGGA

SEQ ID NO: 69324 - protein, 771 aa, Oryza sativa
  misc_feature (682)..(682): Xaa can be any naturally occurring amino acid
MALIGTVAAEVLIPLAAVIGILFAVLQWYMVSRVAVPPHDGVGGAGKVERESDGGDGDGDGVDDEEDGVDYRGVEARCAEIQHAISVGATSFLMTEYKYLGAFMAAFAAVIFVSLGSVGRFSTSTEPCPYDAARRCRPALANAAFTAAAFLLGATTSVVSGYLGMRVATFANARTALEARRGIGRAFAVAFRSGAAMGFLLASSALLVLFAAVNAFGLYYGDDWGGLYEAITGYGLGGSSMALFGRVGGGIYTKAADVGADLVGKVERNIPEDDPRNPAVIADNVGDNVGDIAGMGSDLFGSYAESSCAALFVASISSFGADHDFAAMMYPLLVSAAGIVACAATTLVATDAGELGAADEVAPALKRQILISTVLMTAAVAAVTFLSLPRSFTLFDFGERKLVKNWHLFICVSAGLWAGLVIGYVTEYFTSNAYGPVQTVAQSCRTGAATNVIFGLAVGYKSVIVPIFAIAGAIYASFRLAAMYGIALAALGMLSTIATGLTIDAYGPISDNAGGIAEMAGMPRRVRERTDALDAAGNTTAAIGKGFAIGSAALVSLALFGAYVSRAGIRTVNVVSPRVFVGLLAGAMLPYWFSAMTMRSVGSAALRMVEEVRRQFDEIPGLAEGLAAPDYATCVRISTDASLREMVAPGALVMASPLVAGTLFGVEALAGLLAGALVSGVXQVAISASNSGGAWDNAKKYIEAGATEEARSLGPKGSEAHKAAVIGDTIGDPLKDTSGPSLNILVKLMAVEALVFAPFFAAHGGIVFNHL

SEQ ID NO: 69325 - protein, 367 aa, Fragaria x ananassa
WGWRKSLSFDLIQEWVLKNPEASICTAQGAKKFKDIAIFQDYHGLPEFRMAVANFMGKVRGNRVTFNPDRIVMSGGATGAHEDDCLLLGLIPERDFWVPVPYYPGFDRRFEMANWGTASSSTCESSTISRSREQPWKNAYEKAQKANIRVKGLIITNPSNPLGTILDRETLKSLGFHHEKNIHLVCDEIYAATVFTQPRFISIAEILEEEDVVCHRDLVHIVYSLSKDMGFPGFRVRNPCTHYNDAVSGLRRERCRVSGWVSTQTQCLIASMLSDNEFVDRFIVESAKRLEARHTKFTEGLEEQGTTCLKSNGGLFVWMDLHKHLKEQTFEAEMALWRTIINIVKLNVSPGCSFHCPQPGWFSVCFA

SEQ ID NO: 69326 - protein, 343 aa, Escherichia coli
MLKLDFVTRSAKILSAFIGDEIPQNVLEERVRAAFAFPAPVAKVEGDIGCLELFHGPTLAFKDFGGRFMAQVLTHIAGDKPVTILTATSGDTGAAVAHAFYGLPNVNVVILYPRGKISPLQEKLFCTLGGNIETVAIDGDFDACQALVKQAFDDEELKVTLGLNSANSINISRLLAQICYYFEAVAQLPQEARNQLVVSVPSGNFGDLTAGLLAKSLGLPVKRFIAATNVNDTVPRFLRDGQWSPKATQATLSNAMDVSQPNNWPRVEELFRRKIWQLKELGYAAVDDETTQQTMRELKVLGYISEPHAAVAYRALRDQLHPGEYGLFLGTAHPAKFKESVEA

SEQ ID NO: 69327 - protein, 447 aa, Neurospora crassa
MLLDVKASQRLDSRGNPTIQVEVRTAHGIFRALVPSGASTGVHEAVELRDNDKRKYGGKGVLTAVNNVNEIIGPALVKEGYSSRRDLKQIDGFMRELDGTPNKAKLGANAILGVSMACARAGAAAANIPLYEFLRREGGEEAPYMVPVPFFNVLNGGRHSGNGMAFQEFMIAPTGAKTIEEGIQMASETYFVLKQMISDKFGAIYTGVGDEGGFAPPITQPEEALDLLTEAVAKAGYTDKIKFGIDAASSEFFNPENGTYDLGFKRIKEGESHSDDVRTPAEMMALYKSLIEKYPIPLLEDPFAEDDWESWTKFCKDFYFEELVGDDLLVTNVERVRMAESRVACNAMLLKINQIGTVTEALDAAKLAKSLGWGVFVSHRSGETTDDFIADLSVGLCTGHIKSGAPCRGERVAKYNRLLDIETELKESWKPWSYAGEKFRKPEAFFI

SEQ ID NO: 69328 - protein, 384 aa, Nicotiana tabacum
MCVQESEEVSEEMENLDISKSDENIKIGSLQVEDELGNTQKENCEKNTSSSFSVIRNSFPMESISEDTTIADRKQILSNKFLPTLRSGEWSDIGGRLDMEDTHICIADLAKNFGQSILGEEEAVSFYGVFDGHGGKGAALFVRDFLPRIIVEDADFPLKLEKVVSKSFLETDAAFAKSCSADSDLSSGTTALTAMIFGRSLLVANAGDCRAVLSRGGLAIEMSKDHRPCCVSERTRVESLGGFVDDGYLNGQLGVTRALGDWHIKGLKEVEKGGPLSAEPELKLLTLTKEDEFLIIGSDGIWDVFRSQNAVDFARRRLQEHNNAKLCCKEVVDEAKKRGAIDNLTVVMVCFHSEPPPTIVFQRSRIRKCISAEGLQNLRSLLDG

SEQ ID NO: 69329 - protein, 634 aa, Methylococcus capsulatus str. Bath
MIEFHEVTLRIGGRSLFEHASFNIFPGQKVGVTGANGVGKSSLFGLVTGSRQTDAGEVRLPPNWVIAHVAQETPSDARAAIEFIMDGDTELREVEREIASAEASGDGLALARAHARYEAIGGYQARAKAGRLLAGLGFAAGDGERPVDAFSGGWRMRLALGRALMGRSDLLLLDEPTNHLDLDAVLWLQEWLAGYPGTLLFVSHDRDFLDGLADHILHIENGQVILNTGNFSDFERARAQRLAQNQAAFRRQQAEIARLQGFVDRFRAKATKARQAQSRLKLLAKMEVISLAHVDSPFEFAFRPPEKLPRPLLQTEDVTVGYEGVTLLENIGLSLMPGDRVGLLGRNGAGKSTLIKLLAGLHPPSSGERRVSGELRLGYFAQHQVELLRPAENAVFHVQSLDDKASEKDIRNFLGGFGFSGERTFEPVAGFSGGEKARLVLALLVYQRPNLLLLDEPTNHLDLEMRLALIRALQDFEGAVVLVSHDSYLLRAVADDFFLVADGRVTPFDGDLDDYRAWLRNRASSNSSGAEDHRDAGTSRRETRRADAERRQRLRPLRLQLERAEAELEHCSKRREELESQLADPGLYAEEARDRLKRLLLEKAEAEASLVRAEAAWYAASEALEQAQLQTDMA

SEQ ID NO: 69330 - protein, 193 aa, Triticum aestivum
  misc_feature (69)..(69): Xaa can be any naturally occurring amino acid
  misc_feature (151)..(151): Xaa can be any naturally occurring amino acid
NPHPSRPPLDSISASSPSHARPELRPWGATIQSVKARQIFDSRGNPTVEVDVCCSDGTFARAAVPSGAXSTGVYEALELRDGGSDYLGKGVSKAVNNVNSIIAPALVGKDPTAQTELDNFMVQQLDGTKNEWGWCKQKLGANAILAVSLAXFCKAGASVQKIPLYQHIADLAGNKQLVLPVPAFNVIDGGSHA

SEQ ID NO: 69331 - protein, 481 aa, Metaporana parvifolia
  misc_feature (7)..(7): Xaa can be any naturally occurring amino acid
DSGSEVXAVEKKNLGRIVKIIGPVLDVAFPRGKMPNIYNALVVKGRETNVTCEVQQLLGNNRVRTVAMSDTDGLTRGMEVIDTGAPISVPVGGSTLGRIFNVLGEPVDNLGPVDTNTSSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSMMLQPRIVGEEHYETAQRVKQTLQRYKELQDIIAILGLDELSEEDRLTVARARKIERFLSQPFFVAEVFTGSPGKYVGLAETIRGFQLILSGELDVLPEQAFYLVGNIDEATAKAMNLKT

SEQ ID NO: 69332 - protein, 527 aa, Clostridium perfringens SM101
MITVNNVSLRFGGRKLFEDVNLKFTPGNCYGVIGANGTGKSTFLKILAGEIEPNTGEVSIPAKTRVSVLKQDHYQYDDCEVLKTVIMGNPRLFEIMEEKDALYAKPDFSDEDGIKAAELEAEFADLDGWEAESEASSLLQGLGIGTELHYSHVRDLKGDEKVKVLLAQALFGKPDVLILDEPTNHLDIKAITWLENFLGNFEGTVIVVSHDRHFLNMVCTQICDVDFGKIKLYVGNYDFWYESSQLALQMAKDQNKKKEEKIKELQNFIARFSANASKSKQATSRKKLLDKITLDDIQPSSRKYPFVGFKPEREVGNDILEVNGISKTVDGVKLLDNVSFRVNKDDKIAFVGNERSITTLFKIINGEMEPDSGDYKWGVTITNAYFPKDNTEFFENCELNLVDWLRQFSDEKSESYLRGFLGRMLFSGEEALKQASVLSGGEKVRCMLSKLMLSSANVLTLDQPTNHLDLESITAVNNGLADYKSVLLFACHDHQFVETIANRIIELTPEGIKFDKVCTYDEYLETK

SEQ ID NO: 69333 - protein, 195 aa, Synechococcus sp. RS9917
MANLDQAPSRSMPNLLHVLPAFADEAELRLNTIVELNSNTVNKYELITETGHLKLDRVGYSSLAYPFAYGCIPRTWDEDGDPLDIEIVNVTEPLIPGSVVEARIIGIMTFDDGGEVDDKVIAVLADDKRMDHIRSVEDLGEHWKKETTYYWEHYKDLKKPGTCSVNGFFGTEKAVEIIKSCEARYMAEIDPKLVD

SEQ ID NO: 69334 - protein, 198 aa, Escherichia albertii
ARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGF

SEQ ID NO: 69335 - protein, 484 aa, Bonamia media
TSDSEVSAVEKKNLGRIVQIIGPVLDVAFPPGKMPKIYNALVVQGQDKEQTDVTCEVQQLLGNNRVRAVAMSDTNGLKRGMQVIDTGAPISVPVGGSTLGRIFNVLGEPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPGIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 69336 - protein, 224 aa, Mesembryanthemum crystallinum
MGEEVILLDFWPSMFGMRLRIALAEKGVKHERKEEDLLIGKSPLLLQLNPVHKKIPVLVHNGKPINESMIAVQYIDEVWNEKSPSLLPSDPYQRAQARFWADFIDKKLYDECRKIYTTKEAEIGEETYKGFLEIIKVLEAEVGEKSYFGGDTFGFVDVALIPFYSWFYALEMLGKFNIETECPKLIAWAKRCMERESVSKSLPDRHKIYDFITLQLRKALGVDQ

SEQ ID NO: 69337 - protein, 199 aa, Escherichia albertii
ARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGFS

SEQ ID NO: 69338 - protein, 490 aa, Itzaea sericea
  misc_feature (2)..(3): Xaa can be any naturally occurring amino acid
MXXNPTTSDSEVSAVEKKNLGRIVQIIGPVLDVAFPPGKMPKIYNALVVQGRDKEQTDVTCEVQQLLGNNRVRAVAMSDTDGLKRGMQVIDTGAPISVPVGGSTLGRIFNVLGEPVDNLGPVDTNTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 69339 - protein, 201 aa, Glycine max
MASSESTKQEGVVGGIGEKLIPLHENVLQKHAAFFDKNHDGVIYPWETFQGLREIGNGILSSVGLSLFINLALSQTTRPGKFPSLLFPIEIKNIQLGKHGSDTGAYDTEGRFVPSKFEGIFTKHSHTHPNALTYDELKEMLKANREPKDFKGRIGGLVEWKVLYKLAKDKNGLLQKETIRSVYDGSLFEMLKKENSARKKN

SEQ ID NO: 69340 - protein, 197 aa, Shigella boydii
HLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 69341 - protein, 344 aa, Vitis vinifera
MSMASLPHIDDDDDFGGDFSGGHNGRRSGNKRGFGDLEDDEDDIFSNKKGSFKLEETAPGVATGMILSLRESLQNCKDTLATCQTELEAARSEIQKWHSSFQNDSFIPAGTSLEPKLVVNYLQTLKSSEESLREQLEKAKKKEAAFIVTFAKREQEIAELKSAVRDLKAQLKPPSMQARRLLLDPAIHEEFTRLKNLVEEKEKKVKELQDNVAAVNFTPQSKMGKMLMAKCRTLQEENEEIGNIASEGKMHELTMKLALQKSQNAELRSQFEGLYKHMEGLTNDVEKSNEMVLILQEQLEEKDSELKRLKEELEQKTQMEAENNDSASDKKVSDDATIPVEDGN

SEQ ID NO: 69342 - protein, 192 aa, Shigella boydii
TMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIV

SEQ ID NO: 69343 - protein, 201 aa, Triticum aestivum
MMSRERKKAAALQEKLQLLRSLTHSHALSNTSIIMDASKYIKELKQKVVMLNQEIACAAQDSCSRQTTYPTVNVETLGHGSFLVNVLSDKSCPGLLVSILEAFDELGLSVLQATASCADTFRLEAIGGENLMENVDEHVLKQAVLRACSSHSGGGKANIAQASRSPPSPSSVKHLNNIYCLIWSNDSLLISLPCSSPVIVE

SEQ ID NO: 69344 - protein, 392 aa, Lactococcus raffinolactis
MSTKEMKQEVTEKFTALFGDGATANYFSPGRINLIGEHTDYNGGYVFPAAISIGTFGVARKRTDSLVKVYSLNFETVGVIEFSLEDELVNTPEANWGNFVKGYLLKLKEAGHAIQTGFELVIEGTIPNGSGLSSSASLELLVGTVVNDLYHLGLDKLTLVQLGQKVENEFIGVNSGIMDQFAIGFGEIGKAILLDTNTLKYELVPAEFGDYKIVIMNTNKRRELADSKYNERRAECEEALKRLQTKLEITALGQLTPTEFEENRALIGDVTLEKRAKHAVYENERTKLAKTCLEAGELQAFGQLLNASHESLKNDYEVTGIELDTLTETAQGLPGVLGARMTGAGFGGCGIALVKTSDIEAFISKMSATYLEKIGYDASFYVATIADGARKL

SEQ ID NO: 69345 - protein, 396 aa, Haemophilus somnus 2336
MFENINAAPADPILGLGEAFKSEMRANKINLGIGVYKDANGNTPIMKAVKEAENRLFELETTKNYLTIDGIAEFNSYTKELLFGTNSKIIKQGRAKTVQSLGGTGALRIAAEFIKRQTTSQNVWISSPTWPNHNAIFNAVGMTIREYRYYDAEKKALDWDNLIADLSNASEGDVVLLHGCCHNPTGIDPTPEQWKILAEMSEKNGWLPLFDFAYQGLANGLEEDAIGLRTFAENHKELLVASSYSKNFGLYNERVGAFTLVAETEEISAIALTQVKSIIRTLYSNPASHGATAVSIILGDDLLRQQWESELTEMRNRIKRMRYQFVELLKEYGAKQDFSFIIEQNGMFSFSGLNAEQVDRLKEEFAIYAVRSGRINLAGVTEDNIRYLCESIVKVL

SEQ ID NO: 69346 - protein, 514 aa, Vitis vinifera
MSSTLEIEARDVIKIVLQFCKENSLHQTFQTLQSECQVSLNTVDSLETFIADINSGRWDAILPQVAQLKLPRKKLEDLYEQIVLEMIELRELDTARAILRQTQAMGVMKQEQPERYLRLEHLLVRTYFDPHEAYQDSTKEKRRAQIAQALAAEVSVVPPSRLMALIGQALKWQQHQGLLPPGTQFDLFRGTAAMKQDVDDMYPTTLGHTIKFGTKSHAEYARFSPDGQFLVSCSVDGFIEVWDHISGKLKKDLQYQADETFMMHDDAVLCVDFSRDSEMLASGSQDGKIKVWRIRTGQCLRRLERAHSQGVTSLVFSRDGSQILSASFDSTARIHGLKSGKLLKEFRGHSSYVNDAIFTNDGGRVVTASSDCTVKVWDVKTTDCLQTFKPPPPLRGGDASVNGVHLFPKNTDHIIVCNRTSSIYLMTLQGQVVKSFSSGKREGGDFVAACVSPKGEWIYCVGEDRNIYCFSYQSGKLEHLMKVHEKDVIGVTHHPHRNLVATYSEDSTMKLWKP

SEQ ID NO: 69347 - protein, 194 aa, Shigella boydii
MIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFS

SEQ ID NO: 69348 - protein, 475 aa, Zymomonas mobilis
MTEGLFPRGRKVRVVSTLGPASSTAEQIRDRFLAGADVFRINMSHGTHDEKKVIVDNIRALEKEFNRPTTILFDLQGPKLRVGDFKEGKVQLKEGQTFTFDQDPTLGDETRVNLPHPEIFKALDKGHRLLLDDGKIVVRCVESSPTKIVTRVEVPGPLSDHKGFNVPDVVIPLAALTPKDRKDLDFALKEKADWVALSFVQRVEDVIEAKELIKGRAPLLVKLEKPAAIENLESILAATDAVMVARGDLGVECLPESVPPTQKRIVERSRQLGKPVVVATAMLESMIKAPAPTRAEVSDVANAIYEGADGIMLSAESAAGDWPHEAVNMMHRIASYVENAPGYIERVRFTPTPAEPTTVDALAENASKTAETVGAKAIIVFTETGKTAQRVSRARPVAPILSLTPDAEVARRLGLVWGAQPVQVSTVKTLDEAKKLAAETAKKYGFAKAGDKLVVVAGEPFGKAGTTNIVDVIEA

SEQ ID NO: 69349 - protein, 311 aa, Exiguobacterium sibiricum 255-15
MKIYSLGEALIDLIPLDADNVTFQKNPGGAPANVAVGLARLGADSYFLGSVGDDSMGHFLKDTLHHYGVKTDHLVFDPEHKTGLVLVTNAADGERSFEFINSYRADMSFHEKDIPDSLAEADLLHIGSISLISGDAVEATRRAIEVAKSNNVPISYDPNLRESLWSDLDAARSTIRSVLPDAQIVKLAEEELTFLTGQTNLDEGAAELLAEYPIRLLAVTRGAEGSLLYTDRSMAEIQAISVDAIDTTGAGDAFMSGLLHQCAIRSFSFDWDETELQDIGRFAAISGGLAASVKGAMAALPTLDEVSRRLT

SEQ ID NO: 69350 - protein, 308 aa, Cicer arietinum
MAVPVIDFSKLNGEERAKTMAQIANGCEEWGFFQLINHGIPEELLERVKKVSSEFYKLEREENFKNSTTVKLLNDIAEKKSSEKLENVDWEDVITLLDNNEWPENTPCFRETMLEYRSELKKLAENIMEVMDENLGLPKGYIKKALNDGDEDNAFFGTKVSHYPPCPYPELVNGLRAHTDAGGVILLFQDDKVGGLQMLKDGEWIDVQPLPNAIVINTGDQIEVLTNGRYKSCWHRVLTSTDGNRRSIASFYNPPLKATISPAPQLAEKENQQVDDTYPKFVFGDYMSVYAEQKFLPKEPRFKAVKAI

SEQ ID NO: 69351 - protein, 341 aa, Salmonella typhimurium LT2
MKALSKLKAEEGIWMTDVPEPEVGHNDLLIKIRKTAICGTDVHIYNWDDWSQKTIPVPMVVGHEYVGEVVGIGQEVKGFKIGDRVSGEGHITCGHCRNCRGGRTHLCRNTTGVGVNRPGCFAEYLVIPAFNAFKIPDNISDDLASIFDPFGNAVHTALSFDLVGEDVLVSGAGPIGVMAAAVAKHVGARHVVITDVNEYRLELARKMGVTRAVNVAKESLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 69352 - protein, 807 aa, Vitis vinifera
MVELFLSSPKELEDFSTAILERKKSPNRLVVDEAVNDDNSVVSMNPATMEKLQFFRGDTVLIKGKKRKDTVCIVLVDEQCEEPKIRMNKVVRANLRVRLGDVVSVHQCPDVKYGKRVHILPIDDTIEGVTGNLFDAYLKPYFLESYRPVRKGDLFLVRGGMRSVEFKVIETDPGEYCVVAPDTEIFCEGEPIKREDEERLNEVGYDDVGGVRKQMAQIRELVELPLRHPQLFKSIGVKPPKGILLYGPPGSGKTLIARAVANETGAFFFLINGPEIMSKLAGESESNLRKAFEEAEKNAPSIIFIDELDSIAPKREKTHGEVERRIVSQLLTLMDGLKTRAHVIVIGATNRPNSIDPALRRFGRFDREIDIGVPDEVGRLEVLRIHTKNMKLSDDVDLERVAKDTHGYVGADLAALCTEAALQCIREKMDVIDLEDETIDAEVLNSMAVTNEHFQTALGSSNPSALRETVVEVPNVSWEDIGGLDNVKRELQETVQYPVEHPEKFEKFGMSPSKGVLFYGPPGCGKTLLAKAIANECQANFISVKGPELLTMWFGESEANVREIFDKARQSAPCVLFFDELDSIATQRGSSVGDAGGAADRVLNQLLTEMDGMTAKKTVFIIGATNRPDIIDPALLRPGRLDQLIYIPLPDEASRLQIFKACLRKSPVSRDVDLVALARYTHGFSGADITEICQRSCKYAIRENIEKDIERERKKTENPEAMEEDDVDDVPEIKAAHFEESMKFARRSVSDADIRKYQLFAQTLQQSRGFGSEFRFPDQPNNATAASTAADPFSSAAAAGDDDDLYS

SEQ ID NO: 69353 - protein, 212 aa, Zea mays
  misc_feature (183)..(183): Xaa can be any naturally occurring amino acid
MASLSLSSPPSLSSAHHNASTRLILRTPNSLKLRTPPHSLPAIRAITLTQDDLKRLAADKAVESVKSGMVLGLGTGSTAAFVVAKLGALLASGQLSDIVGVPTSKRTEEQARSLGIPLSVLDDNPRLDLAIDGADEVDPDLNLVKGRGGALLREKMVEAASDKFVVVVDDTKLVDGLGGSGLXMAVEGVQFCWKYNLDRLQELFREEVWKQN

SEQ ID NO: 69354 - protein, 385 aa, Physcomitrella patens subsp. patens
MRRLLLQGSPNVLSTPTPTSSQKLSKGVIYLVGFGLALVLVIAISISTIAYYCYKRRSTAVSPWKQGMSGQLQRMFDTEASLLRREEVEVACEDFSNIIGSSLDNIVYKGTLSNGTEIAATSMRVSVENWSSQKELSFRRKVEALERMKHPYLVNLVGYCSEEEPFTRILVFEYASNGTLRDHLHNKESEHLDWATRMRIIMGTAYGLSYMHHELVPPASHLDLDSNSIFLTDDYAAKVANFEVSKMSLARNERQKHSWARIASPDFESNIYSFGIRLLEVISGGVPHSELTGNLVDWANEYLSDPKMMWYMVDPSLKLYNHDDLVALCKIIQLCLASKNRRPSMRKITNMLTEVLKLSPEMVGPKSTALLWAALELQDDNPESQ

SEQ ID NO: 69355 - protein, 448 aa, Staphylococcus aureus subsp. aureus MRSA252
MHFIAISINHRTADVALREQVAFRDDALRIAHEDLYETKSILENVILSTCNRTEVYAVVDQIHTGRYYIQRFLARAFGFEVDDIKAMSEVKVGDEAVEHLLRVTSGLDSIVLGETQILGQIRDAFFLAQSTGTTGTIFNHLFKQAITFAKRAHNETDIADNAVSVSYAAVELAKKVFGKLKSKQAIIIGAGEMSELSLLNLLGSGITDITVVNRTIENAMKLAAKHQVKYDELSSLPNLLESADIVISSTSAQSYIITNEMIERIAENRKQDSLVLIDIAVPRDIEPGISAITNIFNYDVDDLKGLVDANLRERQLAAATISEQIPAEIHAHNEWVSMLGVVPVIRALREKAMAIQAETMDSIDRKLPGLSERERKIISKHTKSIINQMLKDPIKQAKELSSDKKSNEKFELFQNIFDIEAKCPHEQAKQQKESKVKEISARRIFSFE

SEQ ID NO: 69356 - protein, 196 aa, Staphylococcus aureus subsp. aureus MRSA252
MKVNPNNIELIISAVKEDQYPETELSEVALSGRSNVGKSTFINSMIGRKNMARTSQQPGKTQTLNFYNIDEQLIFVDVPGYGYAKVSKTQREKFGKMIEEYITKRENLQLVIQLVDLRHDPTQDDILMYNYLKHFDIPTLVICTKEDKIPKGKVQKHIKNIKTQLDMDPDDTIVSYSSIQNNKQQQIWNLIEPYIS

SEQ ID NO: 69357 - protein, 113 aa, Triticum aestivum
MCTLEKRGNLFLLTLTGDNEHRFNPDAIATILSLLAQAKSQAKRGSVLITTGHGKFFSNGFDLAWAQASGSLTGAAERLHQMVESFKPVVAALLDLPMPTIAALNGHAAAAGL

SEQ ID NO: 69358 - protein, 307 aa, Thermoplasma volcanium GSS1
MAIENKEILVTGGAGFIGSNLVARLSEKNHVYVLDSLQTGSLHNIDGLSNVEFIKDYAKNVSNYCINPDYIFHIGVYSSSPMYRSNPFLVSEAIHDMIAILELAKKSKTPVVFASTSSIYNGVKPPHRENVTPLVSDYYTEARISMERISELYSKLYDINISAMRFFSIYGYREMKKRMYANLVSQFLWDMHSKKSPIIYGDGEQRRDFVFVDDVVDALILAAEKSDGFQVYNVGTGVNYSLNELVQKLNKYLGSNIEPKYVENPMAKTYVHETLADTNKAEKMIGFRAKISLDEGIKRLISYYGYA

SEQ ID NO: 69359 - protein, 300 aa, Mannheimia succiniciproducens MBEL55E
MKGKTMKVIIPVAGLGTRMLPATKAIPKEMLTLVDKPLIQYVVNECIAAGVKEIVLVTHSSKNAIENHFDTSFELETMLEKRVKRQLLEEVRSICPKDVTIMHVRQGNAKGLGHAVLCGRPAVGNEPFAVVLPDVLLAEFTANQKTENLSAMIKRFNETGSSQIMVAPVDPKDVSSYGIADCNGAEFSGGESAVISRMVEKPSPEKAPSNLAVVGRYVFSATIWDLLERTPVGVGDEIQLTDAIDMLIAKETVEAFHMTGESFDCGDKIGYMKAFVEYGIQHEKLGNEFKNYLKAFAKTL

SEQ ID NO: 69360 - protein, 287 aa, Synechococcus sp. RS9917
MASDDALRVSVLSEALPYIQRFAGRRIVVKYGGAAMAHASLQEAVFRDLALLTSVGVRPVVVHGGGPEINHWLKKLEIPAEFRDGLRVTDPSTMDVVEMVLVGRVNKQIVNGLNRLGARAVGLSGSDGGLVQARPWGDGSHGLVGDVARVDPDVLEPLLEKGYVPVISSVAATSDGRAHNINADTVAGELAAALEAEKLILLTDTPGILRDRQDPESLIRQLRLSEARQLIAEGVVAGGMTPKTECCIRALAQGVAAAHIIDGRVPHALLLEVFTDAGIGTMVLGRG

SEQ ID NO: 69361 - protein, 197 aa, Zea mays
  misc_feature (30)..(30): Xaa can be any naturally occurring amino acid
  misc_feature (45)..(45): Xaa can be any naturally occurring amino acid
  misc_feature (75)..(75): Xaa can be any naturally occurring amino acid
  misc_feature (87)..(87): Xaa can be any naturally occurring amino acid
  misc_feature (174)..(174): Xaa can be any naturally occurring amino acid
MILLVGAMNFEEAMQMGSETYHHLKDIILXRMCSDSCNIGDHGGXAPNISSISEGLDLVIAAIERAGHNGRIKLXIDVAATDFCVGXWDDLLMSDPERIKRAVSEYTCNALVLKANQVGTVTEAIEVVKQANDAHWGVMVSHRSGDTEDSFIADLAVGAAAGQIKASVPCRGEXTKYNQLLRIEEELGSEGVYAGEN

SEQ ID NO: 69362 - protein, 538 aa, Cryptococcus neoformans var. neoformans B-3501A
MHGPVFISSLLHPSPVILSSNMSAEQAVASIPEESKEVELGPLPTVEGKSEVEVKELLTKAAKQVRFYFSDSNLPVDKYFFSLTCCNAEGWVPIKTISTFKRMKDFQSLGVPFVAYALRLSIKEDGNDPLVAVSEDGENVRRKRPLEKNTTAWDRSVYIKGFGEEETEANTQEKIEAYCDQFGKINAVRMRRGDIEGKGAAGKGKGQFKGSVFVEFAYEADAKKFAEQESIPKFTPDGPEMTFMSKDAYVKMKAKEKGIPEGDINRGGQSKSKPEGKFNAFREMERAKHGQLPSLAKIPDGVAIVGSRPEMKNLKAGENKKKRSREDDDEEREGKEARTDEPEPLVIEYNGASLECDRHTGKVLDRSKVAFEINSAVKFINHGENPDWKDLKAQVSNVIASPFLAFPPGSSSGTIAKSDNSVINDEEFEKLKEAKMTFGGAEVEWARMAEEEHRDFWYTRACFKGKQAAQALNEKEEKEKRGRGGRGGRGGGRGGRGRGGRGGRGGRGGKGGRGGRDGRDGKEDSSAGFPPKLATGEQ

SEQ ID NO: 69363 - protein, 240 aa, Oryza sativa
  misc_feature (29)..(29): Xaa can be any naturally occurring amino acid
  misc_feature (60)..(60): Xaa can be any naturally occurring amino acid
  misc_feature (85)..(85): Xaa can be any naturally occurring amino acid
  misc_feature (97)..(97): Xaa can be any naturally occurring amino acid
KHDIFLSLRTTAATPFSIRESTGSEPPIXSRLRRRPTGVQNPNPNPSEEEGVGGGGRRGXEMVYYALYWWADLDNLTNLQPRYGXCDDPTYPYYFKXLRCENCGAGQRPRATCVSLGEVVDLPNGRSTANLVQKCKLCGRDASIVMIPGLGTPLTIEQSQKGDRTCLMVFDCRGCEPIDFAFGNGWKAESLEGTSFDIDCSEGEFADYDEKGECPVGLGKLRSEFRVVKKQESRGKTKYV

SEQ ID NO: 69364 - protein, 265 aa, Klebsiella pneumoniae subsp. pneumoniae MGH 78578
MMTPIWLGTSWKMNKPLSQAMAWCETLAARMPEGCHPAIQPFVIPPFTAIQPVSHFLQTHQLPLLTGAQNMHEADQGAWTGEISAAMLAETGATLVELGHSERRAAFNESDAAINRKVHSALGHGLRPLICIGDSAEEKRWQVSRESVVRQMKIALYGLSHQQALRTLIAYEPVWAIGEHGTPASPQEAGVIHQALRQALCERFGHETGTRIPLLYGGSVTLQNAVELLRQQEINGLFIGRAAWDAQGYCDIVQRVTQEFILQAQ

SEQ ID NO: 69365 - protein, 182 aa, Shigella boydii
LFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMIGVAMIVGF

SEQ ID NO: 69366 - protein, 287 aa, Brassica napus
MNLDTQQHSVNVMLRQLSFIRSSLIPFSSYSPRTSPTPLTSIRSQTRATMSTTPIQNESTQQTQRPVQVAQRLEKFKTTIFTQMSILGNKHGAINLGQGFPNFDGPDFIKEAAIQAIKDGKNQYARAFGAPELNSAVASRFHQDTGLVIDPEREVTVTCGCTEAIAAAMLGLINPGDEVILFAPFYDSYEATLSMAGAKVKCITLRPPGFDIPLDELKAAVSSETRAILMNTPHNPTGKMFTREELEAIASLCIENDVIVFSDEVYDKLDFEMDHICIASLPGLYER

SEQ ID NO: 69367 - protein, 327 aa, Gloeobacter violaceus PCC 7421
MKAFVLAAGKGTRLRPFTDALPKPLMPVVNKPVMTHILALCRKHGFDQIVANLHYRGEKIAERFADGHRHGVELRYSWEEQLLGTAGGVRRQADFLAGDAFLVISGDVMTDLDLGALVRFHKQSGAVATMAVKEVGDPSRFGVVLTDPDGRVESFQEKPAKGSERSRLANTGIYVLEPEVFEHIPEAAFFDFGNDLFPLLVSKGAPVYAMRTGAYWSDVGTLSQYLYTHWELLTHPELKQRVGANTVVESGAVVSEQALIGSGCTIEKGARVLGYSCVSDGCTIRAGSVVVDSVVWTSARWGHKLKGDLVRSIWGDGMQVSLGLPNL

SEQ ID NO: 69368 - protein, 248 aa, Oryza sativa Indica Group
MAPKLHPAELTEGKCGRPLGLRFHNTSGNLYIADAYKGLMRVGPRGGEATVLATEADGVPFKFTNGVDVNQVTGEVYFTDSSTRFQRSQHEMVTATGDSTGRLMKYDPTTGYLDVLQSGMTYPNGLALTADRSHLVVALTGPCKLVRHWIEGPKAGTSEPFTELPGYPDNVRPDGKGGYWVALHREKTESPYGSDTHLLAVRIGRKGKILQELRGPKNVRPTEVIERGGGKLYLGSVELGHVAVVKAT

SEQ ID NO: 69369 - protein, 191 aa, Shigella boydii
KARHLTMIAIGGSIGTGLFVASGATISQAGPGGALLSYILIGLMVYFLMTSLGELAAYMPVSGSFATYGQNYVEEGFGFALGWNYWYNWAVTIAVDLVAAQLVMSWWFPDTPGWIWSALFLGIIFLLNYISVRGFGEAEYWFSLIKVATVIIFIVVGVMMIIGIFKGAQPAGWSNWTIGEAPFAGGFAAMI

SEQ ID NO: 69370 - protein, 350 aa, Oryza sativa Indica Group
MGAVLGTGRVGTLTRVALTVLVFLLLLPSHALAAAVAKDTSATLVETLPLPTTLVGPESVAFDKFGDGPYSGVSDGRILRWDGADKGWTTYSHAPGYNVAKCMAPKLHPAELTESKCGRPLGLRFHNTSGNLYIADAYKGLMRVGPSGGEATVLATEADGVPFKFTNGVDVNQVTGEVYFTDSSTRFQRSQHERVTATGDSTGRLMKYDPTTGYLDVLQSGMTYPNGLALSADRSHLVVALTGPCKLVRHWIEGPKAGTSEPFAELPGYPDNVRPDGKGGYWVALHREKTESPYGSDTHLLAVRIGRKGKILQELRGPKNVRPTEVIERGGGKLYLGSVELGHVAVVKAT

SEQ ID NO: 69371 - protein, 127 aa, Cryptococcus neoformans var. neoformans JEC21
MFRTLPLLRTARTALRQTAPVALRPQPLALSLRPLAARGYAAAAGLSKDDITVRILDVLKSFEKVDSSKLTNNASFTSDLGLDSLDAVEVVMAIEEEFAIEIPDAEADEITTVQDAINYVANTSEAH

SEQ ID NO: 69372 - protein, 365 aa, Clostridium perfringens SM101
MKLGMVGLPNVGKSTLFNAITKAGAESANYPFCTIEPNVGVVSVPDKRLDVLEKIYNTKKKVYTAIEFYDIAGLVKGASKGEGLGNKFLSHIREVAAIVHVVRCFDDENVVHVEGSVDPIRDIETINLELIFADLDVLERRMEKTMKLVRSGDKTAKFEYDVMERLKAHLEANKPARTLEATEDEEAFVKSLFLITSKPVLYACNISEDDMMEGNLDNEYVKKVRAYAETENSGIMVVCAKLEEELSGLDEEEKAEMLSEYGLEESGLDKLIQASYKLLGLMSYLTAGVQEVRAWTIKQGTKAPQAAGKIHSDIERGFIRAEVVSYDDLVECGSEAAAKEKGVYRLEGKEYVMKDGDIVNFRFNV

SEQ ID NO: 69373 - protein, 208 aa, Clostridium perfringens SM101
MKRPIFIGITGGTGSGKSTIAKEIYRQFGEECIAMIEQDSYYKDQSHLSMDDRVKTNYDHPNAFDNNLLVSHLESLLNGHCIQKPSYDFSIHNRIEDTTKVEPKEIVIVEGILILEDPRIRELLDIKIYVDTDADVRIIRRMVRDINERGRTIESVINQYLNVVKPMHNQFTEPTKKFADIIIPEGGHNKVAIDIIVAKIKEVLGKYE

SEQ ID NO: 69374 - protein, 205 aa, Pseudomonas syringae pv. tomato
MPVVFVAASKLPTPFAEFAMHGFIESATGREHVVLSLGDVADGAPVLGRVHSECLTGDALFSQRCDCGSQLEAAMRAIATEGRGVLLYLRQEGRGIGLMNKIRAYELQDGGADTVEANERLGFAADQRDYAICLPMLQHLGVQSLRLMTNNPRKVKALTDMGINVAERVPLHTGQNPHNRLYLATKAGKLGHMMGNEHQSEVGPA

SEQ ID NO: 69375 - protein, 145 aa, Synechococcus sp. RS9917
MLTALLRLTNTLLRAAATAALAATLCVALLLTACSGASASGLSGDYVEDTVAVAHRLQATIALPQDDADRPEAEAEARTLINDYMSRYRPRPQVNGLASFTTMQTALNSLAGHYNTYANRPLPEGLKERVDKELTKAERAAVRGS

SEQ ID NO: 69376 - protein, 354 aa, Arabidopsis thaliana
  misc_feature (165)..(165): Xaa can be any naturally occurring amino acid
MAPRIRSIGSYATQGKFSVDFFGDEFIVTVTSDPSVIGQWIHDVLRFSSRPLVVGVGVQWTPHPTSPPARYHSPVSYHSDSSPVTHHYDSPPVCYRSDSPPAQYCSVSPPARYSSDSPPAQYRSVSPPAQYRSVSPPALYRSVSPPARYRSVSPPVRYRSDSPPXAQFRSVSPPARYLSDSPLVRYRSVSPPARYLSVSPPARYRSVSPPARSDPPANTLQLCVGNRCIIIQLFYCNRVPHVLRRFLGDRNHTFVGFWNSQDAGKLKRSRHRLEIAELLDLRNHVVDSRGRGLKGRSFEVVVGECLGYRGVRLEKAIGMSDWSVYDLSYDQILQASIDVYVCSKLGFRNRLWEF

SEQ ID NO: 69377 - protein, 511 aa, Cryptococcus neoformans var. neoformans JEC21
MFARQPLSQNLLRPLSRPSSSFSRTSTIPKLAFLQSARGFASASEPYDVVIIGGGPGGYVAAIKAAQLGFKTACIEKRGALGGTCLNVGCIPSKAMLNNSHIFHQTQHDLKNRGIDVSGIQLNLPKMLAAKEASVKALTGGIETYLFKKNGIDYIKGEASFETANKLNVKLLEGGETQVEAKNVIIATGSEVTPFPGLEIDEERIVSSTGALELKEVPKKMVVIGGGVIGLELGSVWSRLGAEVTVVEYLGAIGAGMDGEIGKQFQKILTKQGFKFKLNTKVISGHREGDIVKLKVDSAKGGKEETIEADVVLVAIGRRPVTTGLNLEAIGVETDKRGRIIIDDEFNTSAKGVKCIGDVTFGPMLAHKAEEEGIAAVEILKTGHGHVNYDAIPSVVYTHPEVAWVGKNEEELKGAGVQYKIGKFPFAANSRAKTNQDSEGFVKFIVEKETDQVLGCHIIGPNAGEMIASATLALEYKASAEDIARTCHAHPTLSEAFKEAALASYDKTINF

SEQ ID NO: 69378 - protein, 359 aa, Nocardia farcinica IFM 10152
MAGQQGTDAVILVGGQGTRLRPLTLSAPKPMLPTAGLPFLTHLLARIAEAGITHVVLGTAFKAEVFEEHFGDGSDLGLEIEYVTESEPLGTGGGIRNVLPKLRHDTVMVFNGDVLGGTDLGAVLDTHHSTGADVTLHLVRVSDPRAFGCVPTDEEGRVTAFLEKTQDPPTDQINAGCYVFRREYIEKIPAGRPVSVEREVFPALLAEGARVQGHVDTSYWRDMGTPEDFVRGSADLVRGIAPSPALPGQRGESLVHPGAGVAPGALLIGGTVVGRGAEIGAGARLDGAVIFDGACVEAGATVERSIIGFGARIGPRALVRDAVIGDGANVGARCELLRGARIWPGVEIPDGGIRFSTDV

SEQ ID NO: 69379 - protein, 80 aa, Alexandrium catenella
VGHGIGEFFHGVPQVFHCRNSDNRKMQEGTTFTLEPVLTEGSQDWITWDDGWTVATSDRGRAAQFEHTLLITANGCEVMT

SEQ ID NO: 69380 - protein, 325 aa, Glycine max
MAVEKSGIAKDVFLLIGKTPIVYLNKIADGSVARVAAKLELMEPCSSVKDRIAYSMIADAEKKGLITPGQSILIEPTSGNTGIGLAFLAAAKGYKLIITMPASMSLERRTILLSFGAELVLTDPAKGMKGAVPKAEEILDKTPNAYILQQFENPANPKVHYETTGPEIWEGTRGKVDALVSGIGTGGTITGAGKFLKEKNPNIKLYGVEPVESPVLSGGKPGPHKIQGIGAGFVPGVLEVSLVDEVVQISSDEAIETAKLLALQEGLFVGISSGAAAAAAIKIAKRPENAGKLIVVIFPSFGERYLSSVLFESVRREAESLTFES

SEQ ID NO: 69381 - protein, 549 aa, Bdellovibrio bacteriovorus HD100
MKFSELNLDSQLLSAIQKLNYDDCTPIQEQAIPPVLDGKDVAGLAQTGTGKTAAFVIPVMERILRARPIQGEVTEEQKALIEKRAYKDWKPQNFVLILVPTRELAEQVQDNINKLSVDSGLRGFAIYGGTGYDKQKEALKNGVEFIVATPGRLIDLYKEHLVDLKQVRAIVFDEADRMFDMGFKDDMKYILQRVPRERQLLVFSATLNFDVLNTIYQFGSEPVEINISRDQAKADNVKDQIFHVGSDEKPQHLLSLLKVHNPKQAIIFTNFKMSVERIAKFLVENGVPAMAISSLLTQAQRNRVIEQFKAENDMNVLVATDVAARGLDIKGVDMVVNYELPMDSESYVHRIGRTGRAGTTGQAFSLVGDKDIESLGRIEDYLKHKIEIGYLENDQLLKDFKPMTSSYDGHYPKSLDRARAPREGGRGGDRGPRREGDRGPRRERGDRGPRQDRGPRPEGQQKSAQGAGAQQTQGGGQRPDSRPRRQEGGPKRPHDAKRGEQRQPRNDQARKPHGQQQPRQGASAKKRVPMAAQKSIGQKVAGFFKRLFS

SEQ ID NO: 69382 - protein, 273 aa, Alexandrium catenella
KYDSTLGIYDGTIVPDGDSLVIDGVKVALSHTRDPAEIPFAAHGADYVCESTGVFLTTEKVQPHLKAGAKKVVFSAPAKDDSHTIVMGVNQETYDSSMECVSCASCTTNGLAPLVKAINDKFGIKRGLMTTIHAMTASQPTVDGSSKKDWRGGRAASGNIIPSSTGAAKAVAKVIPDVAGKLTGMAFRVPTIDVSVVDLTCELDTPTSYEEICAEVKRRAEGDMKGFLGYCDEDLVSSDFETCTISSTFDSKAGIMIDPTFVKLVAWYDNEWG

SEQ ID NO: 69383 - protein, 256 aa, Exiguobacterium sibiricum 255-15
MNILMVGAGSMSESLVKGWLDSGISPQMITMTNRADRSRLFALAEQYGVRTTAEEQVDQFDVVVLAMQPDGVLDYIKQQTWRTDQLVVSVAAHITPAEIEAHISCGAVCAMPNTPVAFRTGMTGLWFGDLVSDEKRQQATALFGRVGETVETNAATMPYLMAAAGCSPAFFYEIVGAMTPVLTKAGFDASSARRIIAQAMKGSAELLLHEERPTEELIKDVAAPGGPTDRGVRVLREHDLAQAMYEALMESAREKN

SEQ ID NO: 69384 - protein, 497 aa, Staphylococcus aureus subsp. aureus MRSA252
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGGNDVATSPFTLVFKNAGFAFAASFMNAVILTSVLSAGNSGMYASTRMLYSMSKDKLAFETFGKTNKNGVPYMSLLVTAIIVVIIFVVQSVTEGAYQYIVAASGLTGFIAWVGIAVSHYRFRRAFDKQNYDKSKLKYTAKWFPFGPIFAAILCIVVIIGQDVDFIKTGDFNFSRFLITYMGIPVFLAFFIYHKLRYKTKKIPLEQVDLRQDVSMDEIKG

SEQ ID NO: 69385 - protein, 504 aa, Thermoplasma volcanium GSS1
MRPTVFSSKAVISSSSLSASLAGAKIIEKGGNIFDAAIAVSSVLSVTQNNLCGLGGDAFALVRYNGRVKGYNGSGKSSRNVNRGLYFELGYSRIPERGIYSAITVPGLVDLWNSLYLEYATMRFSDLISDAIKYAETGFYITRHYEESLIASSPILGQYNWSNQFMPYGKIPAEGDLFIQKDLAGTLREIAEEGPRSFYDGYLSDIIFKAMEKTNLLIDSKDLSDHKTLAANPVKSTYMDYDVFETAPNSQGATVNYWLALLEQKIQNKIPRPVDIVESGLEAYRWRSMFIGDPERMPFNGDLLSKGAGPYYNNPRVPEDKGDTTYFSISDANGNSISMIQSNYMGFGSGIIPEGTGFVLQNRGSYFTLDDKHHNSLEPRKRTFHTLAACIIEKDGELVYSLGTMGGDIQPQVQVQIITGLINQDLMPQEAIERPRWAFPATIYEQPSVLNVEDTSLINENETRLRINPMKYSSSFGTAQVTALLNGRVAGGSDPRGDGFSIPV

SEQ ID NO: 69386 - protein, 828 aa, Neurospora crassa
MYQGTDEFGLACRLVKRASLPSRSGLPGAVRLNKYTPSLERVDRSISMKEPLNNSSYTNRIRSWVNPKTHGAPGPVSLLPISNSPPITTTTTTDTTPTVGQNATLNDSSRGGNVPSAHEQPQTSTDSSSTGGHHKEDSSNGAKSPTAASHQAAGQGPELETTVSAAAQEQEQKQKPNVAVRFGKVLKQVLFHNKLVNLMLVFVPVGIVVSQLPGSSPGLIFAMNALAIVPLAGLLSYATESVALQVHHPVSKTVHMLTESVSFNVYSIALVKDELSIVQASLLGSILANLLLILGMSFLLGGLRFREQIYNSTVTQMSACLLSLSVISLVLPTAFHYSFTDVNDADKKTLKISRGTSVLLSHSYLYESTPQHIIDEESTPGPAAGWLDSSSSGSDSSTDSDSSDSDYSRETVSKRMKRVMRGGHRRRKSSIISNLTSESVVAGHERTPSFGTSDAVPGYDEATQEASSSRPALAVNLHSPTTDGNEEAVEDEKHHRRRHRYKRHMKKHRKHKHKKHHHNGSQECMNGQTIDENAEIQPDVAPTLLSPGEPRRVDFAVEPASSADNAQAETSAGRRPFPGLRGMSLRPVARNLAPAVFVTGPDSVNSPPASSGPVPRVRYGIRRTNSLPDRLSQSLYRPQGALMPSQIPMSAVVDGAIPDKDGDHPDDLSRVSAIILLLVSTVLVAVCAEFMVDSIHDLVETAKVPELFIGLIILPIVGNAAEHVTAITVAMKNKMDLAIGVAVGSSIQIALFITPLVVIIGWCMDKDMTLYFTLFETVCLFVSAFIVNFLVLDGRSNYLEGALLCATYVIIALVSFYSPNPTEPGQSA

SEQ ID NO: 69387 - protein, 384 aa, Debaryomyces hansenii CBS767
MVASKISNVAKTASLAAQALKTSGSANGRTLAQAGQYHALRMSGQRPASSSSGPQTMTVRDALNSAMAEELDRDDDVFLMGEEVAQYNGAYKISRGLLDRFGERRVIDTPITEMGFTGLAVGSALAGLKPICEFMTFNFAMQSIDQIINSAAKTYYMSGGKQPCNITFRGPNGAAAGVGAQHSQCYAAWYGSIPGLKVLSPYSAEDYKGLFKAAIRDPNPVVFLENEMSYGESFEMSEEALSSDFVLPIGKAKIEREGTDITLVSHTRNVMHCLQAAEKLESEYGVKAEVINLRSIKPLDTDSIIQSVKKTNHLVTCEAGFPAFGVGSEICAQIMESEAFDYLDAPVERVTGCEVPTPYAKELEDFAFPDVEIVMRASRKVLGL

SEQ ID NO: 69388 - protein, 293 aa, Magnetospirillum magnetotacticum MS-1
MLVEALPWLEEFAGALVVVKYGGNAMVDDALKAAFAEDMVFLRRVGLRPVVVHGGGPQISAMLDRLGIESEFRGGLRVTTPEAMDVVRMVLTGQVSRELVGLINAHGPYAVGLSGEDGGLLQAQRRHATVDGEPVDVGLVGDVVEVHPSAVQDLLDAGRIPVVSTIAPDLEDPTQVLNVNADTAAAALAVALGAKKLVVLTDVEGLYTSWPDRGSLVAQITRSELAALLPSLSAGMVPKMEACLRAVEGGVPAATVIDGRVPHSTLLEVFTTQGNGTMVVPDAAGAPAPALTT

SEQ ID NO: 69389 - protein, 341 aa, Staphylococcus aureus subsp. aureus MRSA252
MSTNIAINGMGRIGRMVLRIALQNKNLNVVAINASYPPETIAHLINYDTTHGKYNLKVEPIENGLQVGDHKIKLVADRNPENLPWKELDIDIAIDATGKFNHGDKAIAHIKAGAKKVLLTGPSKGGHVQMVVKGVNDDQLDIEAFDIFSNASCTTNCIGPVAKVLNNQFGIVNGLMTTVHAITNDQKNIDNPHKDLRRARSCNESIIPTSTGAAKALKEVLPELEGKLHGMALRVPTKNVSLVDLVVDLEKEVTAEEVNQAFENAGLEGIIEVEHQPLVSVDFNTNPHSAIIDAKSTMVMSGNKVKVIAWYDNEWGYSNRVVDVAEQIGALLTSKETVSAS

SEQ ID NO: 69390 - protein, 145 aa, Pyrus pyrifolia
MEQDFHAERFKEFLSEVTIMKRLRHPNIVLFMGAVTKPPNLSIVTEYLSRGSLYRLLHKAGAKETLDERRRLSMAYDVAKGMNYLHRRKPPIVHRDLKSPNLLVDKKYTVKVCDFGLSRLKANTFLSSKSAAGTPEWMAPEVHRD

SEQ ID NO: 69391 - protein, 130 aa, Zea mays
KKLTPLELCQVAGDDFLISDPEPIKRAVNEYPCNAFFFKANQVGPVPEAIEVVKQAKDAPWGGMVSHRSGDPEDFFFADLAVGASPGQIKTGAPSRGECFPNYNQLLRIEGELGSEGVFPGGNWGTVTPS

SEQ ID NO: 69392 - protein, 132 aa, Glycine max
  misc_feature (120)..(120): Xaa can be any naturally occurring amino acid
MHAKSAQSSFRDRTQEFHSITERLKKSGSGPNGPSSSTSSTRSEEQRSAIANQSEFNRRASKIGYGIHQTSQKLAKLAKLAKRTSVFDDPTMEIQELTGVIKQDITALNSARVDLQFLCXSRNESGNVSADP

SEQ ID NO: 69393 - protein, 320 aa, Methanosarcina mazei Go1
MVSARSLNSAVKKSGFETMKRDVLSITDLSREEIYELLESAADLKKKRKAGEPTEYLKHKSLGMIFEKSSTRTRVSFEVAMSDFGGHALYLNSRDIQVGRGETIEDTARTLSGYLHGIMARVMSHDTVEKLARFSTIPVINALSDREHPCQILGDFMTIMEYKNRFEGLKFAWIGDGNNVCNSALLGSAIMGMEFVIACPEGYEPGAEFLEKAKALGGKFSITDDPKTAAKDADIIYTDVWVSMGDEAEQEKRLKDFGSFQVNTELLGVAKPDVIVMHCLPARRGLEITDEVMDGPNSVIFEEAENRLHAQKALILKLMR

SEQ ID NO: 69394 - protein, 270 aa, Saccharomyces cerevisiae
EFAEIVFCAISSTEQVRGYGAHLMNHLKDYVRNTSNIKYFLTYADNYAIGYFKKQGFTKEITLDKSIWMGYIKDYEGGTLMQCSMLPRIRYLDAGKILLLQEAALRRKIRTISKSHIVRPGLEQFKDLNNIKPIDPMTIPGLKEAGWTPEMDALAQRPKRGPHDAAIQNILTELQNHAAAWPFLQPVNKEEVPDYYDFIKEPMDLSTMEIKLESNKYQKMEDFIYDARLVFNNCRMYNGENTSYYKYANRLEKFFNNKVKEIPEYSHLID

SEQ ID NO: 69395 - protein, 325 aa, Novosphingobium aromaticivorans DSM 12444
MKARQARIFRTGGPEVIEWVEVDLPAPGPGEVLVEHTAVGLNMIDTYHRSGVYPIQLPSGLGVEAAGQVVATGPGVVGIAAGDRVSTFGPDLGAYASARIYPADWLFRLPDSIDEATAAAATLKGCTVEFLVERCARVEAGMPVLVHAAAGGVGLLLVQWLKHVGATVIGTVSTEEKAQAALAAGADHVINYATDAVAPRVRELTGGKGVRVAFDGVGMATWEASLDSTGRRGLVVSYGNASAPVTGVGLGTLSQKGSLFVTRPTLYHYYADREEREAGAARVWDMIASGAVKVTIGQTRPLSEVAEAHADLEARRTTGSTVLLP

SEQ ID NO: 69396 - protein, 241 aa, Oryza sativa Japonica Group
TRPQEGELKLLGTWASPYVSRVKLALHLKGLSYEYVVEEDHFNNKSELLLSSNPVHKKVPVMIHNGKPICESLIIMEYLDEAFPDTAAPLLPADLHDRAVARFWAAYIDDKLVPSWKQAFSGKTGEEKAEGMRHMLAAVDALEAAMEWSYKGKPFFGGDAVGFLDVALGGLLSWLHGTEELCGAKILDAAKTPLLSAWARRFGEMDAAKVALPDVCKLVEFAKMKRVQLEAAMAATTVSRN

SEQ ID NO: 69397 - protein, 170 aa, Synechococcus sp. RS9917
MDLRSLPPSPSPGLVNLLVEIPAGSRNKYEYFADAGVMALDRVLHSSVKYPFDYGFIPNTLAEDGSPLDAMVIMEEPTFAGCLICARPIGVLDMHDTGHYDGKILCVPVADPRQRGITSIRQIAPNQLEDVAEFFRVYKNFEGRVTVIGGWRDADAVAPLLESCIRAAQA

SEQ ID NO: 69398 - protein, 579 aa, Methylococcus capsulatus str. Bath
MAEHLYPGFFSELLVLLLASLASVLLFQRLRLPDILAYLFAGGLVGPFGFGMVTNDANIHFLSELGLVFLMFELGLEFSVRQLLHLSRAVFGLGSLQMLLTLSVFASALFFALHWPIGATLVVAGSLALSSTALVVRELRSLKLINRHHAQLAVGVLIFQDLAALLGLILVPALAGNGERALHEQLLHVAEKGGILVVILTGAGKWLLPSIFHEVARSRSEEIFVLTVLVIILLSAWLTQAFGLSMALGAFLTGVMLGEGEFRHQVEVDIRPFKDILMGVFFASVGMQIDFGLLVEEGRIVLLGIVLLILAKSVVITLAARIMGESATTGSKTGIILAQASEFGLALITLGAQLGVLAPRIASLALAIVVGSLILAPWLIRYNFEISQWIGRLVGQKVSGRDREMSRIPPHLSDHIILAGYGRVGQMIAKFLKNNGIPFIALDPDGNRIKEGRAAGDPVIYGSCARIDLLRRCHMERARLAILTFKSLSEARRIITQIRRQGYTLPIVVRTQNEADHAELIAAGADYVIPEMLESSLVIAAEVLSLLGYSKTVVQPQIDAERALHAQIKEPAAPDPGEG

SEQ ID NO: 69399 - protein, 518 aa, Mycobacterium sp. KMS
MNGQSVGTTILTRRTFLAATLAASTAAMAACGKPTSVNPATDPIGAAEAARPHTGRTVTAALTPGPADIDLGGPVARTLAYNNIVPGPLIRANVGDELAISVTNGLNHPSSLHWHGIALRNDMDGATPATPNIDPSSNFTYRFSAPHPGTYWAHPHTGLDADYGLYAPVIIDDPAEPGGYDAEWIVVLDDWTDGIGSSPQQLYEGLRPISGVGGHSGGMPGMPGMPGMPGMSGTPGMPGVPGVGGVGASPLLGGDAGDVSYPFYLANGRIPAAPTTLTARPGQRIRMRIINAASDTAFRVALAGHRMTVTHTDGFPVVPTEVDALLIGMGERYDVLITTGDGVFSFVASAEGKNALARAILSTGAGAAPDPTFMPPELQRRVGTVGVFTAAPEAVLDVSRADVALSARLSGSMASYDWTINGRPFEDTVPLTVRQGQKATLTFANTTMMWHPMHLHGHTFQVIKPDGTPGPRKDTVIVLPMQELTVALAADNPGVWMMHCHNTYHQEAGMMTSLNYSP

SEQ ID NO: 69400 - protein, 274 aa, Physcomitrella patens subsp. patens
RFAGKVVIVTGGASGIGEATARLFAKNGAYVVIADINTKGGSQLSSELGSQAKFVHCDVKKEQDVAAVVDEAMSWKGKLDVYFSNAGFVGALGSIEELNLDDFDETLAVNLRGAVVGIKHATRAMKSVKSGAIVCTGSTASQMAGLGPHTYCASKTALKGLVRSTALELRSYGIRVNMVSPDATATPMFQRVMEDSTGKPHTLEQIKERMAKKALLPNRPLTPLDVANAVLFLCSDEAGYISGHNLLLDAARTVGLPVPAGFSHWFEGYSPILK

SEQ ID NO: 69401 - protein, 318 aa, Listeria monocytogenes EGD-e
MNKIANRQVMCEVLMKEATRNDSNLVVLTSDSRGSASLGAFAEKFPERLIETGIAEQNIVGIAAGLAHSGKRAFVASPACFLSMRSIEQVKVDVAYSDTNVKLIGISGGVSYGALGMSHHSLQDIAVTRAIPNLEVILPADRLETEAIFDYLLQSNRPAYVRLGRNAVEDCYAEKPVFQIGKAGTLREGNDVSILATGEMVRVALDASEELKLKGISARVLNFSTIKPFDQEVVKAALTETKLLISIEEHSIYGGLGAAVSEVVSSSPTSIRHLILGIPDEPAIAGTSQEIFDYYGLSATGIVATIMKNLPIIGDERR

SEQ ID NO: 69402 - protein, 442 aa, Synechococcus sp. RS9917
MTLRLLLVRHGLSSFNVERRIQGRNDLSVLTSEGEEQARRTGQALIDLRLDAVYSSPLQRAAATTAAILGVRSDHLQPVLDEGLLEVDLEPWSGLSADERAQRDPESYQAWRLRPEELELTRADGSRYRPIPDLMEQARRFLQTLLQRHPVDGDSTVLVVGHNAILRCLILVLLGEPERGFRRLQLDNASLSVFNLQPSGEGHSVQIECLNNSSHLGQPLPAKGKGARLVLVRHGETNWNRDGRFQGQIDIPLNANGHAQAEAARAFLAPVPLQRAYSSSMSRPRQTAEGILRSHPGVPLTVTGGLVEIGHGLWEGKLEAEIQAQWGDLLAEWKRSPHTVQMPEGETIQQVWERSVHTWTTIAASLDPEETALVVAHDAVNKTILCHLLGLSPADIWAVKQGNGGVTVIDMPVDPGQPAVVTCLNLTSHLGGVLDRTAAGAL

SEQ ID NO: 69403 - protein, 288 aa, Vibrio fischeri ES114
MWQAIAKQISEVTQQPFSISERESVNGGEINDCYMISNGSQRYFVKINEKAELPIFETEIESLTQLDKSDHIFVPSPIHIGTTKEHSFLVLNYLPTKSMDKDAFYELGVSLANHHLWGDQLEYGFDCDNYLGNVLQVNTWHRRWDCFFAEQRIGWQLQLLKEKGMVLGDIDTLVKNSKLILHNHQPKPALLHGDLWHGNIALSVKGPISYDPASYWGDAECDLAMVELFGGIQDSFFEGYESISSISEGFETRQHLYSLYHVLNHCNMFGGEYMFHAQQLIDKLNLNE

SEQ ID NO: 69404 - protein, 513 aa, Pneumocystis carinii
MGFLKTILKVLGIENFTLSFVIIILTFFFLLHIFPQLYQKDSSKPPVVFHWLPFIGSTIQYGMDPYKFFQKQKKKHGNIFTFILLGKKMTVALGPKGNDILFNGKLSSLSAEEAYTHLTTPVFGTDVVYDVPNHVLMEQKKFVKTGFTIETFRAYVPLIIEEVKTYLETSPIFGKDKLSGVSSLMKALPEITIFTASRTLQGKEVRSNFDASFAKLYHDLDGGFTPINFLAPWLPLPKNRLRDAAQKKMAQIYMNIIKQRRKTCQHEEKDMIWNLMNQHYKDGRKLTDKEIAHLMIAILMAGQHTSAATGCWALLHLAEKPEYIKLLLEEQKRVFGDNLDDLTYDNLKDMELLSYVIKETLRLHPPLHSIIRKVKSPILIENSPYIVPKNHYLLAAPGVSSVDEEYFENALEFIPERWKCEKNTEDSDKIDYGYGLVTKGAFSPYLPFGAGRHRCIGEQFAYMQLGTIITIFVHELEWTLPKNQITIPKPDYTSMVVLPERPSNIEWRRRQKR

SEQ ID NO: 69405 - protein, 601 aa, Arabidopsis thaliana
MAMPPPGNVTTPSEKLQFPPPANWIPDERDGFISWLRAEFAAANAIIDSLCQHLQAVGDHNEYESVIGSIHHRRLAWSQVLTMQQFFPVADVSYNLQQIAWKRQQQMPPQRHYNSDQVGKFGARRSGPGFNKHHGGGGGYRGADSMARNGHNFNGVNSDRVEHREEAKLASDVKALSVAEEKRDGSEKPRSDSKVEKKLEESETQEEIVKNHKCNSGSKDNSLISEQKQEENDKECPASMAKTFVVQEMYDAKMVNVVEGLKLYDKMLDANEVSQLVSLVTNLRLAGRRGQLQSEAYVGYKRPNRGHGREMIQLGLPIADTPPDDDSIKDRRIEPIPSALSDIIERLVSKQIIPVKPDACIIDFFSEGDHSQPHMFVPWFGRPISVLSLSECDYTFGRVIVSENPGDYKGSLKLSLTPGSVLLVEGKSANLAKYAIHATRKQRILISFIKSKPRNSNWGPPPSRSPNQHIRHPTGPPKHYPVVIPSTGVLPTPSHRPPNGAVQPIFIPPSPPLASPMPFPGGVPTGPPVWPLLPPHPRHQTAPQPRMPIPGTGVFLPPGSNQELADNSNGTEGKLDLKAKEEARNGFGEGECDGSNGKQSN

SEQ ID NO: 69406 - protein, 767 aa, Coprinopsis cinerea okayama7#130
MAVLKRLLTRRTLLYAAGGTLTTAGGLYYLSSSPGPSIPSSSKETRRPPPPWTPPSRAEMLNRLKASNSGNDEDVFDLLIIGGGATGAGVAVDAASRGLKVALVEQADFGSGTSSKSTKLVHGGVRYLQKAIFELDYQQYKLVREALHERRIFLQTAPYLSHMLPIMLPIYKHWQVPYYWAGCKLYDVLAGKENMESSYFLSKGKAMEIFPMLKSEGLVGAVVYYDGQHNDSRMNIALILTAIKHGATISNYTSVTSFTKDPTTNHLTGALVTDTLTSTSFPIRARGIINATGPFTDSLLALDNPAHKPIVQASSGIHITLPNYYSPRKMGLLDPATSDGRVIFFLPWEGNTIAGTTDTPWGQVRVGEEPKASEEEIRWVLDEVRSYLAPDIKVRRGDVLSAWSGLRPLVRNPNVDSDSADDGNGKTAGLVRSHVLHLSPSGLLTIAGGKWTTYRKMAEETVDEAVRVFGLEGRVRIIEAEILYAIRHEYAQTAIDVLARRTRLSSLNARAALHALPRVVEVMSEEMGWDGERRRREVREGVEFLEGSMGLVLGGGGGVGGKEGKEEVLKEVVEETLAKVRVPKRGSSWLGLGGIWSAWNTPSPSPSPPGGLTTPPGTTPSSSSPSSAIHPTHAYTRALFEPGELALLKTLFLSKATKVPVSGSLNHVNKSLFEEGMVESVLGVGDVLGVLRGGFEAQSSPYATVTQKEYEYVLKEAGLQGREWLNFEEFVEVCGNLKEVSSVAPPSKSTQRIRRLRIPVEKSGGGV

SEQ ID NO: 69407 - protein, 677 aa, Bdellovibrio bacteriovorus HD100
MTEPIQIKTKLAGNPSQEPQFKSFVKSKDGRQIPVADPNATRALVSLMDMNAVLGGAASHYGGPAALAELMSALHGHVFDVAARENKQWYDLFHIVNDAGHCENGLYALKANYKMAGLTLDSLKKFRSIESGLTGHGEVHCFPEGVFISNGPLGSAFPQTQGVAMGEAISGKNRVTVTTISDGACMEGEAKEAFAAIPGLAKTGKMGPYVLIISDNNTKLSGRIDAESFSMTPTFNSLKDLGWNVINLAEGNDLQKCYDTIVSAIEQAKANPIAPVIIHAKTVKGIGTKKTAESATGGHGFPLKSPSELPAFLGEILGGAALPDVFNTWIAELNKWEADIKASGVKDSGEKIQVGISSAMVRARKAGFPVLSVTSDLPGSTGVAGFRKEFPQDSFDVGIAESNMVSTAAGLSKLGYIPVVDTFAQFGVTKGALPLTMGALSEAPVIAVFSHTGFQDAADGASHQALSYVAMVSSIPHVDVYSLSCSEEADALMYTVIENFAKARKEGKVPNSAVFFLGRENFPKTYVAGTSYDLRKAQVLADTTAGKTKSVAIATTGSLVPQALQAAKDLESKGVGAVVVNCACVNHVDIATFKTVLEKTQGHLITVEDHQLLGGFGQILTHALMNADVTFKVKSLGVHGEFGQSAYTAADLYRKHKVDASAIVETTGTFFQKSGAW

SEQ ID NO: 69408 - protein, 545 aa, Geobacter sulfurreducens PCA
MIHLSNITKQHGNQLLFRDASFQILPGSRTGLVGPNGAGKTTIFRIITGEEEVDAGEITCAKRTSIGYFSQDVGEMAGRTALEEVMAVSAETVRLAAELKEMEAAMAEPMDDDAMAALLERYGTAMEEFEHRGGYDLDTRARTILTGLGIGPDRYDHPVESFSGGWKMRIALAGILTLQPDVLLLDEPTNHLDVESIIWLEEWLAGEFTGALLMTSHDRDFMNRIVTRIIEVADKTVTTYGGNYDFYERERDIRREQLLASHKRQQEMLAKEEEFIARFAARASHAAQVQSRVKKLEKIDRIEIPPEERVIRFEFNDPPRSGDDVAVFNGLAKSWSLPGGGEKSVFSGVSGVIRRQNKIAVVGVNGAGKSTFLKVLAGRTEPTDGSVALGANVSLGYFSQHAMELLDPKKTVFETVQDAMPLATIGVIRNLLGAFLFSGDAVDKRIENLSGGEKSRVVLATLLARPLNFLVLDEPTNHLDIRSREILLDALQNFTGTVVLVSHDRHFLRLLVDRVFEIDHGEMRIYEGNYGYYLEKSQQLHLAAC

SEQ ID NO: 69409 - protein, 345 aa, Oryza sativa Japonica Group
MEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 69410 - protein, 181 aa, Oryza sativa Japonica Group
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIASKA

SEQ ID NO: 69411 - protein, 219 aa, Escherichia coli
  misc_feature (1)..(1): Xaa can be any naturally occurring amino acid
  misc_feature (42)..(42): Xaa can be any naturally occurring amino acid
  misc_feature (90)..(90): Xaa can be any naturally occurring amino acid
  misc_feature (92)..(92): Xaa can be any naturally occurring amino acid
  misc_feature (138)..(138): Xaa can be any naturally occurring amino acid
  misc_feature (174)..(174): Xaa can be any naturally occurring amino acid
  misc_feature (182)..(182): Xaa can be any naturally occurring amino acid
XTQDELKKAVGWAALQYVQPGTIVGVGTGSTAAHFIDALGTXKGQIEGAVSSSDASTEKLKSLGIHVFDLNEVDSLGIYVDGADEINGHXQXIKGGGAALTREKIIASVAEKFICIADASKQVDILGKFPLPVEVIPXARSAVARQLVKLGGRPEYRQGVVTDNGNVILDVHGXEILDPIAXENAINAIPGVVTVGLFANRGADVALIGTPDGVKTIVK

SEQ ID NO: 69412 - protein, 422 aa, Staphylococcus aureus subsp. aureus MRSA252
MTAEKITQGTEGLNVPNEPIIPFIIGDGIGPDIWKAASRVIDAAVEKAYNGEKRIEWKEVLAGQKAFDTTGEWLPQETLDTIKEYLIAVKGPLTTPIGGGIRSLNVALRQELDLFTCLRPVRWFKGVPSPVKRPQDVDMVIFRENTEDIYAGIEFKEGTTEVKKVIDFLQNEMGATNIRFPETSGIGIKPVSKEGTERLVRAAIQYAIDNNRKSVTLVHKGNIMKFTEGSFKQWGYDLALTEFGDQVFTWQQYDEIVEKEGRDAANVAQEKAEKEGKIIIKDSIADIFLQQILTRPAEHDVVATMNLNGDYISDALAAQVGGIGIAPGANINYETGHAIFEATHGTAPKYAGLNKVNPSSVILSSVLMLEHLGWQEAADKITDSIEDTIASKVVTYDFARLMDGAEEVSTSAFADELIKNLK

SEQ ID NO: 69413 - protein, 116 aa, Arabidopsis thaliana
MRGLSTKPVAIIIAILTVHFLFAAVTSQSSGDFVPIESKCNGTIAECSLSTAEEEFEMDSEINRRILATTKYISYGALRRNTVPCSRRGASYYNCRRGAQANPYSRGCSAITRCRR

SEQ ID NO: 69414 - protein, 605 aa, Lycoris aurea
METSIGSVDAAKPAPNGMVGSPPSATAHPITPCLPAAAIPSECTLGGHVARRLVQVGVRDFFGVPGDFNLTLLDHLIAEPGLNYVGCCNELNAGYAADGYARAHGVGACVVTFTVGGLSVLNAIAGAYSENLPLICIAGGPNSNDFGTSRILHHTIGLPDFSQELRCFQTITCFQAVVNNLEDAHELVDTAISTALKESKPVYISISCNLPGIPHPTFTPEPVPFSLSPRVSNKMGLEAAVEATVAFLNKAVKPVMVGGPKIRVAKAGDAFVELANASGYAVAVMPSAKGLVPETHPRFIGTYWGAVSTAFCSEIVESSDAYIFAGPIFNDYSSVGYSLLLKKEKAIIVEPDRVVVANGPAFGCVLMKDFLRELAKRLKKNTTAYENYQRIFVPEGQPLEAAPKEPIRVNILFKHIQKMLSGDTAVIAETGDSWFNCQKLKLPDGCGYEFQMQYGSIGWSVGATLGYAQAAKDKRVIACIGDGSFQVTAQDVSTMIRFGQNPIIFLINNGGYTIEVEIHDGPYNVIKNWNYTAFVEALHNGEGKCWTAKVFCEEDLKEAIETATGPKKGCLCFIEVIAHKDDTSKELLEWGSRVAAANSRPPNPQ

SEQ ID NO: 69415 - protein, 453 aa, Staphylococcus aureus subsp. aureus MRSA252
MAEKLQRELSNRHIQLIAIGGAIGTGLFLGAGQTIALTGPSILLTYIIIGFMLFMFMRGLGEIIIQNTEFKSFADVTNTYIGPFAGFVTGWTYWFCWIITGMAEVTAVAKYVSFWFPEIPNWISALFCVLLLMSFNLLSARLFGELEFWFSIIKIATIIGLIVVGFVMILFAYKTQFGHASFTNLYEHGVFPKGASGFFMSFQMALFSFVGIEMIGVTAGETKDPVKTIPKAINSVPIRILIFYVGALAVIMSIIPWQQVDPDNSPFVKLFALIGIPFAAGLINFVVLTAAASSCNSGIFSNSRMLFGLSSQQQAPPNFSKTNKYGVPHVAIFASSALLLVAALLNYIFPDATKVFTYVTTISTVLFLVVWGLIIIAYINYSRKTPDLHKKATYKLFGGKYMGYLIFVFFIFVFGLLFINVETRRAIYFIPIWFILLGFMYLRYKRIAAKSNN

SEQ ID NO: 69416 - protein, 585 aa, Staphylococcus aureus subsp. aureus MRSA252
MRKTKIVCTIGPASESEEMIEKLINAGMNVARLNFSHGSHEEHKGRIDTIRKVAKRLDKIVAILLDTKGPEIRTHNMKDGIIELERGNEVIVSMNEVEGTPEKFSVTYENLINDVQVGSYILLDDGLIELQVKDIDHAKKEVKCDILNSGELKNKKGVNLPGVRVSLPGITEKDAEDIRFGIKENVDFIAASFVRRPSDVLEIREILEEQKANISVFPKIENQEGIDNIEEILEVSDGLMVARGDMGVEIPPEKVPMVQKDLIRQCNKLGKPVITATQMLDSMQRNPRATRAEASDVANAIYDGTDAVMLSGETAAGLYPEEAVKTMRNIAVSAEAAQDYKKLLSDRTKLVETSLVNAIGISVAHTALNLNVKAIVAATESGSTARTISKYRPHSDIIAVTPSEETARQCSIVWGVQPVVKKGRKSTDALLNNAVATAVETGRVTNGDLIIITAGVPTGETGTTNMMKIHLVGDEIANGQGIGRGSVVGTTLVAETVKDLEGKDLSDKVIVTNSIDETFVPYVEKALGLITEENGITSPSAIVGLEKGIPTVVGVEKAVKNISNNVLVTIDAAQGKIFEGYANVL

SEQ ID NO: 69417 - protein, 204 aa, Citrus unshiu
KLGDDEFGHMLVNILKQNNVKTEGVCFDNHARTALAFVTLKKNGEREFMFYRNPSADMLLKDSELNMGLIKQAKIFHYGSISLISEPCRSAHMAALKAAKDAGVLLSYDPNVRLPLWPSQDAARDGIKSIWNHADLIKVSDDEVNFLTKGGDAEKDDVVMSLWHDNLKLLLVTYGAKGCGYFTKKFKGRVPGFSVKTVDTTGAG

SEQ ID NO: 69418 - protein, 652 aa, Zea mays
MASISGAAAAPSSAACRLRLRRHILLRPSHLRLRAPHSIADLSRSSSSSSSAPTRAQPLGSRPENVGGVRAVEKDPIKLWERYVEWLYQHKELGLFVDVSRMGFTEDFLRQMEPRMQRAFAAMRELEKGAIANPDEARMVGHYWLRDPALAPNSFLRSKIETTLDRILAFSQDVVSGKVAATFSIFLFAYIPAIASAADFELHGMLGVHHLGGKYSNRHGRYIVQPIDAMYLIETFGTFLFVLMYYNKGFRIRFIDNTDPAGIDHQIAQLGPELATTLVIVISKSGGTPETRNGLLEVQKAFRDAGLQFSKQGVAITQENSLLDNTARIEGWLARFPMFDWVGGRTSEMSAVGLLPAALQGIDIKEMLAGAALMDEETRNTVVKANPAALLALCWYWASEGIGNKDMVVLPYKVTLLLLSRYLQQLVMESLGKEFDLDGNRVNQGLSVYGNKGSTDQHAYIQQLREGVHNFFVTFIEVLRDRPAGHDWELEPGVTCGDYLFGMLQGTRSALYANDRESISVTVQEVTPRAVGALVALYERAVGLYASLVNINAYHQPGVEAGKKAAGEVLALQKRVLTVLNEATCKDPCEPLTIDEIADRCHCPEDIEMIYKIVQHMAANDRAIIAEGSCGSPRSVKVYLGECNVDEDLQAA

SEQ ID NO: 69419 - protein, 588 aa, Brassica napus
MSLPETKSQTLLDAWDFQGRPADRSKTGGWASAAMILCIEAVERLTTLGIGVNLVTYLTGTMHLGNATAANTVTNFLGTSFMLCLLGGFIAHTFLGRYLTIAIFAAIQATGVSILTLSTIIPGFQPPRCPTTSSHCVQPSGIQLTVLYLALYLTALGTGGVKASVSGFGSDQFDETEPKEQSQMTYFFNRFFFCINVGSLLAVTVLVYMQDDVGRKWGYGLCALAIVLSLSIFLAGTNRYRFKKLIGSPMTQVAAVIVAAWWNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 69420 - protein, 442 aa, Xanthomonas axonopodis pv. glycines
MLAEMPLLETALERELATLALGRRYGKVVELVGTMLKVAGVQVSLGEVCELRQRDGTLLQRAEVVGFSRDLALLAPFGELVGLSRETRVIGLGRPLAVPVGPALLGRVLDGLGEPSDGQGAIACDTWVPIQAQAPDPMRRRLIEQPMPTGVRIVDGLMTLGEGQRMGIFAAAGVGKSTLMGMFARGTQCDVNVIVLIGERGREVREFIELILGADGLARSVVVCATSDRSSIERAKAAYVGTAIAEYFRDRGLRVLLMMDSLTRFARAQREIGLAAGEPPTRRGFPPSVFAELPRLLERAGMGESGSITAFYTVLAEDDTGSDPIAEEVRGILDGHLILSREIAAKNQYPAIDVLASLSRVMSQIVPSDHSQAAGRLRRLLAKYNEVETLVQVGEYRQGSDAVADEAIDRIDAIRDFLSQPTDQLSAYESTLEQLASVTDDA

SEQ ID NO: 69421 - protein, 430 aa, Clostridium perfringens SM101
MKNLNLKGNPNRGLIGATLGFFIGFAAVSLYGPTSAVFKEAFVNLNPVLLALLIAAPNLSGSLLRIPFSAWVDTTGGRKPLIVLLLLSIIGMGGLYVVLAFFSDNLNQYYYLLFALGLLSGCGIATFSVGVSQASYWFPKSKQGVALGIYGGVGNLAPGIFALLIPNLALPLLGLPGSYLAWLIFLIVGTVIYIKIGQNAWYFQLVDKGINKDEAKEIASKDYGQELFPKGKASETLLISAKSWKTWALVFIYFTTFGGFLALTGWFPNYWMTYFGLNMKVAGLLTALYSILTSLTRIYGGKVADKNGGEITTIVSLGIALIGAICMTFASTMTLAIIGIILLAIGMGVANAAVFKIVPNAVPEAMGGASGWIGGLGALGGFLIPPVMASFLNRSGFAGYSQGFSVFIVLIIIAIGVIALFQALQKKSAK

SEQ ID NO: 69422 - protein, 331 aa, Cryptococcus neoformans var. neoformans JEC21
MTSMDLRVGGKYRIGKKIGSGSFGDIYLGVNIVSGEEVAIKLESVKAKHPQLEYESKVYKTLAGGVGIPFVRWYGTECDYNAMVLDLLGPSLEDLFNFCNRKLSLKTVLLLADQLISRVEYIHSRNFIHRDIKPDNFLMGVGKRGNQVNVIDFGLAKKYRDPKTHLHIPYRENKNLTGTARYTSINTHLGVEQSRRDDLESLGYVLMYFLRGQLPWQGLKAATKKQKYDRIMEKKMTTPTEVLCRGFPHEFAIYLNYCRSLRFDDKPDYSYLRKLFRDLFIREGFQYDYVFDWSLQPGVKSSGATGEDGLQAQDNQRQLRSQTKARDTGGW

SEQ ID NO: 69423 - protein, 280 aa, Oryza sativa Japonica Group
MYNNYGNSPGMQMPPIGQMPPAAGQMPSANPQPGQFGNPFYGASSGLIKTGLGAYGEKFLGSSSEFMQSNINRYFSNPQYYFHVNDQYVRNKLKVILFPFLHRGHWTRISEPVGGRLSYKPPIYDINAPDLYIPFMAFGSFIILAGFTLGFMGKFTPEAINLQFSRGLIGWALQIVILKGLLYSMGGGEVPLLDLVAYGGYLFAGLSLAVISRLLWAYSYFVMMPWMSLCMGVFLVRTMKRVLFTEMRSSERHSTRQHYFLLFLAISQFPLFFWLGNIGA

SEQ ID NO: 69424 - protein, 128 aa, Arabidopsis thaliana
MGNSVRSNLRDIRGRRSMDPRMWHKVAAISGMAALGLGTYGAHVFKPENPSYKQVWQTASLYHLVHTAALVSAPSTKYPNIFGGLLTAGIVAFSGTCYMVALREDRKFSTLAPFGGFAFIAAWATLLF

SEQ ID NO: 69425 - protein, 416 aa, Klebsiella pneumoniae subsp. pneumoniae MGH 78578
MESKVVVPAEGQKITLQNGKLNVPHNPIIPFIEGDGIGVDVTPAMLKVVDAAVEKAYKGERKISWMEVYTGEKSTHVYGQDVWLPAETLDLIRDYRVAIKGPLTTPVGGGIRSLNVALRQELDLYVCLRPVRYYQGTPSPVKHPELTDMVIFRENSEDIYAGIEWKADSAEADKVIKFLRDEMGVKKIRFPEHCGIGIKPCSEEGTKRLVRAAIEYAITNDRDSVTLVHKGNIMKFTEGAFKDWGYQLAREEFGGELIDGGPWVKIKNPNTGKEIVVKDVIADAFLQQILLRPAEYDVIACMNLNGDYISDALAAQVGGIGIAPGANIGDECALFEATHGTAPKYAGQDKVNPGSIILSAEMMLRHMQWFEAADLIVKGMEGAIAAKTVTYDFERLMEGAKLLKCSEFGDAIIANM

SEQ ID NO: 69426 - protein, 409 aa, Clostridium perfringens SM101
MKKLNVIGLGYIGLPTALSFAGVGIAVIGTDYNKEIVDTLNNGKVTFKEDGLYDLYKEALNKGVEFSSEYAKTNKYIITVPTPYIKESKKLDAQYVISAVESVLDVCDKGTILVIESTVSPGTMDKFVRPIVENRGFKIGEDIHLVHAPERIIPGNMVNELKNNSRTIGADNIEIGYEVKRWYETFCEGEIVVTDIKTAELSKVVENTFRDINIAFANELSRICRKENIDVYKLINIANKHPRVNILTPGPGVGGHCISVDPWFLVGDYPEIVNIIKAAREVNDSQPDFVIDRIRDVMNENGITDISKVGLYGLTYKENVDDLRESPTLQILEKLERYFVKGIKLYDPWIEEKKFENQYNNFNEFLDDVELVVLLVAHDHIKEFKDMLNEKIVLDTKNILKLSKNIYTL

SEQ ID NO: 69427 - protein, 284 aa, Triticum aestivum
  misc_feature (91)..(91): Xaa can be any naturally occurring amino acid
MATSAMTLAMAAATDASLFHPTFLAQHKLAPASASLPLIFSRAPLLRSTRPRVPLTPLVASSDAAEAGLDWADAEEAEETVTEEEPAVAAXSGGDAGYAAEPPEEAKVYVGNLPYDVDSERLAQLFDQAGVVEVAEVIYNRESGQSRGFGFVTMSTIEEADKAIETFNRYDISGRLLNVNRAAQRGSRVERPPRQFASSFRAYVGNLPWQAEDSRLVQLFSEHGEVVNATVVYDRETGRSRGFGFVTMASKEDLDSAISALDGQEMDGRPLRVNVAAERPQRGF

SEQ ID NO: 69428 - protein, 602 aa, Rhodococcus sp. RHA1
MSTVVDALIGKVFAATRENRSGELADYIPELAAVAPDSFGICIATVDGYVYEVGDTRLPFTIQSISKPFTYALALADRGSDAVAEKIDVEPSGEPFNEISLDPRTERPRNPMINAGAITAASLVAGPDVDTRFERIRAEYSRYAGRDLTFNRSVYESESRTGHRNRAIGHMLRSFGIITGDPDETVDLYFRQCSIDVTCRDLSLMAATMANNGVNPVTRDTVLEPALVERVLSVMSTCGMYDAAGKWVYEVGLPAKSGVGGGIVAVLPGQIGIAVYSPRLDAHGNSVRGVEACRALSNDLELHFLHVTRAARSAIRATYSVVDSPSRMRRTPAERAALDDVGKRSRIYELHGDLLFAGAESAVREIGGVENELEVVVIDVRRVDDVGGIARRMLESLRDELTRRGCAVALVDPAALLGYTHSDLTGASGRVFADLEAALQWSEDTLLDRHCAALRQPATIDVAHHPVLAGLRPEQLRLLTRELDIRTFARDEQIIQRGDRACGLFLILSGRVSMRVTDSGGAVYRIMTLSTGMTFGEMTMLLDLRFLNDVCADSEVTVAVLPADRYADMAVTEPGLKLALLERLAAGAYEQLDVMLRSLLRP

SEQ ID NO: 69429 - protein, 513 aa, Bacillus anthracis str. Ames
MIDQKQQSNTFEERVETIKRGGAPKYHEQNKAKGKLFVRDRLALLFDNGEYVEDALFANCEETGLPADGVITATGKIHGRTACVMANDSTVKAGSWGARTVEKILRIQETAEKLRVPLFYLVDSAGARITDQVEMFPGRRGAGRIFYNQVKLSGKVPQVCLLFGPSAAGGAYIPAFCDVVMMVEGNASMYLGSPRMAEMVIGEKVTLEEMGGARMHCSISGCGDVLCKTEEDAITQARQYISYFPNNYLEKTPLVTPQEPKQFDKTLEQIIPENQNAPFNMKDLINRVIDEGSFYEVKKLFAQELITGLARIDGKPVGIIANQPRMKGGVLFHDSADKAAKFINLCDAYHIPLLFLADVPGFMIGTKVERAGIIRHGAKMISAMSEATVPKISIVVRKAYGAGLYAMAGPAFEPDCCLALPTASIAVMGPEAAVNAVYANKIAALPEEERDSFIAEKREEYKKDIDIYHLASEMVIDGIVHPNNLREELKGRFEMYMSKYQVFTDRKHPVYPV

SEQ ID NO: 69430 - protein, 649 aa, Rhodococcus sp. RHA1
MGVLARIQTPDDLRQLNSAEMKQLAAEIREFLVQKVAATGGHLGPNLGVVELTLALHRIFDSPADPIIFDTGHQAYVHKILTGRKDDFDSLRKQGGLSGYPCRAESDHDWVESSHASASLSYADGLAKAFELTGQDRHVVAVVGDGALTGGMCWEALNNIAAGKDRSVVIVVNDNGRSYAPTIGGLADHLAALRLQPGYERILDSGRRMVKKLPWVGRTAYSVLHGMKAGLKDAVAPQVMFTDLGIKYLGPVDGHDEAALESALRRAKAFGGPVIVHAVTRKGMGYAPAENHVADQMHSTGVIDPITGRGTGSASADWTSVFSAELIDQASHRQDIVAITAAMAGPTGLAAFGEKYPDRMFDVGIAEQHAVTSAAGLALGGLHPVVAVYSTFLNRAFDQLLMDVALLKLPVTLVLDRAGITGNDGASHNGMWDMSLLGIVPGMKVAAPRDTATLREELDEALAVDDGPTALRFPKGTVGDDVPAVSRLDGVVDILRAPSGRNDVLIVSVGAFAGLALAAAERLEQQGISATVVDPRWVLPVPESLVKLAEDYTMVVTVEDSGLHGGVGSTVSAALRAAGVDVPCRDLGVPQQFLDHASRAQIHAELGLTAQDVARQITGWFAGLGNLRPEQQNGVVADLDAQRAEKQQG

SEQ ID NO: 69431 - protein, 465 aa, Rhodococcus sp. RHA1
MTQMSERHTAKVIGVTVAAAVGGFLFGFDSSVINGAVDSIQGHFELGSFFTGFAVAIALLGCAVGAWFAGRLADRWGRKKVMLLGSVLFVVSSLGAGLAFSVPDLMLWRVLGGLGIGIASVIAPTYISEIAPARYRGALASLQQLAITLGIFAALLSDAVLQNAAGGASNELWLNLEAWRWMFIVGVVPAVVYGILALLIPESPRYLVGKHLDQEAADILANITGELDPHERVSEIRLTLRHESTASFDDIRGPKFGLQPIVWVGIFMAIFQQFVGINAIFYYSTTLWKSVGFTENESFTTSVITAIINVGMTFVAILFVDRIGRRILLMVGSLGMFASLLMAAIAFSQASGSGDDVVLPSPWGAVALIGANLFVIFFASTWGPVMWVMLGEMFPNNMRAYALGISTAANWIANFTVTLAFPPLTRSVGLWFLYGLFAFFALLSFFFVRSKVRETKGMELEEMHT

SEQ ID NO: 69432 - protein, 577 aa, Bdellovibrio bacteriovorus HD100
MTKTKLLALSISLLALGCQSTSTSPVIRTAKERPDHSTAEAFGSQYAISTQGRYSSKAAERMFAEGGNIIDAVVAASFTVSVERPQSTGIGGGGFMLFHEAKTGDTYAIDFRERAPLKAHQNMYIGKDGKADSKLSQDGILAVAVPGLVAGLLEIHQRFGSLPLKQVMQPAIELAESGFEIYPEFHRALENRAEVLAKDPSAKAIFLTKDGKVPALGTMLIQKDLAKTLKLIAAKGKDGFYKGPVAQSILKYSKERKGLLSQKDFNDYQVKWRKPVEGKFHGYEVISMPPPSSGGVHVIQFLDFLEKDNLAKSGPLSTKSIHLAASALQSAFADRATYLGDPEFTDVPVSGLLSEKYLQERRSEVPENRARKAGEVSAGRATGYESTDTTHISMIDAKGNAVATTQTINGWMGAAVVAPGTGIVLNNEMDDFSAQVGASNLFGAIGGKPNAIAPKKTPLSSMSPTILLENNKPVMAVGAPGGTRIISCVAQTILNYVEFKLPLYDAVTMVRYHQQWQPDVLYVDPPGPKPEVLKQLNAMGYDVKIEPVPCYVMAVSKEGDKLHGVADPRDIGISIAK

SEQ ID NO: 69433 - protein, 259 aa, Vitis vinifera
MDRIVQWKNQLLQYVNQAQQWLQRMSSTPLYTTIGVVSLSTIVIFSIRWLKPRKSNTIILAGLSGSGKTVLFYQLRDGSSHQGTVTSTDTNEATFVLQTDPFWKGKRRLIHLVDVPGQSHLRSKLDKYLPQAAGLIFLVDGLEFLRHCPAIAEYLLDILTNTTVVKRKIPVLIVCNKTDKVTAHTKEFIQKLLEREIQKLRASGTAISEADIANEYTLGVTGEAFTFSQCCNMVTVEEASGLVGEISQVEQFITKHLKP

SEQ ID NO: 69434 - protein, 605 aa, Lycoris aurea
METSIGSVDAAKPAPNGMVGSPPSSTAHPITPCLPAAAIPSECTLGGHVARRLVQVGVRDFFGVPGDFNLTLLDHLIAEPGLNYVGCCNELNAGYAADGYARAHGVGACVVTFTVGGLSVLNAIAGAYSENLPLICIAGGPNSSDFGTSRILHHTIGLPDFSQELRCFQTVTCIQAVVNNLEDAHELVDTAISTALKESKPVYISISCNLPGIPHPTFTPEPVPFSLSPRVSNKMGLEAAVEATVAFLNKAVKPVMVGGPKIRVAKAGDAFVELANASGYAVAVMPSAKGLVPETHPRFIGTYWGAVSTAFCSEIVESSDAYIFAGPIFNDYSSVGYSLLLKKEKAIIVEPDRVVVANGPAFGCVLMKDFLRELAKRLKKNTTAYENYQRIFVPDGQPLEAAPKEPIRVNILFKHIQKMLSGDTAVIAETGDSWFNCQKLKLPDGCGYEFQMQYGSIGWSVGATLGYAQAAKDKRVIACIGDGSFQVTAQDVSTMIRFGQNPIIFPINNGGYTIEVEIHDGPYNVIKNWNYTAFVEALHNGEGKCWTAKVFCEEDLKEAIETATGPKKGCLCFIEVIAHKDDTSKELLEWGSRVAAANSRPPNPQ

SEQ ID NO: 69435 - protein, 168 aa, Burkholderia sp. 383
MIQVGDALPDAQLFEYIDDAREGCTLGPNAYSVRDQVAGKRVVIFGLPGAFTPTCSAQHVPGYVEHAEQLRAAGIDEIWCVSVNDAFVMGAWGRDLHTAGKVRMMADGSAAFTHALGLTQDLSARGMGIRSLRYAMVIDGGVVKTLAVEAPGKFEVSDAASVLATLTS

SEQ ID NO: 69436 - protein, 466 aa, Thermoplasma volcanium GSS1
MARSLRRNVLNFREVLFQGVAASAPAGAAVATMTGSAAFALGSLPLAAAVAFVIVFLNALIIRRISTHVAGPGGYYDYIKTGFGKEVGIFSGWVYILYQIAALAFISLSIAVFVPALLSYIYGISVPGNLWIPLLIGAAAFGYLVSFSGIRGSLRYVSVMGSLEIAVVVFIGLFIILSHPAINTPAVFTLKYDKFGVSGIALGVLFMYTAFSGFGGMTPLGEEAKNAKKLIGDAVIISSVILGVFFVFAAYAFTVGWGPSSMESYANNLVPGIKLAQVDIGLWAAILITIFYINSILTDNVTFSNSVARITLSMSRDGVLPRFLSEVHEKRKTPHFAGLVMVIASVIIGLLSVEFLGPFGGFLFTGVLSTLAALLVHMLANLSLPVIIKKKANKVGVLNVALPVTVTAILVYVFYGTFVSISTPVVAASISFGAWATFAAIFSVVRRNKILESEYISVNEVGEEAE

SEQ ID NO: 69437 - protein, 364 aa, Physcomitrella patens subsp. patens
GVAVYALGRGDLGQLGIGDYSDHPTPTSLSTLVGKDIVHIAASDYHTAFLTDEGEVYTTGSNDAGQLGVRGMEEQVVPIRVAALDTHMVTHIACGFKHTVAVTETGALASWGGDEYGQLGFDSGNIVDGVQPRIVKGSRDLHFSRVAAGGYHTLALTGSGDVYSFGDGSSGALGHGNLDGCSTPSLVKSLWGLGVTQIACGENHSAALTVDGKVFTWGRGKYGQLGHGSTQNIKLPVAVKALVDHDVIQIACGGDHTLAITSDGRLFSWGHGLWGQTGHGTKEDVLSPKQVHQLEGRVLVQVSAGARHTVVLLDRGEVYGWGDCEQRQLGTCDRCDFSTYGHICVSLCRCECVLMNTSCNLLTL

SEQ ID NO: 69438 - protein, 696 aa, Physcomitrella patens subsp. patens
MEVGEVSRDRRKLTYLIEDATVSPAKSLDIGLLQSIKALVRSSDANVRTAFDTLFDKLQRQHSQVRFLAVLLIDELFTRSKLFRSLLVPKFEMFMLLTIGYRDDFPLPKPPDRATLLRTTSMELVEKWNDTFGVHYKQVRLGYEYLKKTLRLQFPNLRAATALAEQQRQEKEARTQALILKKYESLCQNFSELRTEIHTTLDEIAECCKILELESASALEDNEPVLEADLESLVFGDDEYEEYGDSSLRRELHKEVPEQVAVTEKLKETTDNSALFETLRDLYKLVESNHLRTTQEWLSILTRVDVSDTRSRDAVLKEVIDLRTQLLGSLVKCESLGIDRTEKASTSRFTVGEVDDDIIWEPGDAEADKDLGEIASTSYAFNMEKESNNSLPSDKELHSSSAVTQSEAKKERAETGPRAELLEKAPILPYGSFLDSWGATSDVPANQRGLEMDNHWGRFDSEAMIPGDKIAEMNVRSSFYKPPEREIVPCRAPLKKGGLCPRRDLFRCPLHGPIIPRDDNGNPIRTLEIDTSAAKPADKAPMEEFSDINKEDFLSASSSSKNASSSITVADLAKEAIANVRERDEAEARKRRDEKVKAKRTQSKRDREHNDAVLRASALSGTCQELFGEEFDDVAKMRIGKKRARGGLTALLKKNPTVKERIAQRLLNGRARENAMNELARVEEARHRDAAANQWN

SEQ ID NO: 69439 - protein, 2493 aa, Oryza sativa
  misc_feature (1421)..(1421): Xaa can be any naturally occurring amino acid
MVSSSSPVVNVYPLANYTFGTKEPKMEKDTSVADRFARMKVNYMKEGMRTSVEAILLVQEHNHPHILLLQIGNTFCKLPGGRLKPGENEIEGLKRKLCSKLAVNSPSFPPNWQVGECVAVWWRPNFETVMYPYCPPHITKPKECKKLFIVHLSEREYFAVPRNLKLLAVPLFELYDNVQRYGPVISTIPQQLSRFQFNMWASGSPPTSPVSGVRRGACRRAPRKPLPPIAAHVPPFPAPTSTAIAMGKPKQQVLSRFFSPKPRPSAPATADDPPPPPRPPAEPPVAAVVSFSPAKRARALSVSPKTTAKRAKPSPPPSDYVRRRLLEPPRPPPPAAVNPSGKAYTPLEQQVVDLKARHPDVLLMVEVGYRFRFFGEDAAVAASVLGIIAHPDHSFLTASIPTFRLGFHVRRLVAAGHKVGVVRQTETAAIKAAHGGGAAGTPFARGLSAVYTRATIEAAAGELEGGGAPDEGSRYLVCVVDKEVDAMGTEGFEVKIGVVAIEVSTGEVVHGEFMDGVSRNGLEAVLLGLAPVEVILGTPISSATEKLMVAYAGPTSNVRVERTSRLCFSEGGALAELLSLFEKSGVDAPTVENGRHLMEMNEENNNPRGIEVPLSSSELTVIAPYDWVSICSLGIMAMPELVIHALALSVRYLKGFGMDRIICFGSSFQPFTANTEMSLSANTLQQLELTHPLCDRNQICTRHDAVSEISESIGSQQYSTNNLQDEVDMSCSSSVRSDLSTILSSVLRMLAGTLDIQRGITRIFHCKATAKEGTSNDTPFGLIILVVLDKDEFVGVVQAILTAGKQLQKLVLEDTDTMSSQHRTVHSPLLRRLINTASSCTVLANAATLVSCLNKDAADQGDMLNLFIASVDQFPEVAEGHATVEMAKQKLELLITEYRKQLGLPVDRKVPSSWMKVNSTKKTIRYHTPEVSKNLENLLLAKEKLAVICRTTWNNFLMDFGRYYAQFQATVKSLATLDCLYSLATLAKQNKYVRPNFVRENEASQIHIKDGRHPVLESLLGVNFVPNDTELHANSEYCQIVTGPNMGGKSCYIRQVALITLMAQVGSFVPASSATLHAVDGIYTRMGASDSIQHGTSTFYEELSEASNILHNCSSRSLVIIDELGRGTSTHDGVAIAYATLHYLLKEKKCMVIFVTHYPKILNILREFEGSVGAYHVSYLATRKLLEVADRQMVINNTETKDLGEITFLYKLVAGASDRSFGLNVALLAQLPSSCIERASVMAAKLQQELSEREKNKFCRLMDVPRESSPKELCAQPYQGLAEACHRILFNVTSAQSNDELTDTLSSLREAREIALKAIKGWGRVGMDLSRFTAPRPGLQIGAAGNGFRACSLRRLRYRVCGGNPMGASALGGCGSRSLFYLAPNHGSPLALRTRGRALRCQGNDSLAYVDGPLEGTNGSXVDNTEDEANSSGLDEEKGDDDAENLRDLLQKARKELEVARLNSTMFEEKAQRISESAIALKDRADKAQSDVSSAVTTIQEIISKEADAKEAVRTATMALSMAEARLQLASEALDAKRGSVGPMEVSIDDVEEEALASAQEEIKECQESLSKCEEELRRIQEKKMELQKEVDRLTELAERALLDASKAEEDVANIMVLAEQAVALEMEAAQRANDAELALQKAEKAISSVDAVVELPAPAEEQVSDEEDNVSEVYDYSSDAIDDIPERDEVSNVERLTVGDLAVEGIEQLESSREMSDDESTDKLLVEPQKEAEPDIDKSKQGKKQEIERKESQPSNAPKASLKRSSRFFPASFFSSKADGEFTPTSVFKGLMKSTRKHAPKLVVGIVLLGAGAFFLNRAEKSSQLFQQQEITTSIEEVTSTAKPIVREMRKIPQRVKKLIELLPHQEVNEEEASLFDILYLLLASVVFVPLFQKIPGGSPVLGYLAAGVLIGPYGLSIIRHVHGTKAIAEFGVVFLLFNIGLEDISAYHFLPAAFCGKAKLNEEVLATTAAVGMIAHRFAVLPGPAAIVIGSGLALSSTAVVLQVLQERGESTSRHGRATFSVLLFQDLAVVVLLILIPLISPNSSKGGVGFQAIAEAMGMAAVKAIAAITAIIAGGRLLLRPIYKQIAENRNAEIFSANTLLVIFGTSLLTARAGLSMALGAFLAGLLLAETEFSLQVESDIAPYRGLLLGLFFMTIFFLVQHRGFYYLLWNDDKSLILPVGMSIDPKLLLSNFPAISVILGLLIIGKTMLVTFIGRVFGISTIAAVRVGLLLAPGGEFAFVAFGEAVNQGLLSPQLSSLLFLVVGISMALTPWLAAGGQFLASKFEQHDVRSLLPVESETDDLQDHIIILGFGRVGQIIAQLLSERLIPFVALDVRSDRVAVGRALDLPVYFGDAGSREVLHKVGAERACAAAITLDTPGANYRAVWALSKYFPNVKTFVRAHDVDHGVNLEKAGATAVVPETLEPSLQLAAAVLAQAKLPMSEIAATVNEFRNRHLSELTELCATSGSSLGYGYSRVMSISKSKTVTSV

SEQ ID NO: 69440 - protein, 940 aa, Debaryomyces hansenii
MTWSQLELEKAHIAYACIGIFSTIFSLVSLFVKERLYIGEATVATIAGLILGPHCLGWFEPVTWGNSDYITLEICRIVLCIQIVAVAVELPRKYMKKHWLSVAIFLLPVMTCGWLVVGLFIWVLIPHFNFSSALLVSACVTATDPVLAAAVVGKGKFAERVPGHLRNVLSAESGCNDGMAFPFIFLSLNIILHPGNAGEIVKDWFLLTILWECFFGVALGVILGLLMRYAVAFAEKKGLIDRESFLAVFVFLAFNSAGIGSMLGVDDLLVSFAAGTAFGWNGDFAKKTEESHVSTVIDLILNLSFFVYFGAIVPWPEFNNAAIGLNVWRLIILALVIIFLRRMPAVLILKPFTPDIKSWREALFCGHFGPIGVGAIFAAILARKDLEAHFTSDETPLAHLPEKNFPHYQLLACIWPIVCFIVITSIIVHGSSVAVLTLGKRLNRMAITMSFTTTNTQDQGPSWMSRLQKLDKASTSFSLHRIDTQAPPSEKDDKLQQSNTVETSGIKVRPAGGAKRRKHKKKRDPRSRLKKSLSRASADSEADEVLTPQRHKPQAEFLQLGRTPSTAIRTPSDEESEPESAVGIDNSKEDFDDSPGSSNSIEVVANEDQGRMVFAVPPYDSHGRVEQDEDQDNGKVSFARNAMEGRKSVPSTAFQEGEKIIIEDQAGEVIETLPLKSLQGQPENEDDLSIHSMSSLSRQLSKYSTAQSDRTSTETSLNTKEKPGTPLGKLARSSTLSLGRKGKRKGYYKKNDPKHRKVFAHQVDNFIVIENADGDIIRRYKVNRHSANRARSNTGNSMVGKALNFVGLKKNNPKNNVNANDLEKNDIENVLIPEHDDKNNPNHPLKDPKFENAIESKLTKILLDDRSQSSNFLNVGNKSETIPEGSERGVSDDDYDTSSGSEETDEDEDEVLEETDIEKKRRLAALGQMPTHRRKEDEED

SEQ ID NO: 69441 - protein, 260 aa, Mannheimia succiniciproducens MBEL55E
MKKYYFGTNLKMYKGIADTTRFLAQLSELTHDIRANNDIELFVIPSYTAIQSAIQTTLATSHDNPIIIGAQNMNPNDNGQYTGDISPLMLKEIGTQLVMIGHSERRHKFGETDRQENEKVLSALKHDLTTLLCVGETLEQKNYNISDEVLRTQLKIGLSGINTNQLAKLRIAYEPVWAIGESGIPATADYANEKHAVIKQCLIELFGDAGKDIPVFYGGSVNAENSNELFGQQYIDGLFIGRSAWDAENFFKIIERIVNK

SEQ ID NO: 69442 - protein, 194 aa, Triticum aestivum
PVLDLRILSSSKPSYIKMTEKSAVHAIMGMLSSSIKAWHCAAAELIGRLIINPDNESFLVPVISQIYRRLVDLLSVPAFDAQAAAVSALYNVSEVNMDCRLKLASERWAVDRLLKIVKAPHPVSEVCRKAAVILESLVSEPQNRMHLLVHENNFAEILTSEGKYSDTFARILYELTARPSNKVTSGQAIWGNIN

SEQ ID NO: 69443 - protein, 311 aa, Gloeobacter violaceus PCC 7421
MVVLVTGAAVVDILVSAPQELPAPGASRLTDTIALAAGGCGVNTAIGLARLGVPVEFAAHLGADGAGEWIKAELSRAGVGLAHFRQSAEVATKSAVVLLSAAGERSFLRTRGGGNAIARADLEHLDWSGIGHLHIGGCYSLRRLLGEDLAAVLRSARRAGVVTCLDTVWSSDGNWEALLPALGQIDHLLPSLAEARAITGESTPQAMARWLIAHGSTRVIIKLGERGAYACGPDIDAVVPALPVPGGRVIDTTGAGDAFCAGYLAALAEGLTAPRAVRWANAWGAVAVSGLGATAALRDRSQLEALVVPTE

SEQ ID NO: 69444 - protein, 99 aa, Triticum aestivum
RFPVGDGTMDLVRAGHAVNRWIPEPALEFLWYDADRVLRPGGMLWVDHLWCRKGDLDGVYAAMLRRLGYKTIKWAVADKTGIGAKDELVYLTALLQKPF

SEQ ID NO: 69445 - protein, 544 aa, Listeria monocytogenes EGD-e
MAYSFKLPDIGEGIHEGEIVKWFVQPGDKIEEDESLFEVQNDKSVEEITSPVSGTIKEIKVAEGTVATVGQVLVTFDGVEGHEDDAEEESAAPKAESTESTPAPAQASGKGIFEFKLPDIGEGIHEGEIVKWFIQPGDKVEEDQSIFEVQNDKSVEEITSPVDGTVKDILVSEGTVATVGQVLVTFEGDFEGEASHESTPESPAEDAALANNDATSAPATGGNGTPSSKKDPNGLVIAMPSVRKYAREKGVNIAEVAGSGKNNRVVKADIDAFLNGEQPAAATTTAQTEEKAAAPKAEKAAGKQPVASSDAYPETREKLTPTRRAIAKAMVNSKHTAPHVTLMDEIEVTALMAHRKRFKEVAAEKGIKLTFLPYMVKALVATLRDFPVLNTTLDDATEELVYKHYFNVGIAADTDHGLYVPVIKNADKKSVFQISDEINELAGKARDGKLTADEMRHGSATISNIGSAGGQWFTPVINYPEVAILGVGRIAQKPIVKDGEIVAAPVLALSLSFDHRVIDGATAQKAMNNIKRLLNDPELLLMEV

SEQ ID NO: 69446 - protein, 645 aa, Brassica napus
  misc_feature (57)..(57): Xaa can be any naturally occurring amino acid
MSSSSSSSFRSPAGAAATLFSSDQKIRLGRLDVLRSSHSAFLGRRNPRGVVSVHPSXSPSPIQAVSSPSKPEAATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIRNMGSTLGACGDLNRNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNLYVGGGMGRTHRMESTFARLAEPLGYVPKEDILYAVKAIVVTQREHGRRDDRKYSRMKYLVSSWGIEKFKDVVEQYYGKKFEPSRELPEWEFKSYLGWHEQGDGAWFCGLHVDSGRVGGIMKKTLREVIEKYKIDVRITPNQNIVLCDIKTEWKRPITTVLAQAGLLQPEFVDPLNQTAMACPAFPLCPLAITEAERGIPSILKRVRAMFEKVGLEYEESVVIRVTGCPNGCARPYMAELGLVGDGPNSYQVWLGGTPNQTQIARSFMDKVKVHDLEKVFEPLFYHWKVDRETKESFGEFTTRMGFEKLKELIDTYKGGPQ

SEQ ID NO: 69447 - protein, 702 aa, Rhodococcus sp. RHA1
MTDIATAFADEVVTNAYTKIVAVPGIEGPVALITLDNGFDHTKPSSFGPGGLKALDAALDEAFAAHPVAIAITGKPFIFAAGADLKGVPSITNRDQALELGRLGHKVFRRLRESSVPTFAFVNGVALGGGLEVALHSHYRTASESAGALGLPETFLGLVPGWGGTQLLPNLIGPSNAVTVVLENALNQNKTLNPKKALELGVVDAVFGSADFLEQSFAWAAQVLAGEITPARPEIDRGKGWDDAIARAKAIVEGKTKNNAPGPVKAVELLELARTTDLTDPASLDKGFAAEDEALADLLLADELRAGLYAFDLVNKRAKRPAGAPDKSLARKVTGVGIVGAGLMASQLAMLFVRQLKVPVILTDIDQERIDKGVGYVHGEIDKLQGKGRLSPDAANRLKGLVSGSLDKAAFAKTDFVIEAVFENLDLKKKIFAELEEHIAPETILATNTSSLSITKMAADLKHPERVVGFHFFNPVAVLPLLEVIKGEKTDDATLATAFATAKALKKSAVGSADLPGFVFNRLLIRTLGEVMNAVDEGTPFEVADNAIAELGMPMTPFTLLALVGPAVALHTGETLAEAYPERFHNSPGLEALVEAKKSAVWSYGADGKQVVDPEVAELWKQGDKASTSEEVLERTRRAFAEEIQIMLDEGVVAAAEDIDLCLILGGGFGFWNGGITPYLDRTGTSEAVNGKRFLAPGVASV

SEQ ID NO: 69448 - protein, 146 aa, Pseudomonas fluorescens Pf-5
MKSVAELLKLKAKHNQQVHTIAPHQMVLEALMVMAEKNVGALPVLENGVVVGVISERDYARKLVLHGRSSVGTPVSAIMSSPVITVDSHQSVDTCMNIMTDSHLRHLPVVENGQLLGLLSIGDLVKEAIAEQADLIRQLEQYIRGE

SEQ ID NO: 69449 - protein, 467 aa, Listeria monocytogenes EGD-e
MVVGDFPEERDTIVIGAGPGGYVAAIRAAQLGQKVTIIEKEYYGGVCLNVGCIPSKALITIGHRFKEAGHSDNMGITADNVNLDFTKAQEWKGGVVNKLTSGVKGLLKKNKVEMLEGEAFFVDDHSLRVIHPDSAQTYTFNNVIIATGSRPIEIPGFKYGKRVLSSTGALALTEVPKKLVVIGGGYIGTELGGAFANLGTELTILEGGPEILPTYEKDMVSLVKRNLKSKNVEMVTKALAKSAEETENGVKVTYEANGETKTIEADYVLVTVGRRPNTDEIGLEQAGVKVTERGLVEVDKQGRSNVSNIFAIGDIVPGVPLAHKASYEAKIAAEAIAGEKSENDYTALPAVVFSDPELATVGLTEKEAKEKGFDVKAAKFPFGGNGRALSLDAPEGFVRLVTRKEDGLVIGAQVAGMNASDIISEIGLAIESGITAEDIALTIHAHPSLGELTMEAAELALGRPIHM

SEQ ID NO: 69450 - protein, 235 aa, Bdellovibrio bacteriovorus HD100
MSNHSPNPEIIRNMFSKVAANYDKGNNVLSMGIHHLWRKKLVKYSGAKAGDQVLDCATGTGDLAIEFKKTVGTGAVTGTDFCAEMLIPAPGKAKERGLDITFEQADVTQLQYADNSFDVCSISFGIRNVGDPVKALKEMARVTRPGGKVMVLEFGQVNIPVFGALYNFYSQNILPKIGGIVTGQKEAYEYLQKSSAAFPCREGFLDLMKESGAYSKMEYITLTGGIAYIYKGTVK

SEQ ID NO: 69451 - protein, 158 aa, Corynebacterium efficiens YS-314
MSVEVTVEIPKGSRNKYEIDHETGKVYLDRYLFTPMAYPLDYGFIDHTLGEDGDPMDALVILPESVFPNVIVKSRVIGVFKMTDEAGGDDKLLAVLDDPRYDHIQDISDVSDFLKDEIEHFFVHYKDLEKGKHVDGSGWGDKAEAEQILADSIERYKA

SEQ ID NO: 69452 - protein, 187 aa, Novosphingobium aromaticivorans DSM 12444
MSIVGTKLKPFQATAFHQGKFVDVSDADVVGKWGVFFFYPADFTFVCPTELEDLAGIYEELQGLGVEVYSVSTDTHFSHKAWHDSSPAIGKINYYMLGDQNHTISNNFGILREGVGLADRGTFVTDPDGTIQLVEITPEGVGRNAAELLRKIKAAKYWREHPGQVCPAKWEEGAETLAPSIDLVGKI

SEQ ID NO: 69453 - protein, 462 aa, Shewanella sp. MR-4
MGKLSIKKWLIFSAMLVAVLLAMFPLKQHPALFSYSASVVLITLLFWSTGFIPPFMAGLIFFALATIFKLIDPSALFSGFGSAAVWLIISGFVIGGAISESGLSRRLAALIAPALTMSYQRMIAGLVISAMLLGFVMPSSVGRAVVMLPIGMALAEQLGFSRGSNGRIGIATALALACNMPSLAVLPANIPNMILAGASENLFNVHFGYAEYLFLHFPILGLLKSAIIVALVVYLFPAKIDKTQMAAATDIEAYDVVKQVKLGVLLVITLLFWITDSWHGINPAWVGLTTAIILLLPKWGIIEPKRFNQSVDFSTVIFVAAALGLGVLVNQSGLGSELGQVFSQYLPLSQGGSFLNFMSLSLISTLTGLVATVPGVPTVLTPMAADLANATGFYLPAVLMTQVIGFSTVIFPYQAPPLILAMQLSQESLAHLLKVTLPLALITLLVLMPLDYLWWQLLGWIS

SEQ ID NO: 69454 - protein, 138 aa, Microcystis aeruginosa MCS3
ADMLTEIGVHYVVIGHSERRQYFGETDETVNLRVISAQKQGLIPIICVGESKAQRDAGETEKVIIKQIQGGLVNVDQNNLVIAYEPIWAIGTGETCESEEANRVIGLIRQQLDNPEVTIQYGGSVKPDNIDEIMAQSQ

SEQ ID NO: 69455 - protein, 531 aa, Shewanella sp. MR-4
MSADQQTVTPLENFSPKVAQRAVHRVQPELNFWQIFNMCFGFLGIQFGFALQNANVSRIFQTLGASIDDIPILWIAAPLTGLLVQPIIGYLSDNTWGRLGRRRPYFLIGAICTTLAIFVMPHSPTLWIAAGMLWIMDASINIAMEPFRAFVGDNLPPKQRTQGYAMQSFFIGIGAVVASALPYILSNFFAVANTAPAGEIADSVRYAFYFGGAVLFLSVAWTVVSTKEYSPDELAAFHGNADAGIDEQQNRTRTHKNYQSAAIVWMAVGALLTLAVWTQDLDKQLYILTLGIFAFGPLQLYCALRLGKSSPSQRAQLGIVFNVVDDLFHMPKAMHQLAIVQFFSWFALFAMWIYTTSAVTSYHFGSSDVLSKAYNDGADWVGVLFASYNGFSAIAALFIPLLAKRIGIKLTHTFNMFCGGFGLISFYFIKDPSLLWLPMIGVGIAWASILSVPYAMLSGALPPKKMGVYMGIFNFFIVIPQLLAASVLGLILNGLFDGQPIYALITGGVLMLCAGIAVLFVEQPNTQHTQA

SEQ ID NO: 69456 - protein, 138 aa, Microcystis aeruginosa PCC 7941
ADMLTEIGVHYVVIGHSERRQYFGETDETVNLRVISAQKQGLIPIICVGESKAQRDAGETEKVIIKQIQAGLVNVDQNNLVIAYEPIWAIGTGETCESEEANRVIGLIRQQLDNPEVTIQYGGSVKPDNIDEIMAQSQ

SEQ ID NO: 69457 - protein, 421 aa, Vibrio fischeri ES114
MTTTTAPANFTELGLISPLLARLTELEYQQPTPIQAQAIPSVLAGRDLIAGANTGSGKTATFALPLLQQIAELQSGKAQASKGNFVTGLVLVPTRELAKQVADSIKSYAVHFNGAIKTVSVFGGVSVNTQMLALRGGADILVATPGRLLDLISSNAVKLDKVKTLVLDEADRMLSLGFTEELNELLALAPKQKQTLLFSATFPEEVQTLTQALLNNPVEIQLQSADASTVVQRVFTVNKGEKTSVLAHLIQKNQWRQALIFVNAKNACNHLADKLAKRGIAAEVFHGDKGQGARTRVLEAFKAGEIDVLIATDIAARGLDIEKLPVVINFDLPRSPADYMHRIGRSGRAGEVGLALSLIDYEDYHHFKIIEKKNKIRLEREQVEGFEVNEEITEALLASIKPVAKPEGTGKKNKKKYKDNW

SEQ ID NO: 69458 - protein, 185 aa, Zea mays
MYKNQLQELAQRSCFNLPSYTCLREGPDHAPRFKAAVNFNGEQFESPGFFSTLRQAEHAAAEVALAALARRGPSYSLAARILDETGVYKNLLQEVAQRVGAPLPLYTTERSGVGHLPVFTCTVELAGITFTGDHAKNKKQAEKNAASAAWSALKQLVREEVNSSNEPKLVMNKEQINQGRKQLHP

SEQ ID NO: 69459 - protein, 249 aa, Triticum aestivum
  misc_feature (51)..(51): Xaa can be any naturally occurring amino acid
  misc_feature (56)..(56): Xaa can be any naturally occurring amino acid
GRSIVPYSSSLYQRACWYRSSEFTGYRRPTRPVNGSFDQSSSAGGDLYPCXTYYSXIMNRVLHAHWGVLDDEDSNGLRSHTLSILVNDCPGVLNIITGVFARRGYSIQSLAVGPAEKEGISRITTVVPGTDESIEKLVQQLYKLIDVHKVDDLTDLPFAERELMVIKVSGNTAARREILDIGNIFRAECVDLSDHTVTLQLTGDLDKMVALQRLLEPYGICEVARTGRAALIRESRVDSKYLRGYSLPL

SEQ ID NO: 69460 - protein, 741 aa, Mycobacterium sp. JLS
MTEAGLSEREPNLSHLRLTARLNTAALDSRRGVVRLHPEVIAALGIREWDAVSLTGARTTAAVVGIAPPGTPTGTALLDDVTLSNAGLPENSSVIVAPVTVYGARSVTVSGSRLATNSISPATLRQALLGKVMTVGDTVSLLPRDLGPGTSTSSATTALASSVGITWTSELLTVTSVDPPGTVSIQPNSSVTWGDGPAPKAASARPTDGAAVGEATVTTPSVDRPAVSFDDLKGSHAQAGRLTEWLKLSLDEPSLLETLGATAHLGVLVSGPAGVGKATLVRTVCAQRRLVELDGPEVGALHAEDRLNRVSSAVSTVRDGGGVLLITDIDALLPATPEPVGTLILTELRTAVATPGVAFVATSARPDGVDARLRDPDLCDRELGLSLPDAATRKELLEVLLRSVPAQELHLDEIAGRTPGFVIADLCALVREAALRAAARASADGAPPQLTQADLTGALTVIRPLSRSATEEVSVGSVTLADVGDMTETKQALTEAVLWPLQHPDTFERLGIEPPRGVLLYGPPGCGKTFVVRALASSGRLSVHAVKGAELMDKWVGASEKAVRELFRRARDSAPSLVFLDEIDALAPRRGQSFDSGVTDRVVASLLTELDGIEPMRNVVVLGATNRPDLIDPALLRPGRLERLVFVEPPDAEARREILRTAGKSVPLADDVDLDTLAAGLDGYSAADCVALLREAAMTAMRRSIDAADVTAADVEAARQTVRPSLDPLQVDTLRAFAENR

SEQ ID NO: 69461 - protein, 136 aa, Triticum aestivum
  misc_feature (45)..(46): Xaa can be any naturally occurring amino acid
  misc_feature (49)..(49): Xaa can be any naturally occurring amino acid
  misc_feature (78)..(78): Xaa can be any naturally occurring amino acid
  misc_feature (91)..(91): Xaa can be any naturally occurring amino acid
  misc_feature (105)..(105): Xaa can be any naturally occurring amino acid
FYLKGMKFMNVERSFAQQHYADLSDKPFFPGLVEYIISGPVVAMXXRGXDVVLTGRRIIGATRPWEAAPGTIRGDYAXEVGRNVIHGSDSXENGKKEIALWFPEXVAQWKSNLHPWDLRSLSSLWMPCLLQWKPFV

SEQ ID NO: 69462 - protein, 213 aa, Brassica napus
MAATTMTTTLGFVLPTGLSPRRGGLRVSIVRCSASSLTTSTGSTASGIVEKPWSSYDARLVLEDGSVWPAKSFGAPGTRVAELVFNTSLTGYQEILTDPSYAGQFVLMTNPQIGNTGVNLDDEESKQCFLAGLVIRSLSISTSNWRCTKTLADYLTERNLMGIYDLDTRAITRRLREEGSLNGVLSTEQTKTDEELLHMSRSWDIVGIDLISD

SEQ ID NO: 69463 - protein, 306 aa, Mycobacterium sp. JLS
MSANTKWTAADVPDQEGRVAVITGANTGIGYEAAAVLAAKGAHVVLAVRNTDKGGAAAERIRSALPHADVTVRELDLTSLDSIRAAADGLRADYPRIDLLINNAGVMMTQKGTTKDGFELQLGTNHLGHFALTGQLLDNLLPVEGSRVVTVSSNAHRWGRVNFDDLQSERSYNRVTAYGQSKLANLLFTYELNRRLSAKGAPTIAVAAHPGTSSTELTRNLWPVARRPVELVWGLVSQTPEMGALPTLRAATDPDVRGGQYYGPDGIGEQRGHPKLVQSNARSYDEAAQRGLWSVSEELTGVTFPV

SEQ ID NO: 69464 - protein, 77 aa, Triticum aestivum
NLSLSLEWKLRHARGSRNSTTGGGGGGGKVSFKVILTSDPKLPFKVFSVPEAAPFTAVLKSASASSHPRPAPSSPRP

SEQ ID NO: 69465 - protein, 379 aa, Staphylococcus aureus subsp. aureus MRSA252
MIYLDNAATTKAFEEVLDTYLKVNQSMYYNPNSPHKAGLQADQLLQQAKVQINDMVNTNMTYDVVFTSGATESNNIALKGVAYRKFDTAREIITSVLEHPSVLEVVRYLEEREGFKVKYVDVTKDGTIDLQHFNDLMSDKVGLVTCMYVNNVTGQIQPIPQMAEVIKNYPKAHFHVDAVQAFGKISMDFNNVDSISLSGHKFNGLKGQGVLLVNHIQNIEPIIQGGGQEYGVRSGTVNLPNDIAMVKAMKMANENLEALNAFVTELNNDVRQFLSQYQGVYINSSTSGSPFVLNISFPGVKGEVLVNAFSKYDIMISTTSACSSKRNKLNEVLAAMGLSDKSIEGSIRLSFGATTTKEDIARFKEIFIIIYEEIKELLK

SEQ ID NO: 69466 - protein, 179 aa, Geobacter metallireducens GS-15
MVRTAPEMAKVGEPAPPFTLDAVVDKEFKKVSLGDYRGKWVVLFFYPADFTFVCPTEITGFNKAMDRFTELNAQLLGASVDSKYSHLAWIKRGDLGDLKYPLLADNKKEATARYGILDEKEGVALRGLFIIDPNGVLQYQVVNNLSVGRSVDETLRVLEALQTGELCPLGWKPGEKTIK

SEQ ID NO: 69467 - protein, 484 aa, Bordetella bronchiseptica RB50
MENLGYPARLELYVAGQWRGVEGRRTQVVVNPSTQQPLGELPLASVEDIDDALAAADQAFGDWARTTAWERADILQRAAALIEARRDRLAVVLTLENGKPLADSHGELDRVVETILWCAEEGKRTYGRVLPARAQRLSQSSLKRPVGPVAAFVPWNFPAVLAARKLAAAMAAGCTVVLKPAEETPAICIELVRAFVDAGTPAGVVNLLYGVPAQVSERLIASPIIRKVSFTGSVAVGRLLASMAAGHLKPATMELGGHAPVVVFDDVDADRVAKMCVGFKYRNAGQVCLSPSRFYVHERIADRFAESFVRHAGLLRVGDGMEEGVQMGPLNNVRRLQAAERLVEQAVGAGASLALGGRRIGQRGYFYPPTVLEGVPDAADILAEEPFCPVAPIMRFGSMDEVIGRANHPSLGLAAYAFTNRMATSAEFAERIEAGWIGINNFVPALADAPIGGMKDSGLGYEGGPEGLDAYLHARFVSQLNVEV

SEQ ID NO: 69468 - protein, 300 aa, Desulfovibrio desulfuricans G20
MTKHFTQIRDLGYQAAWDVLRRAKEMKDSRHRSTLLEGKSAIMLFEKASTRTRVSFETAVHQLGGKTIFMTPAESQLGRSEPLRDTARVLSRYNDLMIVRTFGQEKIDELVEYGSIPVINALTDEGHPCQVMSDMLTIYERTPDLEKVRVAWVGDGNNMANSWIEAAIFFKFELFMAFPEGYEPDRNLLALAMQAGAKIFLTHDPAMAVDGAHYVNTDVWASMGQEEEQKKREKAFAGFCVDDALMAKAAPDARFMHCLPAHRGEEVTEDVFESPASIVWDQAENRLHMQKALIEWVMEG

SEQ ID NO: 69469 - protein, 177 aa, Brassica napus
NLSSPGSQGNQEFGGTKDPSAAMVKDTAKEISEATQGLEPNNGNVIAVERGTDVEKSPISSYENSTQTAQNVASQDPCVKETAPVVDSVSKVVVSEESEHAETSNLVKHKSGAGENGKVATLPGSASGTNKMVENARESEVPLSPEEKRLLLPGPSAVRTSWLSCCGLFDAMTGSDR

SEQ ID NO: 69470 - protein, 903 aa, Arabidopsis thaliana
MSKQTYKVCFCFRRRFRYTASEAPREIKTIFEKYSENGVMTVDHLHRFLIDVQKQDKATREDAQSIINSASSLLHRNGLHLDAFFKYLFGDNNPPLALHKVHHDMDAPISHYFIFTGHNSYLTGNQLSSDCSEVPIIDALKKGVRVIELDIWPNSNKDDIDVLHGMTLTTPVGLIKCLKAIRAHAFDVSDYPVVVTLEDHLTPDLQSKVAEMVTEIFGEILFTPPVGESLKEFPSPNSLKRRIIISTKPPKEYKEGKDVEVVQKGKDLGDEEVWGREVPSFIQRNKSEAKDDLDGNDDDDDDDDEDKSKINAPPQYKHLIAIHAGKPKGGITECLKVDPDKVRRLSLSEEQLEKAAEKYAKQIVRFTQHNLLRIYPKGTRVTSSNYNPLVGWSHGAQMVAFNMQGYGRSLWLMQGMFRANGGCGYIKKPDLLLKSGSDSDIFDPKATLPVKTTLRVGIAGVPGDTVMKKTKTLEDNWIPAWDEVFEFPLTVPELALLRLEVHEYDMSEKDDFGGQTCLPVWELSEGIRAFPLHSRKGEKYKSVKLLVKVEFVILCKFFVHGSCLKGENCEFSHDSKDPPNNVCTFYQKRICLYGSRCRYDHVRAASNLPLSSDSESLDRSISTTPSRHLQQQGDNNDGDKSSNVYCIHPREYPICSFAAAGDCPRGNQCPHMHGDLCNTCGKKCLHPFRPEEREEHTKECEKKQKHIEALKQSQDIECSVCLDRILSKATPGERKFGLLTECDHPFCIQCIRNWRSSAPVSGMDVNSTLRACPICRKLSYFVVPSVVWYSSPEEKKEIIDIYKAKLRSIDCKHFNFGNGNCPFGASCFYKHAYSDGHLEEVVLRHLGSQEGETVITDSIRSLPNMINFSHHSLSLALSSDNNNIIVLEFSLLADSSYLLIIEM

SEQ ID NO: 69471 - protein, 353 aa, Saccharomyces cerevisiae
MFEGFGPNKKRKISKLAAEQSLAQQPWVEKYRPKNLDEVTAQDHAVTVLKKTLKSANLPHMLFYGPPGTGKTSTILALTKELYGPDLMKSRILELNASDERGISIVREKVKNFARLTVSKPSKHDLENYPCPPYKIIILDEADSMTADAQSALRRTMETYSGVTRFCLICNYVTRIIDPLASRCSKFRFKALDASNAIDRLRFISEQENVKCDDGVLERILDISAGDLRRGITLLQSASKGAQYLGDGKNITSTQVEELAGVVPHDILIEIVEKVKSGDFDEIKKYVNTFMKSGWSAASVVNQLHEYYITNDNFDTNFKNQISWLLFTTDSRLNNGTNEHIQLLNLLVKISQL

SEQ ID NO: 69472 - protein, 402 aa, Brassica napus
  misc_feature (112)..(112): Xaa can be any naturally occurring amino acid
MATKRSVGTLKEADLKGKSVFVRVDLNVPLDDNSNITDDTRIRAAVPTIKYLMGNGSRVVLCSHLGRPKGVTPKFSLKPLVPRLSELLGVEVVMANDSIGEEVQKLVAGLPXEGGVLLLENVRFYKEEEKNDPEFAKKLAALADVYVNDAFGTAHRAHASTEGVAKYLKPSVAGFLMQKELDYLVGAVANPKKPFAAIVGGSKVSTKIGVIESLLSTVDILLLGGGMIFTFYKAQGHSVGSSLVEEDKLDLAKSLMEKAEAKGVSLLLPTDVVIADKFAPDANSKIVPATAIPDGWMGLDVGPDSIKTFSEALDTTQTIIWNGPMGVFEFEKFAAGTEAVAKQLAELSGKGVTTIIGGGDSVASVEKVGLADKMSHISTGGGASLELLEGKPLPGVLALDDA

SEQ ID NO: 69473 - protein, 693 aa, Oryza sativa Japonica Group
MAAGSHGGYRGYEVAREREHDVGVSRRSKEHYHHRHPSRHRDSERRRDGGRSGGRELSNGYSHRRDSPRPPPRRRPSEGRTEDREPGEVSGGSGSERSGERPMKTGEPRENGVTRVSKEEAKMSPSKKRKQSPVIWDRNGSKRQARDPVRGIREVDAVVAEIIMHQSHSLPVMSSLSSIGDGHSPMILDVSVDKVQEYEKNRIVDEEEEGYPTMRNILTSRWADAGDEEENVFVPKKKKSVSPVDSIERGSTKKVTSPESGEVLVYNSVRSSSRSSDSGVLQGSANRDLEVEKGDNIDVEEAADDDYPAGHLLDSDFEGEDCRSETPECTRSPRRCINMLQGCRSVDEFERLNTINEGTYGVVFRVRDKRTGEIVALKKVKMEKEREGFPLTSLREMNILLSFHHPSIVEVKEVVVGSNDRDIFMVMEYMEHDLKGVMETMKQPYSQSEVKCLMLQLLEGVKYLHDNWVLHRDLKTSNLLLNNRGELKICDFGLSRQYGSPLKPYTQLVVTLWYRAPELLLGAKDYSTAIDMWSLGCIMGELLSKGPLFNGKSEIDQLDKIFRTLGTPDENIWPGYSKLPGATVKFGKQTHNRLRDKFRAVSFTGGPMLSEAGFDLLNRLLTYDPEKRISAEDALNHEWFRELPLPRSKDFMPTFPALNEQDRRFKKHMKSPDPLEEQRMKEQGNNGDRGLFG

SEQ ID NO: 69474 - protein, 312 aa, Arabidopsis thaliana
MAEVNGVIPTIDLEEVNDQILNEKIREASERWGCFTVINHGVSLSLMAEMKKTVRDLHERPYEMKLRNTDVLLGNGYKPLSEFNPFYESFGLFDMASPQAVNSFCDKLDASPDQREILLKYAKATDDLARSLARRLAESYGVVEPNFLRGWPSQFRMNKYHFKPDSVGKLGVILHTDPGFLTILQGDEDVGGLEAMDNSSGSFFPIHTLPNTLLVNLGDMATIWSNGRLCNVKHRVQCIEAKMRITIASFLLGPVDRDLEAPDEFVDAEHPRLYKPISDGGLRKIRLSKHLHAGESLKFITINELSDVPKID

SEQ ID NO: 69475 - protein, 757 aa, Mannheimia succiniciproducens MBEL55E
MDEQLRQAALDFHEFPVPGKIEVTPTKSLATQRDLALAYSPGVAMPCLEIQEDPAKAYNYTAKGNLVAVISNGTAVLGLGNIGALAGKPVMEGKGVLFKKFAGVDVFDIEINEKDPEKLVEIIAALEPTFGGINLEDIKAPECFYIEQKLRERMNIPVFHDDQHGTAIISSAAVLNGLRIINKKIEDVRLVASGAGAASIACLNLLVSLGMKRENITVCDSKGVIYKGRDENMDATKKLYAIDDNGTRSLADAIPNADIFLGCSAAGALTQEMVKTMGPNPLILALANPNPEITPPEAKAVRPDAIVCTGRSDFPNQVNNVLCFPFIFRGALDVGATTINEEMKMAAVRAIADLALAEQSDVVSSAYTDESEVTFGPEYVIPKPFDPRLIIRIAPAVAKAAMDSGVATRPIQNFDAYIEKLTQFVYKTNLFMKPVFNQAKADKKRVLLTDGEETRILHAVQEISTLGIAYPVLVGRLDVIEAQIKRLGLKIQAGVDFEVLNTDNEEIYQQCWSLYHNKLKRHGVTEAMAKRRMLTNSTAIGSALLELGYADAMLCGLVGTYSSSLSLLKEVIGIKENVDIPATVNGLVLPSGNLFIADTFVNLAPTAEELAEITLMAAEEVRRFGIEPQVALISHSNFGTSEDQSAVKMREVLQLVKTQAPDLIIDGEMHANVALNENLRREVMPDSPLKGAANLLIMPDMESARISLNLLQGTATPITIGPILMGMKKPAHILTSVSSVRRIINMVAIAAVKAQQN

SEQ ID NO: 69476 - protein, 285 aa, Mycobacterium sp. MCS
MAAARVCVVGSVNADLRFAVPSLPRPGQTVLASSMTTSPGGKGGNQAIAAARAGGDVSLVAALGDDPAAGQLRAHLRANGVGLDGVVTVPGPSGSAVVIVDAAAENAIVVAPGANAHLSVASSAVREAIAGADVVLLQLEIPLHTANDAARVARDAGAVVMVNASPAGAPPHELLRLSEVADVVVVNQAEAGEWHWPVPHLVITRGARGASYLGDGERFDVPAPAVEAVDTTGAGDVFAGVLAVHWRSGHENALRRACVAGALATLVPGAGDCAPTAEAIDDTLR

SEQ ID NO: 69477 - protein, 251 aa, Oryza sativa
  misc_feature (44)..(44): Xaa can be any naturally occurring amino acid
  misc_feature (52)..(52): Xaa can be any naturally occurring amino acid
RDGARNPGEEAGGGGAAAAAAGGGGPGGYVAAIMAAQLGLKTTXIEKRGTLXGTCLNVGCIPSKALLHSSHMYHEAKSSFAHHGVKFSNLEVDLPAMMAQKDKAVAGLTKGIEGLFKKNKVTYVKGFGKLASPSEVSVDLSDGGSTVVKGKNIIIATGSDVKSLPGVTIDEKKIVSSTGALCLSEIPKKLVVIGAGYIGLEMGSVWNRLGSEVTVVEFAPDIVPSMDGEVRKQFQRFLRTKHKSAQHKYKE

SEQ ID NO: 69478 - protein, 519 aa, Nitrosomonas europaea ATCC 19718
MHSAILILDFGSQYTRLIARRIRETNVYCELHPFDVSPQFIREFAPIGIILSGGPASTFTEDAPRVPQIVFELGVPVLGICYGMQAMAAQLGGEVEDAQTREFGYAELLTAPCKLFHGIQDRINSDGKPALDVWMSHGDRVNKLPPGFTAIASNAATPFAAMADETRNFYGVQFHPEVTHTRQGKAILDHFVHDICSAGYDWNMPDYVEEAIGRIRARVGNDKVVLGLSGGVDSSVAAALIHRAIGDQLVCVFVDNGLLRLNEAKQIMETFSRNLAVNVIYIDAGRQFLEQLKGITDPEQKRRTIGREFVEIFQQEAEKIENAKWLAQGTIYPDVIESAGSHTKKAGVIKSHHNVGGLPETLHLKLLEPLRELFKDEVRELGLALGLPHDLVFRHPFPGPGLGVRILGEVKYEYTELLRQADAIFIEELRNAGWYEKTSQAFAVFLPIKSVGVMGDNRSYEYVVALRAVQTEDFMTAHWAELPYTLLSRISNRIINEIRGINRVVYDISGKPPATIEWE

SEQ ID NO: 69479 - protein, 127 aa, Zea mays
MATLSAAPLVGAAAVARPCQAQGLPQLRVRAEKARCGAAHSRRPSQRRDGNNGASSSLLAVATSAVTTSPALALVDERMSTEGTGLSLGLSNNLLGWILLGVFGLIWSLYTVYTSTLDEDDDSGLSL

SEQ ID NO: 69480 - protein, 329 aa, Zea mays
MVPGIATKTAARPVAWAPQPRNMFVFGAGFVGRYVSERLLAQGWQVSGTCTTVTTKRELEMLGMNASVFDGTEDSLENIHSLRQATHLLISIPPIPGVGDPLLINLDEDLRRILGHGNLEWLCYLSSTSVYGDCGGVLVDEDHTVNPKSESAKLRYNAEKGWLNLIDDPKLSAFVFRLGGIYGPGRSALDTLAKSKSLSRKQKLRESKQYTARIHVADIYQAVLASMSIRCARKIFNVVDDDPAPRAEVFAFATSLIQRRYPDMITETIDAKPAGLDYQEMIVPAEKRVSNARMKQELGVNLLHPTYRSGLQSILDAWQIQPPLPNTSQ

SEQ ID NO: 69481 - protein, 145 aa, Rhodococcus sp. RHA1
MSSQQQDPTQSAPKVALSDSEWREKLTPEEYAVLRQAGTERPFVGEYTDTKTEGVYHCRACGAELFRSTEKFESHCGWPSFFDPADSDAVILREDTSLGMRRVEVVCGTCHSHLGHVFEGEGYPTPTDQRYCINSISLTLEPTGE

SEQ ID NO: 69482 - protein, 496 aa, Pseudomonas fluorescens Pf-5
MTKSRSDWEQHFQSLSLEGRAFIDGQYCAAASGATFECLSPVDGRFLANVASTDQADADRAVAVARQAFNSGVWSGKAPAERKRILTRFAELILEHQEELALLETLDMGKPIGDSMAIDIPATANAIRWNAEAIDKLYDEVAATPHDQLGLVTREPAGVVAAIVPWNFPLIMASWKFAPALAAGNSFILKPSEKSPLTAIRIAQLALDAGIPKGVFNVLPGYGHTVGKALALHMDVDVLAFTGSTAVGKQLLVYSGESNMKRVWLEAGGKSPNVVFADAPDLRAAAEAAAAAIAFNQGEVCTAGSRLLVQRSIREQFIPLLVEALKGWKPGHALDPETRVGAVVDQRQLENVLRYIEIGKEQGGQLLAGGVRTLESTGGLYVEPTIFDGVTNAMTIAREEIFGPVLSVISFDTEEEALQIANDSIFGLAAGVWTANLSRAHRFARGLRAGSVWVNQYDGGDMTAPFGGFKQSGNGRDKSLHAFDKYTELKATWIKL

SEQ ID NO: 69483 - protein, 437 aa, Brassica napus
  misc_feature (164)..(164): Xaa can be any naturally occurring amino acid
IKNKQVKRRVGKYEVGRTIGEGAFAKVKFARNSETGEPVALKILDKEKVLKHKMSEQIRREIATMKLIKHPNVVQLYEVMASKTKIFIILEYVTGGELFDKIVNDGRMKEDEARRYFQQLVHAVDYCHSRGVYHRDLKPENLLLDAYGNLKISDFGLSALSTHXPGLLHTSCGTPNYVAPEVLNDGGYDGATADMWSCGVILYVLLAGYLPFDDSNLMNLYKKISSGEFNCPPWLSLGAMKLITRILDPNPMTRVTPQEVFEDEWFKKDYKPPVFEEKDDSNMDDVDAVFKDSEEHHVTEKKEEQPAAINAFEIISMSRGLNLENLFDPEQEFKRETRITLRGGANEIIDKIEEAAKPLGFDVQKKNYKMRLENVKAGRKGNLNVATEIFQVAPSLHMVQVSKSKGDTLEFHKFYKKLSNSLENVVWTNNEVKKAGK

SEQ ID NO: 69484 - protein, 324 aa, Pseudomonas fluorescens Pf-5
MISAIRFNQFGAPEVLKLEPVNEQLPGPGEVWIEQEAIGVNFLDVTQRKGVTPVALPSVLGLEGAGRVVIIGEGVSNVQVGDRVAYATGPIGSYASARLYPAERLVKIPETLSFDDAAAVMFKGITAQYLLKTTYPVTHGKTVLIYGVAGGLGEIMVPWAKHLGATVIGVVSKQASVEKALTSGCDEVLVFDANNLASEVSRITQGRKVDVVYDPIGRASFEASLDSLRPRGLMVSFGASSGAPSAVELSTLNAKGSLFLTRPSLAAHTASAAEYQERAQDVLAAIESGIIKPRIWASYALKDASLAHTALESGQSSGAIILKP

SEQ ID NO: 69485 - protein, 433 aa, Bacteroides thetaiotaomicron VPI-5482
MKYYSTNKQAPMASLQEAVVKGLAADRGLFMPMTIKPLPQEFYDTIDTLSFQEIAYRVADAFFGEDIPTDTLKQIVYDTLSFDVPLVKVADNIYSLELFHGPTLAFKDVGGRFMARLLGYFIKKEGQKDVNVLVATSGDTGSAVANGFLGVEGIHVYVLYPKGKVSEIQEKQFTTLGQNITALEVDGTFDDCQALVKAAFMDKELNEHLSLTSANSINVARFLPQAFYYFYAYAQLKRAGKADNAVICVPSGNFGNITAGLFGKKMGLPVKRFIAANNRNDIFYQYLQTGKYNPRPSVATIANAMDVGDPSNFARVLDLYGGSHADISAEISGTTYTDEQIRETVKETWKEHHYLLDPHGACGYRALQEGLKQGETGVFLETAHPAKFLETVESIIGEAVEIPAKLQEFMKGEKKSLQMTKEFADFKKYLLSV

SEQ ID NO: 69486 - protein, 305 aa, Vibrio fischeri ES114
MNKLVVLGSVNADHVLQVASFPRPGETLHGHSYSVIPGGKGANQAVAAARLGADIAFIASVGDDSFGHQMIEAFQFDGINTEAVMIEENTPTGIAMIQVAATGENSICISAEANARLTADRIAPHHGLIEAADTLLMQLETPIETIEKAAQIAKAAGTKVVLNPAPAHQLSDDLLQLVDIITPNETEAELLTGIQVTDMASAQQAADALHAKGIETVMITLGSKGVWISQNGSGRQVEGFKVQATDTTGAGDTFNGAFLTGLQSGRKLDDAIKFAHAAAAISVTRMGAQTSIPSITEVERFLLEH

SEQ ID NO: 69487 - protein, 504 aa, Pseudomonas fluorescens Pf-5
MNSFAEKLMVGATAPSASVELPLGDRVRCVLVHEFLSASECEALIEATEQCGFASAGSDYPSSYRDNDRIVADDPAMAGRLFERLKHCASRMPKLGTVIDEDGWRPVGINERLRFCRYRPGTQFRAHQDGVHHRQRQQSRLTFMIYLNDDAFSGGETLFFEGRSAAMSNRDSTLRLRPRKGSLIVFDHTLWHAGALVDAGQKYVMRSDLMYEPQQSLQVDGPFQPGHRGYVWALADLGDRGFASAGRDATIRLWDHEGRCLGQLDGHTQSILGLVDVAPGELVSHSRDRTVRHWSLATGKSTLVGTSDSAVLSSARLGADRLVTGAADGCLTVWNLATGAADRRQAHACWVWAIAPTGDGSFASASEDGTVRLWQPEERDCVQVLDLGRPLRMLASWIDADGSVTLAVGDLDGAVHLLATEPRLALLDCLAAHDGPVRRVRFEARHMLLTCGEDGLVRRWNLPSRQGAIIGSHDNFATDVLPTRAGGWISCGYDGRILVHGDKG

SEQ ID NO: 69488 - protein, 498 aa, Stellaria longipes
MVSQSKNNQDQVLSKIAVNEEHGEDSSYFLGWKAYEKDQNPFFHPYHEINQNSNGVIQMGLAENQLCFDLIEEWIKRNPDAAICTNDGIKSIFRALFQDYHGLQEFRQAVARFMEKTRGGRVRFDSNLVLTAGATSANETIIFCTANPGDAFLVPTPYYAAFDRDLKWRTGAEILPICHESSNNFKITSKAKEAYENAQSKYKAKKLDLNVKGLLMTNPSNPLGTTTLDRDTLKKISTFTNQKGIHLVCDEIYAATVFSPKFVSIADILLDDHVNQDLVHIVYSLSKDLGLPGFRVGIVYSKDEMVVSAATKMSSFGLVCFANMDDSSQTQLMIAALLSDKNFTEEFLIESSDRLRKYEMITEGLKSAGINCLQGNAGLFVWMDLRQLLKDNTFDSETELWNAILHEVKLNISPGSSCHSECSEPGWFRCFANMDIDETLDLDLGVKRLKDFAQRGRVDNSTMTTTKQPFKLPLKKTVRSNLRPAHSPMNSPLVRART

SEQ ID NO: 69489 - protein, 498 aa, Stellaria longipes
MVLPSKNNSEQVLSKMAVNFNSGEDSSYFLGWKAYNKDDNPHFHPYAEIEQNYNGVIQMGLAENQLSSDLIEEWIKRNPDAAICVEDGIKSIFRALFQDYHGLIEFRQLVARFMEKVRGGRVRFDSNLVLTAGATGANETIIFCTDNPGDAFLVPTPYYAAGDRDLKWRTRAEILPICHCSSNNFKITSKAKEAYEKAQSKYKAKKLDLNVKGLIMTNPSNPLGTTTLDRDTLKKISTFIDQKNIHLVCDEIYAATVFKAKTVSIADILLDDHVNQDLVHILYSLSKDLGLPGFRVVIVYSKDEMVVSAATKMSSFGLSSGLYIHTVIRLLQRLGECLVLPLSQTQNLLATMLSDKKFTWNYIKINRERLKRRYEMIINGLKKVGIECLKGNGGLFCWMNLSPFLEKPTKEGELDLWSSIVNEVKLNISPGSSCHCSNPGWFRVCFANMDESMAVQLAMQRLQNFVGEYVADNMEKKQQWKKSRLSLSFRRPSPLVRT

SEQ ID NO: 69490 - protein, 339 aa, Trametes versicolor
HWHGFFQKGTNWADGAAFVNQYPIARGNSFLYEFTARDQAGTFWYHSHLSTQYCDGLRGPMVVYDPSDPHADLYDVDDETTIITLSDWYHTATSLGAAFPTGSDSTLINGLGRFASGDSTDLAVITVEQGKRYRMRLLSLSCDPNYVFSIDGHNMTIIEADAVNHEPLTVDSIQIYAGQRYSFVLTADQDIDNYFIRALPSAGTTSFDGGINSAILRYSGASEVDPTTTETTSVLPLDEANLVPLDSPAAPGDPNIGGVDYALNLDFNFDGTNFFINDVSFVTPTVPVLLQILSGTISAADLLPSGSLFALPSNSTIEISFPITATNAPGAPHPFHLHG

SEQ ID NO: 69491 - protein, 553 aa, uncultured bacterium
MLRLKERPAWKALEAHAFEMREARIADLFTNDPARAQEFSVAACGLLLDYSKNPLSRQTRRLLMTLAEEASLPAQIVAMFEGKRINVTEKRAVLHTALRNRSGRPLLLDGKDVMPEVRAVLSRVRDFSERVRGGIARGYSGLPFTDVVNIGIGGSDLGPLMVCSALRPYGSHDLLVHFVSNIDGAHLAATLSGLNPETTLFVVSSKTFTTQETLTNARSAREWLLTLLRPSGATEVAVQQHFAAVSSNLEATSKFGIAPDRVFGFWDWVGGRYSLWSAIGLPIALGIGFNRFDELLAGAYDMDEHFRTAPLESSMPVIAALTGIWNINFLGHRSQAVLPYAQDLAHFPAFLQQLDMESNGKRVDRSGAEVEYATGPVIWGAPGTNGQHAFFQHLHQGTQVTPADFIVAANGADRLPEHQEILLANCIAQSEALLRGKNADEVRAELKARGIVGDEAERLIPHRTFPGNRPSNTIVMRHLDPRSLGALIALYEHKVFVQGAIWSINSFDQWGVELGKQLASGVLEDLKAGKARSGHDASTARLIEYVLGNKEDK

SEQ ID NO: 69492 - protein, 386 aa, Staphylococcus aureus subsp. aureus MRSA252
MYYHQPLLLTPGPTPVPDAIMREIQAPMVGHRSKDFEDIAQQAFQGLKPIFGSQNDVLILTSSGTSVLEASMLNIVNPEDHFVVIVSGAFGNRFKQIAQTYYKNVHIYDVTWGEAVDVKDFINYLSTLNVEVKAVFSQYCETSTTVLHPIHELGNAINQFNSNIYFVVDGVSCIGAVDVDINKDKIDVLVSGSQKAIMLPPGLAFVAYSHRAKERFKEVTTPKFYLDLNKYISSQADNSTPFTPNVSLFRGVNAYVETVKAEGFNHVIARHYAIRNALRSALKALDLTLLVNDKDASPTVTAFKPNTNDEVKIIKDELKNRFKITIAGGQGHLKGQILRIGHMGKISPFDILSVVSALEIILTEHRKVNYIGKGISKYMEVIHEAI

SEQ ID NO: 69493 - protein, 566 aa, Robiginitalea biformata HTCC2501
MPGYKKAWLPGDLAAGLTVGILLIPQGMAYAMIAGLPPVFGLYAALVPQLVYALTGTSRQLAVGPVAMDSLLVASGLGALALTGIEEYIAMAVFLALFMGVLQLAFGLLRMGFLVNFLSRPVISGFTSAAAIIIGLSQLKHLLGVEIPGSNRIQQLVSHAAAALPDTHLPTLGLGLAGIALIVGMKKWVPRMPGSLAGVVAGTLAVFLLGWDQAGVKIVGAVPAGLPEFGLPELDMERVSQLFPIALTLALIAYMEAISVGKAVEEKHGKNRIDANQELRALGLSNILGSFFQSYPTTGGFSRTAVNDQNGAQTPLASVFSALVVGATLLFLTPLFHYLPNAILAAVIMVAVFGLIDLKYPRELWKNRKDEFILLLATFALTLGLGIVEGILLGVLFSLLLLVYRISKPHIAILGRIRGTDYFKNINRFSDDIEEFPEFLILRFDGQLFFGNKDYFRKELVKHTRQKGPDLKFVILNAEAISYIDSSAVYMLRALIRDLRRDGIRLLLAGAIGPTRDILFSSGLAEEIGRENQFVRTFEAFEHCRTATGKTEMERKVSTQSARPPV

SEQ ID NO: 69494 - protein, 292 aa, Streptomyces narbonensis
MKGIVLAGGSGTRLHPATSVISKQILPVYNKPMIYYPLSVLMLGGIREIQIISTPQHIELFQSLLGNGRHLGIELDYAVQKEPAGIADALLVGAGHIGDDTCALILGDNIFHGPGLYSLLRDSIARLDGCVLFGYPVKDPERYGVAEVDATGRLTGLVEKPEKPRSHLAVTGLYLYDNDVVDIAKNIRPSPRGELEITDVNRVYLERGRAELVDLGRGFAWLDTGTHDSLLRAAQYVQVLEERQGVWIAGLEEIAFRMGFIDAEACHSLGEGLSRTEYGSYLMEIAGREGAP

SEQ ID NO: 69495 - protein, 779 aa, Picea abies
MMGLKLYFALVFLCSLLFGPVIAEDGKVHIVYMGSLSHNNREDLVTSHLEVLSSVLESPRHAKQSLVRSYTYAFNGFAAVLSKEQATTLVGKPGVLSVFPDTVLNLHTTHSWDYLEKDLSMPGFSYRKPKSSGTDIILGFLDTGIWPEAASFSDKGMGPVPSRWKGACVKGENFNVSNCNRKIIGARYYSGGEDDDLKKNSKPKSIWPESRTARDYQGHGTYTAATAAGSFVDNANYNGLANGTARGGSASSSTRIAMYRVCGLDYGCPGVQILAAFDDAVKDGVDIVSISIGVRSSNQADFVKDAIAIGAFHATQKGILVVSSAGNEGPDSQTVVNAAPWIFTVGATSIDREFLSNVVLGNGKIIKGKGITMSNLSHSAVHPLVYAGSIPDKSSYPVAASNCLLDSLDASKAKGNVVVCIANDTAASRYIMKLAVQDAGGIGMVVVEDIQIFEAFDYGTFPATAVSKTSATEIFSYIKSNRNPVATITLTEVVTNYIPAPVIASFSSRGPGGLTQNILKPDISAPGVNIIAAWNPPNQSDEDTVVSEMTPSTFNMMSGTSVAVPHVTGAAAFVKSINPTWSSSAIRSALMTTAIVRNNMGKLLTNESDIPGTPFDFGAGVVNPIGALQPGLVYETSIDDYFHFLCNYGLDSENIKIIAANESYKCPSGVNADLISNMNYPSIAISKLGIKNGSTTISRSVTNFVPEQAPTYKVTIDAPPGLNVKVSPEILHFSKTSKKLSFNVVFTPTNVATKGYAFGTLVWSDGKHNVRSPFAVNMV

SEQ ID NO: 69496 - protein, 372 aa, Physcomitrella patens subsp. patens
MAATQAREWTGLLQFPVATQTALHNILGKLRQQKKESLTVLVVGKGGVGKSSTVNSIIGERVTVVSAFQSETLRPLQCARTRAGFTLNVIDTPGLIEGGCINDQALDIIKRFLLNKTIDVVLYVDRLDGYRVDNLDKQVIRALARSFGPNFWRIAIIALTHAQLSPPDGVDYTEFVNNRSAALRAAIRQEAGFKKSEGEVRKAPQMLISYMLVENSGRCNTNSEGEKAYSFHLFHELFLLYVLPNGSVWLPALVDRIAEVATGATPSIHVDQKLIDGPNANGKGKWWIPLIILAQYFLIVRPIRSAIEKDLIEEEKQRPQWQIRAEEFVRPTASLYEDDQVDEQAIRQALKQGALNDQMDSFVEDDEDDDEY

SEQ ID NO: 69497 - protein, 294 aa, Triticum aestivum
  misc_feature (247)..(247): Xaa can be any naturally occurring amino acid
LDMYDFGGDVWLCHSLQGQCYNFTAFEPAIDTLKEVEAFLSENPTEIVTIFIEDYVHAPMRLSKLFTAADLMKYWYPISEMPTSGQEWPTVTDMVAKNHRLLVFTSDASKESSEGIAYQWSYLLENESGDPGIDPSACPNRKESQPLNSGSASLFMQNYFPTIPVESEACKENSVGLPQMVQTCYAAAGNRIPNFIAVNFYMRSDGGGVFDVQDRINGLTLCGCNTIAACQAGAPAGACKNTGAPNXRTTSSVNGNVYSGTIVEFKTSASRASSTSTWSNLVISLSLALILKPF

SEQ ID NO: 69498 - protein, 439 aa, Clostridium perfringens SM101
MLKKEIVSNMEKIVENCMGEETAACFATCPMHTDVKEYVRLIKEEKGEEAIKVIREKLFIPGTLGRICAHPCEKQCKWNEGKSPMAIASLKRYAADNFDKEENWDLSIKNSNGKKIAVIGAGPSGLQSALDLRKEGFEVTVFEKLPVRGGMMRVGIPAYRLPRLGLEHEISYLDKLGVNFELNCEIGKDREFNDIVNEFDSVVVAVGKHQGRVDRSLENFDAEGIFSAAGYLKEASLTGNVEKAGKVVLVVGGGDVAMDCARTSLRIDGVEKVYSICLEDSFDNMASSNHEIEGAIAEGIKFNHAQAIKNIHIDENGRVSGVTLKKCLSMFDENGRFAPKFDDEATSEIEVDTIVFAIGQGVEGEFAKDILVQRPNTTFECDKETLQSSSNEKVFIVGDASGESVIVIQAMATGRRAAQSVIRFLNGESLTEGRELKDT

SEQ ID NO: 69499 - protein, 502 aa, Cryptococcus neoformans var. neoformans JEC21
MLATMNPIRPLFRSTPLRLCHNSLSSRIPRRTLVTPTNLVHATVSNVTVDHVKEDPAEHQSGEQIAGEHPSGKEMFGFKLNPVATKTGGSAKSGGRPIYLDMQATTPMDPRVLDKMLPLFTEQYGNPHSRTHAYGWEAEKAVDEARQQVAQLVGAQPKDIVFTSGATESNNMLIKGIAKFHQSKKKHIITTQTEHKCVLDSCRWLSTQGFEVTYLPVLPNGLVSINELKAALRPDTSLVSIMAVNNEIGVIQPLAEISQAIKSWAKENGVTKPLFHTDAAQAVGKIPIDVEALGIDAMSISGHKLYGPKGVGAAYVRRRPRVRLEPLIHGGGQERGLRSGTVAAPLVVGLGEACRIAENEMAADHARIKALSDRLIEGITSKVEHIVRNGDVNGYPGCVNLSFSYVEGESLLMALKDIALSSGSACTSASLEPSYVLRALGAAEDMAHSSLRFGIGRFTTEEEIDLVVQRIVSVVNKLRDMSPLWEMVQEGIDISKIEWNQH

SEQ ID NO: 69500 - protein, 277 aa, Gloeobacter violaceus PCC 7421
MILRVAFLGPSGTYAEEATLALLGNECERLAHPSIQGTLRAAAAGEVDCAVVPVENAVEGTVSATLDTLWLYPQLRVRRALVLPVRHCLIGPVQHLTDIQAVYSHPQALAQCQGWLEEHLGAVERIPTASTSEALRHIGAHTAAIASERAARLHGLRVIFRAINDHPDNCTRFWLVSEKPLTETLPPPGGCTSIAFALRRNQPGVLHEVLSIFARHRINLAKIESRPTKKVIGEYLFFADLEGGVEAEPVNTALRQVAAVVAELNILGSYAVEQSGG

SEQ ID NO: 69501 - protein, 175 aa, Oryza sativa Indica Group
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHKSPGYYDGRYWTMWKLPMFGCTDATQVLKELEEAKKAYPDAFVRIIGFDNVRQVQLISFIAYKPPGCEESGGN

SEQ ID NO: 69502 - protein, 141 aa, Zea mays
YPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKLNEQAEQIHSAIINTIAEGKYRTADLGGSSTTTDFTKAICDHL

SEQ ID NO: 69503 - protein, 149 aa, Mycobacterium sp. MCS
MTVPETGAGTLSAVTERTLVLIKPDGVQRRLVGEILGRIERKGLTLAALELKTVDDELARRHYAEHEGKPFFGSLLEFITSGPVVAAIVEGPRAIAAFRQIAGGTDPVEKATPGTIRADLALVTQDNLVHGSDSPESAAREIDLWFPGR

SEQ ID NO: 69504 - protein, 602 aa, Nocardia farcinica IFM 10152
MSTNQVDSVPGDDDRDSGGAESGSGSAGPSFADLGIDDRILRAIADVGYESPSPIQAATIPPLLDGADVVGLAQTGTGKTAAFAIPILMGLEVTGRQPRALVLAPTRELAIQVAEAFGRYAAHMPGLHVLPIYGGQSYGVQLSGLRRGAHVVVGTPGRVIDHLEKGTLDLSQLQYLVLDEADEMLKMGFQEDVERILADTPREKQVALFSATMPAAIRKISKQYLREPVEITVKAKTQTNTNITQRWVQVSHQRKLDALTRVLEVEPFEAMIIFVRTKQGTEELAEKLRARGFSAAAINGDIAQNQRERTIGQLKSGALDILVATDVAARGLDVDRISHVVNYDIPHDTESYVHRIGRTGRAGRSGQALLFVAPRERHLLKAIERATRHPLEEMQLPSVEDVNAQRVSKFGDAITENLSSANLPLFRKLIEDYEREHNIPLVDIAAALAVGSYDGDNFFMEAEPEPERRERVPRERPARRFDEERGGGSHHRATGTELATYRISVGKRHRVVPGAIVGAIANEGGLRRSDFGHISIRPDHSLVELPAQLPAETLEALRRTRISGVLIQLQLDQGPPAQRAFSRGPRRDRDAGKRPERRKPRS

SEQ ID NO: 69505 - protein, 136 aa, Glycine max
  misc_feature (15)..(16): Xaa can be any naturally occurring amino acid
  misc_feature (84)..(84): Xaa can be any naturally occurring amino acid
MAERGGERGAERGGXXGGFGRGFGGGRGDRGGRGGPRGRGGRRGGRPTEEEKWTPVTKLGRLVQAGKIQKLEQIYLHSLPVKEXQIIDLLVGPTLKDEVMKIMPVQKQTRAGQRTRFKAFVVVGDTNGHVGLGVKC

SEQ ID NO: 69506 - protein, 534 aa, Oryza sativa
MADAATTPLLTSHEAKPAKALSIDDAIETYIGATGARQLLTAMLLAFAWAFEAQQVFMSVFTDAEPTWHCTGVAAGDPGSFCSLAAASASASACALPPGTWEWDRPAETSVVSEWALKCGGGGPALVSLPASSFFAGNLAGGFMLTTLADTLLGRRKMLVLSLVTMSVAGVLTVFSPNVWVYAALRFVCGFCRSTAGTSAMVLSTELVGKWWRNTVSVAAFVFFSVGFMSLPALAYTLREASWRNMYVWTSLPSLCYAVLLYFLVQESPRWLLVRGRKQEAIAALRQIASLNGGEGITTSSFTKLETCAGEVGDGVAGGEGMFSTLRSICERRWALRRLAAITTATFGVGVVYYGMPLSVGSLSSDLYLSVAYNAAAELPSSVLSWLLMGRFNRRSSLVALTAASGLCSLACVVIPDPEAGAGGSHLRLAAELASFFASCAAYDVLLMYSIELFPTSVRNSAVGLVRQAGVLGGVVAPMLVALGRERSYWSFGVFGLTVGCLGLFVTFLPETKGRRLSDTMEDEEEAAAVLSGG

SEQ ID NO: 69507 - protein, 525 aa, Shewanella oneidensis MR-1
MSDIHEHKILILDFGSQYTQLIARRIREIGVYCELWAWDVTEAQIREFAPNGIILAGGPESVTADNSPRAPEYVFNAGVPVLGICYGMQTMSEQLGGKVIQGVGEGEFGYAQIEMLAESALFKGIEDAVSSDGKSLLDVWMSHGDKVSAIPAGFVAVAKTDTCPFAAMSCEEKRFYGVQFHPEVTHTRQGMRMLSHFALDICGCAANWKPSSIIEDAIERLKKQVGDDEVILGLSGGVDSSVVAMLLHRAIGKKLTCVFVDNGLLRLNEAKQVMEMFGDHFGLNIVHVDAENRFLDALKGEADPEAKRKIIGRVFVEIFDEEAKKCVNAKWLAQGTIYPDVIESAGSATGKAHVIKSHHNVGGLPDDMELGLVEPLRELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEVDGISRVVYDISGKPPATIEWE

SEQ ID NO: 69508 - protein, 338 aa, Gloeobacter violaceus PCC 7421
MTIKVAINGFGRIGRNFLRCWLGRKQSDFEVVAINDTSDPNTNAHLLKYDSMLGQFSGEVSADENSLTANGHTIKCFSDRNPLNLPWKDWGVDLVIESTGVFTSRDGASKHLAAGAKKVLITAPGKNDDGTFVMGVNDHNYDPEKHTIISNASCTTNCLAPVAKVLHENFKIVKGTMTTIHSYTGDQRLLDASHRDWRRARAAALSIVPTSTGAAKAIGLVLPELKGKLDGLAFRVPTPNVSVVDLVVEVEKPTLVEQVNHVLKEASENELKGILAFSEIPLVSIDYRITDVSSIVDAQLTMVLKDNLVKVISWYDNEWGYSQRVVDLAELVARKWAA

SEQ ID NO: 69509 - protein, 506 aa, Yersinia pseudotuberculosis
MRYAHPGTPEALVSFKAIYGNYIGGEFIEPLGGQYFMNTSPVNGSDIAQFPRSDARDIDAALDAAHQAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDIFPAGVINVVQGYGREAGEALARSKRIAKIAFTGSTPVGRHIMACAAENIIPCTVELGGKSPNIYFADVMEAEPEFIDKAVEGLVLGFFNQGEVCTCPSRALIHESIYAPFMARVMTKVANIRRGDPLDTETMIGAQASRQQFDKILSYIDIARKEGGEILTGGARATITPALDSGFYIQPTLIKGDNLMRCFQEEIFGPVIGVTTFKDEAEALAIANQTQFGLGAGIWTRDAHLAYRMGRGIKAGRVWTNCYHVYPAHAAFGGYKQSGVGRETHKMALNQYQQTKNLLVSYDTAPLGLF

SEQ ID NO: 69510 - protein, 376 aa, Vibrio fischeri ES114
MKYLCMACNKEYAPKPELIKCECGSALWVKPQTSFSKKDLIENEFTPRRYSSAFPVKKDDINITFNEAITPLCQAEISGTPILVKLDSLQPTGSFKDRGASLVINYLNNHGITSIAEDSSGNGGSAYAGYAAKGNMQCNIFVPAGTSKGKTTQTRLYGANCIEVEGTREDVALAAIESSVTHGSHYVGHNWHPLFIEGVKSIAYEIWEQCGYKAPDNFVVPAGNGSLLAGAYIGFSELLKGGEISKLPRLFGIQSESIQPFVQTFNNKEINITSEDTIAEGIKIKRSSRMNEIVQFVKETNGNFISVNEQQIQSALKEMGAQGYFIEPTSATAFAGIAQLIKTQEIKPDELTVGVVTGNGLKATNSIEHLINDMRG

SEQ ID NO: 69511 - protein, 1015 aa, Pseudomonas fluorescens Pf-5
MTNLSHPAPQFSPRDAEQLAEQLFNVVATASPLDGERDCNYRLNTASDAGWILKVVNSSEPRTESELQTAILSHLASYNPELAVPQLKKSLAGGFLASAVAPSGETHAVRLVSWLHGTPLAEVKRTFALMCSLGQSFADMDRALQGFMHPGAVRDLDWDLRHAARSRSRLHFVKDPGRRAILERFISAFENTVQPRLARLRTQVIHNDGNDWNILVDPQTHQQVSGIIDFGDAVHTVLIAEVAITCAYSILDMEDPIGAAAALTAGFHERYPLQPQELDVLFNLIAMRLVISVTLSASRHEQTQDNPYLAISEAPAWRLLEKMDRMNPRLATAILRKACGYDAIEGAGAVRRWVDENRHAFADIVHPAAAPLNKAIVPFADAAHVLTVASAEQRPAEAAKWWNDFAAEHQVPLGIGPWGEERTIYTDAAFESRFIAGQRRIIHLGVDLIMPAGTPLYTPLAGVVRSVEVEREPLGYGGLIMLEHSPEGCPPFLTLWGHMAHEALTRLKPGDRLEAGALVGHMGADTENGGWLPHVHFQMSTDTQLQASEFIGVGERAYLEVWADLFPDASTLAGIPAETYSQEGRSKAEIVAKRKQLLLPNLSISYSDPIKFVRGDGVWLIDNFGRAYLDCFNNVCHLGHSHPDVVQALARQASRLNTNTRYLHDNIVEYAERLTATLPEGLAVASFGCSGSEANSLMLRMARNHTGRNDAIVLDWAYHGTTQELIDLSPYKYKRKAGKGRAEHVFEAAVPDAYRAADHWPFEELGKRFAQSVAEQIDSMRKQGRAPAFFLAESIPSVAGQLFFPENYLQEVYAMVRAEGGLCLADEVQVGFGRVGSHWWAFETQGVVPDAVSMGKPIGNGHPMSAVVTTREIADSFNNGMEYFNTFAGNPVSCAVGLSVLDVIERDNLKLNALTVGNYLLDGFRTLQQRYDAIGDVRGLGLFLGIELVTDRKSKAPATQLARKVADGARERGILIGTEGPYDNVLKMRPSMIFSQKNADFLLEVLDESFKAALR

SEQ ID NO: 69512 - protein, 397 aa, Bacteroides thetaiotaomicron VPI-5482
MNQLSDRLNSLSPSATLAMSQKSNELKAQGIDVINLSVGEPDFNTPDHIKEAAKKAIDDNFSRYSPVPGYPALRNAIVEKLKKENGLEYTAAQISCANGAKQSVCNAILVLVNPGDEVIVPAPYWVSYPEMVKMAEGTPVIVSAGIEQDFKITPKQLEAAITPKTKALILCSPSNPTGSVYSKEELAGLAAVLAKYPQVVVIADEIYEHINYIGAHQSIAQFPEMKERTVIVNGVSKAYAMTGWRIGFIAGPEWIVKACNKLQGQYTSGPCSVSQKAAEAAYVGTQEPVKEMQKAFERRRDLIVKLAKEVPGFEVNVPQGAFYLFPKCSYFFGKSNGERKIENSDDLAMYLLEDAHVACVGGTSFGAPECIRMSYATSDENIVEAIRRIKEALAKLK

SEQ ID NO: 69513 - protein, 404 aa, Bacteroides thetaiotaomicron VPI-5482
MEEIKMDRIEDAIADFKEGKFVIVVDDEDRENEGDLIIAAEKITPEKVNFMLKHARGVLCAPITVSRCKELDLPHQVSDNTSVLGTPFTVTIDKLEGCSTGVSASDRAATIQALADPASTPATFGRPGHINPLYAQEKGVLRRAGHTEATIDMARLAGLYPAGALMEIMSDDGTMARLPELRAMADEHGLKLISIHDLIAYRLKQESIVEKGVEVNMPTEHGMFRLIPFRQKSNGLEHMAIFKGTWNEDEPILVRVHSSCATGDILGSHRCDCGEQLHKAMEMIEKEGKGVVVYLNQEGRGIGLMEKMKAYKLQEDGMDTVDANLCLGHLADERDYGVGAQILRELGVHKMKLLTNNPVKRVGLEAYGLEIVENVPVETVPNPYNERYLRTKKERMGHTLHFNK

SEQ ID NO: 69514 - protein, 435 aa, Bacteroides thetaiotaomicron VPI-5482
MKQDMIVILDLGSHENTVLARAIRALGVYSEIYPHDITVEELKALPNVKGIIINGGLNNVIDGVAIDVNPSIYTMGIPVMAAGHDKATCAVKLPAFTDDIEAIKAAIKSFVFDTCQAEANWNMANFVNDQIELIRRQVGDKKVLLALSGGVDSSVVAALLLKAIGENLVCVHVNHGLMRKGESEDVVEVFSNQLKANLVYVDVTDRFLDKLAGVEDPEQKRKIIGGEFIRVFEEEARKLDGIDFLGQGTIYPDIVESGTKTAKMVKSHHNVGGLPEDLKFQLVEPLRQLFKDEVRACGLELGLPYEMVYRQPFPGPGLGVRCLGAITRDRLEAVRESDAILREEFQIAGLDKKVWQYFTVVPDFKSVGVRDNARSFDWPVIIRAVNTVDAMTATIEPVDWPILMKITDRILKEVKNVNRVCYDMSPKPNATIEWE

SEQ ID NO: 69515 - protein, 355 aa, Escherichia coli
  misc_feature (74)..(74): Xaa can be any naturally occurring amino acid
  misc_feature (88)..(88): Xaa can be any naturally occurring amino acid
  misc_feature (117)..(117): Xaa can be any naturally occurring amino acid
  misc_feature (122)..(122): Xaa can be any naturally occurring amino acid
  misc_feature (165)..(165): Xaa can be any naturally occurring amino acid
  misc_feature (213)..(213): Xaa can be any naturally occurring amino acid
  misc_feature (277)..(277): Xaa can be any naturally occurring amino acid
  misc_feature (312)..(312): Xaa can be any naturally occurring amino acid
HHHHHHTDPALRAIIERCRELALRAPARVVFPDALDQRVLKAAQYLHQQGLATPILVANPFELRQFALSHGVAXDGLQVIDPHGNLAXREEFAHRWLARAGEKTPPDALEKLTDPLXFAAAXVSAGKADVCIAGNLSSTANVLRAGLRIIGLQPGCKTLSSIFLXLPQYSGPALGFADCSVVPQPTAAQLADIALASAETWRAITGEEPRVAXLSFSSNGSARHPCVANVQQATEIVRERAPKLVVDGELQFDAAFVPEVAAQKAPASPLQGKANVXVFPSLEAGNIGYKIAQRLGGYRAVGPLIQGLAAPXHDLSRGCSVQEIIELALVAAVPRQTEVNRESSLQTLVEGLCGR

SEQ ID NO: 69516 - protein, 365 aa, Magnetospirillum magnetotacticum MS-1
MKDILEKLEERRAQARLGGGERRLEAQHKRGKLTARERIELLLDHGSFEEFDMFVQHRSTDFGMENQKIPGDGVVTGWGTVNGRTVFLFSKDFTVFGGSLSEAHAAKIVKVQDMALKMRAPIIGIFDAGGARIQEGVAALGGYGEVFRRNVAASGVIPQISVIMGPCAGGDVYSPAMTDFIFMVRDTSYMFVTGPDVVKTVTNEVVTAEELGGAKVHTSKSSIADGSFENDVEAILQIRRLLDFLPANNIEGVPEIESFDDVNRLDKSLDTLIPDNPNKPYDMGELIRRVVDEGGFLRDPAAYARNIITGFAASRGVRSACPNHPLCCRVLDRRFAQPPLLRFATPFDSDLHLSTPAPSERAICA

SEQ ID NO: 69517 - protein, 335 aa, Thermoplasma volcanium GSS1
MKAAILKKINEPVSIDDVDIPDPAENEVLIKQEYAGVCYRDLLAATGFFPRIALPMIQGHEIGGTVVKVGDKVEAFRPGDKVSSLIYIPCGKCEFCRSGNENLCPYKKSLGEEVQGGFRQYVNIPEISLVKAPNNVDGASLSLAACVTGMLYHALKRMGKAGEGKKVLITGAGGGVGIHAVEMAKAFGATVIAETTSPEKLDLLEKIGADYIVDGNSKFNEDVKKLGGADIVLECVGIYTFERSLRSLNNGGKMVIIGNVKPDPVSLPLGLIILKGNTIRGSISSTKKDVEEALNMVSKGMIKPIVGKEIDISQINEAYKLMKDKKSSGRIMIKF

SEQ ID NO: 69518 - protein, 532 aa, Oryza sativa Japonica Group
MADEATTTPLLASYKAKPAKAPSIDDAIETYIGATGAGQLFKAILLAFAWAFDAQQVFISVFTDAEPRWHCTAGADPSCSPGAASPCALPPGAWAWDRPAETSVVSEWALKCAGPALVSLPASSFFAGCLAGGFLLTTLADSLLGRRKMLLVSLASMSVAGVLTAFSPNVWAYAALRFVCGFGRSMVGTCALVLSTELVGKRWRDTVSVAGFVCFTVGFLSLPALAYTFREASWRSMYLWTSLPSLGYAILLYFLVQESPRWLLVRGRKHDAIETVRQIAALNGGGGITCSFSMLHACATEREDDSAGGAGGGGGGVFATLRSMWERRWALRRLAAIMTASFGVGMVYYGMPLNVGNLGSNLYLSVTYNALAEFPSSVLSWLLMGRINRRSSVVALTAAAGVCSLACVAIPEGTGGRMAAEVLSFFATCTAFNIILMYSIELFPTSVRNSAVGMVRQALVLGGVAAPMLVALGRERSFWSFGVFGLAVGCLGLFAVCLPETRGRSMSDTMEEEEHKEAAAAIGDMDSNADLV

SEQ ID NO: 69519 - protein, 181 aa, Zea mays
MASSMLSSATVVSSPAQAAMVAPFTGLKSSAAFPVTRKTDTDITSMASNGGRVNCMKVWPPVGKKKFETLSYLPDLTDVELSKEVDYLLRNKWIPCVEFELEHGFVYREHGNTPGYYDGRYWTMWKLPLFGCTDSAQVLKEVQECKKEYPNAFIRIIGFDNNRQVQCISFIAYKPPSFTGA

SEQ ID NO: 69520 - protein, 745 aa, Thermoplasma volcanium GSS1
MDNSSGIILRVAEANSTDPGMSRVRLDESSRRLLDAEIGDVVEIEKARKTVGRVYRARPEDENKGIVRIDSVMRNNCGASIGDKVRVRKVRTEIAKKVTLAPIIRKDQRLKFGEGIEEYVQRALIRRPMLEQDNISVPGLTLAGQTGLLFKVVKTMPGKVPVEIGEETKIEIREEPASEVLEEVSRVSYEDIGGLSEQLGKIREMIELPLKHPELFERLGITPPKGVILYGPPGTGKTLIARAVANESGANFLSINGPEIMSKYYGQSEQKLREIFSKAEETAPSIIFIDEIDSIAPKREEVQGEVERRVVAQLLTLMDGMKERGHVIVIGATNRIDAVDPALRRPGRFDREIEIGVPDRNGRKEILMIHTRNMPLGMDEEQKNKFLEEMADYTYGFVGADLAALVRESAMNALRRYLPEIDLDKPIPTEILEKMVVTEEDFKNALKNIEPSSLREVMVEVPNVHWDDIGGLEDVKREVKETVELPLLKPDVFKRLGIRPSKGFLLYGPPGVGKTLLAKAVATESNANFISIKGPEVLSKWVGESEKAIREIFKKAKQVAPAIVFLDEIDSIAPRRGTTSDSGVTERIVNQLLTSLDGIEVMNGVVAIGATNRPDIMDPALLRAGRFDKLIYIPPPDKDARLSILKVHTKNMPLAPDVDLDSIAQRTEGYVGADLENLCREAGMNAYRENPDATQVSQKNFIDALKTIRPSIDEEVIKFYKSISETMGKSVSEKRKELQDQGLYL

SEQ ID NO: 69521 - protein, 119 aa, Zea mays
MTNQPMKVYKWDMDETLILLKSLLVGSYARDFEGLKDREKSTQTRKRWENLILELCDEHFFYEEMFLVWFTGFFDSGFAAECRSKRDSPSLFSHARSIMYTLKEKGIDMVIASRSPPRT

SEQ ID NO: 69522 - protein, 1151 aa, Saccharomyces cerevisiae
MDQDNNNHNDSNRLHPPDIHPNLGPQLWLNSSGDFDDNNNNNNNNNNNNSTRPQMPSRTRETATSERNASEVRDATLNNIFRFDSIQRETLLPTNNGQPLNQNFSLTFQPQQQTNALNGIDINTVNTNLMNGVNVQIDQLNRLLPNLPEEERKQIHEFKLIVGKKIQEFLVVIEKRRKKILNEIELDNLKLKELRIDNSPQAISYLHKLQRMRLRALETENMEIRNLRLKILTIIEEYKKSLYAYCHSKLRGQQVENPTDNFIIWINSIDTTESSDLKEGLQDLSRYSRQFINNVLSNPSNQNICTSVTRRSPVFALNMLPSEILHLILDKLNQKYDIVKFLTVSKLWAEIIVKILYYRPHINKKSQLDLFLRTMKLTSEETVFNYRLMIKRLNFSFVGDYMHDTELNYFVGCKNLERLTLVFCKHITSVPISAVLRGCKFLQSVDITGIRDVSDDVFDTLATYCPRVQGFYVPQARNVTFDSLRNFIVHSPMLKRIKITANNNMNDELVELLANKCPLLVEVDITLSPNVTDSSLLKLLTRLVQLREFRITHNTNITDNLFQELSKVVDDMPSLRLIDLSGCENITDKTIESIVNLAPKLRNVFLGKCSRITDASLFQLSKLGKNLQTVHFGHCFNITDNGVRALFHSCTRIQYVDFACCTNLTNRTLYELADLPKLKRIGLVKCTQMTDEGLLNMVSLRGRNDTLERVHLSYCSNLTIYPIYELLMSCPRLSHLSLTAVPSFLRPDITMYCRPAPSDFSENQRQIFCVFSGKGVHKLRHYLVNLTSPAFGPHVDVNDVLTKYIRSKNLIFNGETLEDALRRIITDLNQDSAAIIAATGLNQINGLNNDFLFQNINFERIDEVFSWYLNTFDGIRMSSEEVNSLLLQVNKTFCEDPFSDVDDDQDYVVAPGVNREINSEMCHIVRKFHELNDHIDDFEVNVASLVRVQFQFTGFLLHEMTQTYMQMIELNRQICLVQKTVQESGNIDYQKGLLIWRLLFIDKFIMVVQKYKLSTVVLRLYLKDNITLLTRQRELLIAHQRSAWNNNNDNDANRNANNIVNIVSDAGANDTSNNETNNGNDDNETENPNFWRQFGNRMQISPDQMRNLQMGLRNQNMVRNNNNNTIDESMPDTAIDSQMDEASGTPDEDML

SEQ ID NO: 69523 - protein, 379 aa, Oryza sativa Japonica Group
MALRGGHAAAAAGVSSGSEDDDEEAGFSRSYFLAKEKEPSSGKKRARAAGKLSDLNLVDEQVLRASLAEIPPKHEREVEALTRSYKEQYRNWLFELRCGFGLLMYGFGSKKMLLEDFASTTLSDFTVIVVNGYLPSINLKQVIVTIAEIFWEQTKLKRKRQTATRSQLQPFASQSIDDIISFLNNQTSDNGDDNVCLLIHNIDGPALRDAESQQYLAQVSCCPQVHVVASVDHVNAPLLWDKKMVHTQFKWSWYHVPTFAPYKVEGVFYPLILASGGHAQTMKTALVVLQSLTPNAQSVFRVLAEYQLAHEKEEGMHFSSLYTKCRERFLVSSQVTLNSHLTEFKDHDLVKIRKHSDGQDCLHIPLVSDALEKLLQELT

SEQ ID NO: 69524 - protein, 718 aa, Vitis vinifera
  misc_feature (493)..(493): Xaa can be any naturally occurring amino acid
MGSQKKRNFQIEAFKHRVVVDPKYADKTWKILEHAIHEIYNHNASGLSFEELYRNAYNMVLHKFGEKLYSGLVSTMTSHLKDISKFIEAAQGGLFLEELNRKWADHNKALQMIRDILMYMDRTFIPSTHKTPVHELGLNLWRDNIIHSSKIQTRLLNTLLELVLRERNGEVINRGLMRNIIKMLMDLGSSVYQEDFEKPFLEVSADFYRVESQKFIECCDCADYLKKAERRLNEEMERVSQYLDAKSEVKITNVVEKEMIANHMLRLVHMENSGLVNMLLDDKYDDLGRMYNLFRRVPNGLSTIREVMTSHIRDTGKHLVTDPERLRDPVEFAHHLTNDKTFQNALTSSFEYFINLNPRSPEFISLFVDDKLRKGLKGVSEEDVEIILDKVMMLFRYLQEKDVFEKYYKQHLAKRLLSGKTVSDDAERSLIVKLKTECGYQFTCKLEGMFTDMKTSQDTMQGFNSAHGADLGDGPTLAVTVLTTGSWPTQPSXTCNLPTEMLALCEKFRSYYLGTHTGRRLTWQTNMGTADIKATFAKGQKHELHVSTYQMCVLMLFNNADRLSYKEIEQATEIPASDLKRCMQSMACVKGKNVLRKEPMSKDIGEDDVFFVNDKFTNKLYKVKIGTVVAQKETEPEKQETRQRVEEDRKPQIEAAIVRIMKSRRVLDHNNLIAEVTKQLQSRFLANPVEIKKRIESLIERDFLERDNVDRKLYRYLA

SEQ ID NO: 69525 - protein, 365 aa, Nocardia farcinica IFM 10152
MSEAETRSSSATPVSSEAPGSSEAQGSPGTQNGSYVEPGEFKRDTNYITTRITADGRDGYPVEPGRYRLVAARACPWANRTLIVRRLLGLEDVLSLGLCGPTHDKYSWTFDLDPGGVDPVLGIPRLRDAYLARFPDYPRGITVPAVVDVPTGQVVTNDYAQITLDFSTEWTAYHRPGAPDLYPERLRAEIDEVADVIFRDVNNGVYRCGFAGAQDAYERAYDRLFARLDWLSERLTDQRYLVGDTITEADVRLFTTLVRFDPVYHGHFKCNRQKLSEMPVLWAYARDLFQTPGFGDTIDFDQIKTHYYVVHADINPTRVVPKGPDLSGWLTPHGREALGGRPFGDGTPPPPPKPDERVPALLAPA

SEQ ID NO: 69526 - protein, 436 aa, Pseudomonas aeruginosa
MRISIFGLGYVGAVCAGCLSARGHEVIGVDVSSTKIDLINQGKSPIVEPGLEALLQQGRQTGRLSGTTDFKKAVLDSDVSFICVGTPSKKNGDLDLGYIETVCREIGFAIREKSERHTVVVRSTVLPGTVNNVVIPLIEDCSGKKAGVDFGVGTNPEFLRESTAIKDYDFPPMTVIGELDKQTGDLLEEIYRELDAPIIRKTVEVAEMIKYTCNVWHAAKVTFANEIGNIAKAVGVDGREVMDVICQDHKLNLSRYYMRPGFAFGGSCLPKDVRALTYRASQLDVEHPMLGSLMRSNSNQVQKAFDLITSHDTRKVGLLGLSFKAGTDDLRESPLVELAEMLIGKGYEFRIFDRNVEYARVHGANKEYIESKIPHVSSLLVSDLDEVVASSDVLVLGNGDELFVDLVNKTPSGKKLVDLVGFMPHTTTAQAEGICW

SEQ ID NO: 69527 - protein, 432 aa, Clostridium difficile 630
MDSINFAKNLIDFIYDSPSSFHAVESTKEILDKNGFEELVLNQRWNLRVGGKYYVTKNLSAIVAFVVNSEGIERDGFRIIGSHSDSPTFSIKPNAEIEAEKSYLKLNTECYGGAILSTWLDRPLGIAGRVVLKGDSILKPNERLIDFKKPICIIPNLAIHLNRSINDGHSYNKQKDMLPLVGMLNDTLEKDNFLIKQIASNLDVNMEDIIDFDLFLYEFEKGSLIGANDEFISIGRQDNLAMVHASLNALVNTKGQHGVNVMAVFDNEEVGSSTKQGADSNMLLNILERICISMGKDREGFFESIYSSFMISSDLAHAIHPNIPEKHDPTNKPIMGKGPVIKINASQAYTSDGYSIAIYKNICREANVEYQEFVNRSDERGGSTIGPISSTHIDIPSVDVGSPILAMHSIRELGNVEDHYSIYKTFSKFFEI

SEQ ID NO: 69528 - protein, 567 aa, Vitis vinifera
MAINHRFFLIYRMINMGQRGSRTPDRRVHTKQQPAQRPGVRLRRRRRTSPADLRSVHFPSGSPTPAIEISEKLISFTFYLVQLFSYLPSSFLLVRAPEGFSLWCGPPFNNGQPAVKLEKVICTNAKFSEDGSRLMVMKSDSTVSIYDCSSSKEIRSFAVPNMSAATMSPCGTYLQTFQRPSTPQEKNVILWKTETGAPVYQHFQKNMTKTTWPSVQFSSDEAIACRLATNEIQFFDARDFSKEIIYRVRIPGIAAVELSKAPGSHVAAFIPESKGIPASVQIFACGENSMSQPVARRSFFRCSTVQLSWNRGSTGLLVLVQADVDKTNQSYFGESKMNYLTTNGTHEGLVPLSKEGPVHDVQWSYSGSEFAVVYGFLCLAGFGNLPGDMAFWDYKEKKQLGTTRAEWSVTSEWSPDGCYFMTATTAPRLQVDNGIKIFHPNGSLYFKTMFDKLYQADWKPESPDRFGEIAELAQSIDSLKVGETKQQGQGSKSSVAPNKATSANPPTQKPAAYRPPHAKTAAAIQTKLFGGSSTEEMSKNAAKNKKKREKQREKKAAEAATAANNGA

SEQ ID NO: 69529 - protein, 375 aa, Pinus banksiana
QVIKCKAAVAWGAGEPLKIEEVEVDPPQSMEVRIKVHYTALCHSDLIFWEAKGQTPLFPRIFGHEAAGIIESVGEGVTDLKEGDTVLPVFTGECKECRHCKSEESNMCDLLRVDIETGVMKSDGKSRFSINGKPIYHFAGTSTFSEYTVVHSGCVAKINPKAPLNKVCILSCGVSTGMGAALNVAKPKQGSTVAIFGLGTVGLAAAEGSRMAGASRIIGIDLNSDKFERAKLFGVTESLNPLDYEKSIQQVIAEKTDGGVDYSIECTGNVKAMIQAFESCHIGGGVTVLVGFPPSDAVFATNPLNFLCERTLKGTFFGNYKPLSHLPGLVELYLNKKLELEKFITHEVSFADINKAFDYMIKGESLRCVINVIGN

SEQ ID NO: 69530 - protein, 250 aa, Solanum tuberosum
MVRIAFGSIGDSLSVGSLKAYLAEFIATLLFVFAGVGSAIAYNKLTSDAALDPAGLVAIAVAHAFALFVGVSMAANISGGHLNPAVTLGLAVGGNITTLTGLFYWVAQLLGSTVACLLLKYVTNGLAVPTHGVAAGMNGAEGVVMEIVITFALVYTVYATAADPKKGSLGTIAPIAIGFIVGANILAAGPFSGGSMNPARSFGPAVVAGDFSQNWIYWVGPLIGGGLAGFIYGDVFIGSHTPLPTSEDYA

SEQ ID NO: 69531 - protein, 989 aa, Arabidopsis thaliana
MRIDENEGVSASSKHLVFAYYVTGHGFGHATRVVEVVRHLIAAGHDVHVVTGAPDFVFTSEIQSPRLKIRKVLLDCGAVQADALTVDRLASLEKYVETAVVPRAEILETEVEWLHSIKADFVVSDVVPVACRAAADAGIRSVCVTNFSWDFIYAEYVMAAGYHHRSIVWQIAEDYSHCEFLIRLPGYCPMPAFRDVIDVPLVVRRLHKSRKEVRKELGIAEDVNVVILNFGGQPSGWNLKETSLPTGWLCLVCGASETLELPPNFIKLAKDAYTPDIIAASDCMLGKIGYGTVSEALSYKVPFVFVRRDYFNEEPFLRNMLEFYQCGVEMIRRDLLMGQWTPYLERAVSLKPCYEGGINGGEIAAHILQETAIGRHCASDKLSGARRLRDAIILGYQLQRVPGRDIAIPEWYSRAENELGQSAGSSPTVQANENNSLVESCIDDFDILQGDVQGLSDTCTFLKSLAMLDAIHDSEKSTEKKTVRERKAAGGLFNWEEEIFVARAPGRLDVMGGIADYSGSLVLQMPIREACHVAAQRNLPGKHRLWKHAQARQQAKGQVPTPVLQIVSYGSEISNRAPTFDMDLSDFMDGDEPISYEKARKFFAQDPAQKWAAYVAGTILVLMIELGVRFEDSISLLVSSAVPEGKGVSSSAAVEVASMSAIAAAHGLSIDPRDLAILCQKVENHIVGAPCGVMDQMTSSCGEANKLLAMICQPAEVVGLVEIPNHVRFWGIDSGIRHSVGGADYRSVRVGAYMGRKMIKSMASSILSPSASSANGGNPEELEDEGIDLLEAEASLDYLCNLSPHRYEARYADKLPDIMLGQTFIEEYADHDDPVTVIDEKRSYSVKAPARHPIYENFRVKTFKALLTSATSDEQLTALGGLLYQCHYSYSACGLGSDGTNRLVQLVQGMQHNKSNSEDGTLYGAKITGGGSGGTVCVVGRNSLRSSQQILEIQQRYKAATGYLPLIFEGSSPGAGKFGYLRIRRRISL

SEQ ID NO: 69532 - protein, 1287 aa, Shewanella oneidensis MR-1
MFNKSFIAIAIGLTGISQASQENLKAYSWQNKVNYVINADADVRADHSGRSRYIIQLMQAPAATHAAQLFNKAPQDRTSVSKASITQKLPQKISHLLQTSQLEQYRQEIAHHQGIFKTTASKTLGRPLQAKMQFDTAFNGMVLELTPDEAKTMLTVPQVLKVIKETPTELQTDNGPQLIGASNLWDGNATGLAAKGDGIIIGILDTGINTDNRAFSAVGDDGHNIINPLGSGNYLGDCVKDATLCNDKLIGVYSFPLVTDEYNGLRPANGEDYNGHGSHTASTAAGNALVNVPVLMPNIGEEVGDGIETGTVLSNISGVAPHANIISYQVCDQSGCYPSLTIASVELAIKAGVDVLNYSIGPRGGVQNDPWNTASDIAFLSAREAGIFVAMAAGNAGPDAETVGNVAPWAISVAASSHQRVWSHVLSGSGVTGDPLPQIEGLADVFTSNGVINALSDETEIVYAGDYKDINGNSLALCNSRVYFFDPVMADLRGKVVICDRGEISLADKVTNMFFAAGVIIRNTPTSNQNMASARYALPSLLINELDGKQLLEWMKRTDTPKVSISAANAEYDQANADILADFSSRGPYKWQTELMVPHIAAPGVDIYAAYADEMPFTSVNDAAPSDFAFLSGTSMASPHVAGSAALLRQLHPDWTPAEIQSAMMLTATTNVLKEDGKTPAGIFDIGSGRLQIDKAAQAGLVMDVPIDEYKAANPELGGDVTSLNLPVLTSTQCMNSCSWTRTLRATRDGSWTVSSNGNVDGVTISASPSSFDIKEGESVTVTFTANIALRANEDWSFMQVNLAPSDNSPMLSLPVAVKPLIALVPAFITQDYFWNKGDLELADFHFRYPENLLFNIKPLEKATSYHLTLAADSDNRSPFDNVNDGTALSFINVPDGSSNLRVIVGESSAIDIDVFIGLDSNNNGIPEIVELTQACATSMNVGEACRLNAGSGRYWVLAHNYKGSGDPLDAVRLDVLLQPNTETLPALVTIPNMSTKPYDALSAHLSWSGDMIEGVYYSELEVFDRNTPTAARAIARSNLVVNRVKPSVKIDLVKGDLSHRKEAELNIQLPTNPTSDSLTYTLNLAMADNLTITDVETNGDISLNHDKNNIKVTLAPGETSTLIVAKINQKSPISGDFKVDWSLNTDKSDFDVQQGSLMVSNTNKAPSLAVPKEIKGNMGSDVKFNIVSEDANQDPLSYTVTQISGPAVDIKDDGKGEVILSLPEVNSSQVAKFNVNVTDGEFSQSSDMSLEITYINTENSGGAIFWSIVLLGLFGLRRKRLRTRSY

SEQ ID NO: 69533 - protein, 375 aa, Pinus banksiana
QVIKCKAAVAWAAGEPLKIEEVEVAPPQAMEVRIKIHYTALCHTDVYFWEAKGQTPLFPRILGHEAAGVVESVGEGVTDLKEGDTVLPVFTGECGECRHCKSEESNMCDLLRINTERGVMISDGKTRFSKDGKPIYHFLGTSTFSEYTVAHAGCVAKINPEAPLDKVCVLSCGASTGMGAALNVAKPKKGSTVAVFGLGAVGLGAAEGARIAGASRIIGIDLISERFEKAKLFGVTEFINPLDHAKPVQEVIAEKTDGGVDYSIECTGNVKAMIQAFESCHDGWGVAVLVGVPHSDAVFQTSPLNFLTERTLKGTFYGNYKPRSDLPGLVEMYLAKKIELEKFITHEVSFADINKAFDYMLKGESLRCIINLIGN

SEQ ID NO: 69534 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNVCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARMAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLQLERFITHEVSFADINKAFDYMIKGESLRCVTNVIGN

SEQ ID NO: 69535 - protein, 1849 aa, Haemophilus influenzae
MLNKKFKLNFIALTVAYALTPYTEAALVRDDVDYQIFRDFAENKGKFSVGATNVEVRDKKNQSLGSALPNGIPMIDFSVVDVDKRIATLVNPQYVVGVKHVSNGVSELHFGNLNGNMNNGNAKSHRDVSSEENRYYTVEKNNFPTENVTSFTTKEEQDAQKRREDYYMPRLDKFVTEVAPIEASTANNNKGEYNNSDKYPAFVRLGSGSQFIYKKGSRYQLILTEKDKQGNLLRNWDVGGDNLELVGNAYTYGIAGTPYKVNHENNGLIGFGNSKEEHSDPKGILSQDPLTNYAVLGDSGSPLFVYDREKGKWLFLGSYDFWAGYNKKSWQEWNIYKHEFAEKIYQQYSAGSLTGSNTQYTWQATGSTSTITGGGEPLSVDLTDGKDKPNHGKSITLKGSGTLTLNNHIDQGAGGLFFEGDYEVKGTSDSTTWKGAGVSVADGKTVTWKVHNPKYDRLAKIGKGTLVVEGKGKNEGLLKVGDGTVILKQKADANNKVQAFSQVGIVSGRSTLVLNDDKQVDPNSIYFGFRGGRLDLNGNSLTFDHIRNIDDGARVVNHNMTNTSNITITGESLITNPNTITSYNIEAQDDDHPLRIRSIPYRQLYFNQDNRSYYTLKKGASTRSELPQNSGESNENWLYMGRTSDEAKRNVMNHINNERMNGFNGYFGEEETKATQNGKLNVTFNGKSDQNRFLLTGGTNLNGDLNVEKGTLFLSGRPTPHARDIAGISSTKKDPHFTENNEVVVEDDWINRNFKATTMNVTGNASLYSGRNVANITSNITASNNAQVHIGYKTGDTVCVRSDYTGYVTCHNSNLSEKALNSFNPTNLRGNVNLTENASFTLGKANLFGTIQSIGTSQVNLKENSHWHLTGNSNVNQLNLTNGHIHLNAQNDANKVTTYNTLTVNSLSGNGSFYYWVDFTNNKSNKVVVNKSATGNFTLQVADKTGEPNHNELTLFDASNATRNNLEVTLANGSVDRGAWKYKLRNVNGRYDLYNPEVEKRNQTVDTTNITTPNDIQADAPSAQSNNEEIARVETPVPPPAPATESAIASEQPETRPAETAQPAMEETNTANSTETAPKSDTATQTENPNSESVPSETTEKVAENPPQENETVAKNEQEATEPTPQNGEVAKEDQPTVEANTQTNEATQSEGKTEETQTAETKSEPTESVTVSENQPEKTVSQSTEDKVVVEKEEKAKVETEETQKAPQVTSKEPPKQAEPAPEEVPTDTNAEEAQALQQTQPTTVAAAETTSPNSKPAEETQQPSEKTNAEPVTPVVSENTATQPTETEETAKVEKEKTQEVPQVASQESPKQEQPAAKPQAQTKPQAEPARENVLTTKNVGEPQPQAQPQTQSTAVPTTGETAANSKPAAKPQAQAKPQTEPARENVSTVNTKEPQSQTSATVSTEQPAKETSSNVEQPAPENSINTGSATTMTETAEKSDKPQMETVTENDRQPEANTVADNSVANNSESSESKSRRRRSVSQPKETSAEETTVASTQETTVDNSVSTPKPRSRRTRRSVQTNSYEPVELPTENAENAENVQSGNNVANSQPALRNLTSKNTNAVLSNAVAKAQFVALNVGKAVSQHISQLEMNNEGQYNVWISNTSMNKNYSSEQYRRFSSKSTQTQLGWDQTISNNVQLGGVFTYVRNSNNFDKASSKNTLAQVNFYSKYYADNHWYLGIDLGYGKFQSNLQTNNNAKFARHTAQIGLTAGKAFNLGNFAVKPTVGVRYSYLSNADFALAQDRIKVNPISVKTAFAQVDLSYTYHLGEFSITPILSARYDANQGNGKINVSVYDFAYNVENQQQYNAGLKLKYHNVKLSLIGGLTKAKQAEKQKTAEVKLSFSF

SEQ ID NO: 69536 - protein, 338 aa, Triticum aestivum
  misc_feature (318)..(318): Xaa can be any naturally occurring amino acid
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAATRAAKSAGILCSYDPNVRLPLWPSAQAARDGIMSIWKEADFIKVSDEEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGXAIPALPTTATALELISKGSN

SEQ ID NO: 69537 - protein, 175 aa, Bdellovibrio bacteriovorus HD100
MPMINQPAPHFAAQAVFDGGEVKDISLNDFKGKWVVLFFYPLDFTFVCPTELTQFREHLKEFQNAGATVIGCSVDSVHSHKRWLRDDLGNLGYPLMADLTKRIARDYGVLFEDRGIATRGTFIIDPDQKIQYMGIHNTSVGRDAKEILRVLQGCQTGELCQAGWKAGDEHITPIK

SEQ ID NO: 69538 - protein, 363 aa, Exiguobacterium sibiricum 255-15
MMTKLVTAVEDTTKVKTMRALVKEERGFGAVLKEVAVPSPKRGEVLIRVEATSICGTDVHIYEWDAWAASRVNPPYVFGHEFSGEVVELGEGTKRLKLGDRVSAETHIVCHQCKQCLRGQYHICKNTKIIGVDTQGCFAEYVVMPEENLWVNPEDMPAAIASIQEPMGNAVHTVLASDVSAKTVAIVGCGPIGLMAVSVAKAAGAAEVIAIDVNPYRLELAKTMGADVVIDSRHEDVLERVRMMTDGDGIDVVCEMSGHPVAIRQAFEMVTAGGDVNILSLPVKPVEIDLTNHVVFKGVRVQGITGRKMYETWSQVSAFLSSGKVDVKPLITHTLPLERFEEGFELMRQGKCGKVVLQPRGTN

SEQ ID NO: 69539 - protein, 515 aa, Oryza sativa Japonica Group
MADAATTPLLTSHEAKPAKALSIDDAIETYIGATGARQLLTAMLLAFAWAFEAQQVFMSVFTDAEPTWHCTGVAAGDPGSFCSLAAASASASACALPPGTWEWDRPAETSVVSEWALKCGGGGPALVSLPASSFFAGNLAGGFLLTTLADTLLGRRKMLVLSLVTMSVAGVLTVFSPNVWVYAALRFLVGKWWRNTVSVAAFVFFSVGFMSLPALAYTLREASWRNMYVWTSLPSLCYAVLLYFLVQESPRWLLVRGRKQEAIAALRQIASLNGGEGITTSSFTKLETCAGEVGDGVAGGEGMFSTLRSICERRWALRRLAAITTATFGVGVVYYGMPLSVGSLSSDLYLSVAYNAAAELPSSVLSWLLMGRFNRRSSLVALTAASGLCSLACVVIPDPEAGAGGSHLRLAAELASFFASCAAYDVLLMYSIELFPTSVRNSAVGLVRQAGVLGGVVAPMLVALGRERSYWSFGVFGLTVGCLGLFVTFLPETKGRRLSDTMEDEEEAAAVLSGG

SEQ ID NO: 69540 - protein, 356 aa, Oryza sativa Japonica Group
MGVLCFGASNILLCAEDSSSVLGLGGFGGGGGEVAAELGCGGGGGFDFFGFGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGESEIPVNKEMVMRCYELMVEKALVKKIRNSNASSSVPHSPITVLDAACFSFRSDDTTLGSSQSNSNNKDYNSQDSAPASKRRRLNTTPI

SEQ ID NO: 69541 - protein, 431 aa, Geobacter metallireducens GS-15
MPTDITMPKLSDTMTEGRLVSWKKSVGERVERGEIIAEVETDKATMELEAFASGTLAEQRVKPGELVAVGTVIGVIGAGGEIPPVAPEKPTPSPEEPKPSPEESKPSPQKAEPQPTPEATPAAPAGDVPERVMELPEEKASAPAPPEAERGEGERAAPVVRRMARERGIDLSLVTGSGPEGRILQEDLERYLTEKPAPESAVATGEGAEGEPLSRMRGAIARVTSQAWQTIPHFYETVEIAMEEGVEIVRELKGSGNEVTFNDLVVKAAAMALAKYPRLNASFAGDRIVTHCEVNIGIAVAVDDGLLVPVVKGCQGLALKEIALETVRLADRARSGRISQEEISGGTFSISNLGMFGIDEFAAVIFPPQAAILAVGNVADRPVVRDGRVVAAKTMRVTLSCDHRIVDGAYAARFLGEFRRIVEKPVLMLLQ

SEQ ID NO: 69542 - protein, 282 aa, Saccharomyces cerevisiae
MVPKFYKLSNGFKIPSIALGTYDIPRSQTAEIVYEGVKCGYRHFDTAVLYGNEKEVGDGIIKWLNEDPGNHKREEIFYTTKLWNSQNGYKRAKAAIRQCLNEVSGLQYIDLLLIHSPLEGSKLRLETWRAMQEAVDEGLVKSIGVSNYGKKHIDELLNWPELKHKPVVNQIEISPWIMRQELADYCKSKGLVVEAFAPLCHGYKMTNPDLLKVCKEVDRNPGQVLIRWSLQHGYLPLPKTKTVKRLEGNLAAYNFELSDEQMKFLDHPDAYEPTDWECTDAP

SEQ ID NO: 69543 - protein, 412 aa, Glycine max
MNALAATNRNFQRAARILGLDSKLEKSLLIPFREVKVECTIPKDDGTLVSYVGFRIQHDNARGPMKGGIRYHPEVDPDEVNALAQLMTWKTAVADIPYGGAKGGIGCNPRDLSISELERLTRVFTQKIHDLIGIQKDVPAPDMGTNAQTMAWILDEYSKFHGHSPAVVTGKPIDLGGSLGREAATGLGVVFATEALFAEYGKSISDHTFVIQGFGNVGTWAAKSIFERGGKVIAVSDISGAIKNLNGIDILALLKHKDGNGGVLKDFPGAEAMDPDELLVHECDVLVPCALGGVLNKENAADVKAKFIIEAANHPTDPDADGILSKKGVIILPDIYANAGGVTVSYFEWVQNIQGFMWDEEKVNRELKKYMTKAFQDIKAMCKIHNCDLRMGAFTLGVNRVARATLLRGWEA

SEQ ID NO: 69544 - protein, 82 aa, Brassica napus
MAGRSFLIRSPKEEESNAAVREAVLLGAKNAAIAGTVVAVPTLVGCRVLPWAKANLNYTAQALIISAAWLPGLKRFSGCRGG

SEQ ID NO: 69545 - protein, 456 aa, Sulfolobus tokodaii str. 7
MTEMRLVIVGNGAAAFAALIRANELGVKPVMISHGIIGGTCVNVGCVPSKRMLRIGEVYDYTRKTLGKDVYPDFFKAFEDKQEIVETLRKEKYIDVLSSYDVEYVEGKAHFVSPKEVKVNGKIIEGDKFIIATGSSPQIPDIPGLKELGYWTNVEALSPNRKISSLAVIGGRALALEFAQMYKRLGVDVLILQRSKIIIPNWEPEISIAVQNYLSKEEGIYIVTDVKIKEIKKGDEGGKIIVTDKGEAEVDEILVATGRRPNVDLNLDVAGVKLNEKGGILVNETLQTTNPNIYAAGDVIGDLMLESLAGKEGSVAAENAILNSGKKIDRLSIPQVIFIEPNVARVGLTYLEAQREYSVESRVVKMSSVAKARILREPQGLIKMNVDKNTKKILGVQMFGKYAAEVINEAALAIRLRATIDDIIDTVHVFPTMAESLKLAAMSFYRDVDKMSCCVD

SEQ ID NO: 69546 - protein, 362 aa, Sorghum bicolor
MGSTAEDVAAVADEEACMYAMQLASSSILPMTLKNALELGLLEVLQKDAGKALAAEEVVARLPVAPTNPAAADMVDRMLRLLASYDVVRCQMEDKDGKYERRYSAAPVGKWLTPNEDGVSMAALALMNQDKVLMESWYYLKDAVLDGGIPFNKAYGMTAFEYHGTDPRFNRVFNEGMKNHSVIITKKLLEFYTGFDESVSTLVDVGGGIGATLHAITSHHSHIRGINFDLPHVISEAPPFPGVQHVGGDMFKSVPAGDAILMKWILHDWSDAHCATLLKNCYDALPEKGGKVIVVECVLPVTTDAVPKAQGVFHVDMIMLAHNPGGRERYEREFRDLAKAAGFSGFKATYIYANAWAIEFIK

SEQ ID NO: 69547 - protein, 408 aa, Streptomyces coelicolor A3(2)
MSAAIPPTERRVSARVGAISESATLAVDAKAKALKAAGRPVIGFGAGEPDFPTPDYIVEAAVEACKNPKFHRYTPAGGLPELKAAIAAKTLRDSGYEVDPSQILVTNGGKQAIYEAFAAILDPGDEVIVPAPYWTTYPESIRLAGGVPVEVVADETTGYRVTVEQLEAARTEKTKVVLFVSPSNPTGAVYGEAETEAIGRWAVEHGLWVLTDEIYEHLVYGDAVSVSLPALLPELRDKCIVVNGVAKTYAMTGWRVGWVIGPKDVVKAATNLQSHATSNVANVSQAAALAAVSGNLDAVAKMREAFDRRRQTIVRMLNEIDGVLCPEPEGAFYAYPSVKALLGKEIRGKRPQDSVELAALILEEAEVAVVPGEAFGTPGYLRLSYALGDEDLVEGVSRIQKLLAEARD

SEQ ID NO: 69548 - protein, 356 aa, Physcomitrella patens subsp. patens
MAQNGKPLPPQLDQNSTKELNLTVLQRTDRHVEDILTTAAHVTFYQFDTDANQWSRKDVEGSLFVVKRRTQPRFQFIVMNRRSTDNLVENLLGDFEYEVQSPYLLYRNAVQEINAIWFYNARECEDVANLFQRILHAFKPPPKPRLIPPSSDYVELEAVPTTVNLEGPLERGPIASSGMLEMQDEPLERFLVNYFTPDITPTTASRPPINHSVQSRTTIPASPTFSAVSMSSIISPTTTALPLTSLAPLSLDTPDNPPTGRATLIKPSFFVPPPLSSGHSAPSAPLVPSTTSLQPSHGAPLLQPFPPPNPPLSLAPTMQHSVSITKDGVREALNRLVKNEHFIDMVYREMMNAHNF

SEQ ID NO: 69549 - protein, 116 aa, Glycine max
PRFFLCRFLPKFFPHLFALCNRHHHTPHSPYTSLSLFDLDNNTWLHFPLDFLPFHSPLLVASSLGLYLWAQPTPNNPFHNSNITKSLIYCNFFPRNFPVLPFPSLAWSWPRTNLIV

SEQ ID NO: 69550 - protein, 167 aa, Brassica napus
MVNYVLKITADLENLTNLQPSGGCDDPNFPYLFKLKCEQCGEVTQKETCVTLNETFTPPGGRGTCHLVQKCKFCGREGNVTMIPGKGRPLTQEDSEAGEHAPLMVFDCRGYEPIDFGFGGYWKAEAESGTKFDEIDLSSGEEFTEYDEKGECPVMISNFRASFTVTK

SEQ ID NO: 69551 - protein, 219 aa, Zea mays
MARFNPYENNGGTCLAVAGADYCVVAADTRLSIGYSILSRDHSKISQLSDKCVLASSGFQGDIKALQKALAAKELIYEHNNNKKMSCPAMAQLLSNTLYYKRFFPYYAFNVLAGLDTQGKGCVFTYDAVGSYERTGYSAQGTGSALMMPVLDNQLKSPSPLLLPARDAVTPLSESDAVDLVKDVFASATERDIYTGDRLEIVVINSFGTHRECIELRKD

SEQ ID NO: 69552 - protein, 375 aa, Pinus banksiana
RVIKCKAAVAWAAGEPLKIEEVEVAPPQAMEVRVKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYLDKKLELEKFITHEVSFADINKAFDYMIKGESLRCVINVIGN

SEQ ID NO: 69553 - protein, 304 aa, Nocardia farcinica IFM 10152
MRELNIPLPVLRAAINPLFRVMLNPRLPFTVQRTLMDAASRIQFVPAGTTVRRTRLGGRPAEQLTAGRAEPTTAVLYLHGGGYAVGSMATHRSLAARLAHETGAAVFLLDYRLAPEHPFPAALDDAVAAFDELVAAGYGPESIAIAGDSAGGGLSLATAQRLLAEQNRRPAALGLIAPWTDPTGTPARERDLVVSRPWALACAAAYLGDGDPGVPGYAPLRASMHGLPPTYVQADIDELLHEQCVELVQALRDAGVHVRFTESRGLWHVAQLQASLAAPAAAAVRELSEFLREALQPVDMRHLG

SEQ ID NO: 69554 - protein, 375 aa, Pinus banksiana
QAIKCKAAVAWAAGEPLKIEEVEVASPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDCSIECTGNVKAMIQAFESCHDGWGVAVLVGVPHSDAVFATSPVNFLNERTLKGTFFGNYKPRTDLPGLVELYMDKKLELEKFITHEVSFADINKAFDYMIKGESLRCVINVIGN

SEQ ID NO: 69555 - protein, 400 aa, Bacillus anthracis str. Ames
MAVCSLVAKITYAEERQQNNYPIILVNGFAGWGREEMLGVKYWGGVHDIQEDLKRNGYTVHTAAVGPVSSNWDRACELYAQINGGTVDYGAAHAEKHGHKRFGRTYSGFAPNWSETNKIHLVGHSMGGQTIRTLVQLLKEGSYEEKNYVKNHPNTKISPLFEGEKSYVHSVTTLATPHNGTTLADGSLLLPFVKDLLITAASFGGNDNLSLYDFKLDQWGLKKNTGESFFQYSNRILNSSIWKNTKDISQWDLSTDGAKELNNWVKTQLNVYYLSYSGHASQAAPITGLHLPHITMNKVLMGNAFFLGSYARYEENRPLIDTTWWQNDGVVNTSSMIAPSSNATVNNNESLQIGKWNHIETKANWDHLDMVGLSVSDTLGFSSIQEFYRAIAEKLSRLPK

SEQ ID NO: 69556 - protein, 253 aa, Oceanobacillus iheyensis HTE831
MKLKDKVAIVTGAASGMGKAIATLYASEGAKVIVADLNEEGAQSVVEEITSNNGVATAIKVNIAQKEDIDKMIDTAVDTYGTLDILVNNAGIMDGFEAVGDVEDDRWDLIFDINTKGVMRAMRKAIPIFLEKESGVIVNTASTGGLNGAHAGAAYGASKHAVIGLTKNTGYMYANSGIRCNAIAPGGVATNITSSLKGFNEFGFGRTKAVQGVMPRVGQPEEIAQVALFLASDDASFVNGTVVTADGGWTAAF

SEQ ID NO: 69557 - protein, 177 aa, Rhodococcus sp. RHA1
MIDHSSARDAVTRLTRWADDFPQPGVRFADLTPVFSDADGFRVVVDALAACAPEADVIAAVDARGFLLGGGVARELGSGVVAVRKSGKLPPPVLSQSYTLEYGTATLEIPAGSIGLDGRSVLVVDDVLATGGTLDATARLVESAGARVIGVAVVLEIAALGGRERLGKYPLTSLVTV

SEQ ID NO: 69558 - protein, 375 aa, Pinus banksiana
KVITCKAAVAWGPSQPLKIEEVQVAPPKAMEVRIKVHYTSLCHTDLVFWQAEGHTPIFPRIFGHEAAGVIESVGEGVTDLKVGDCVLPVFTGECKECKHCKSEESNMCDLLRIDTERGVMMSDGNSRFSINGKPIHHFLGTSTFSEYTVAHAGCVAKINPKAPLDKVCVLSCGVPTGMGATLNAGKPKKGSIVAVFGLGAVGLAACEGARIAGAARIIGIDFNNERSERAKQFGVTEFINPKEYDKPIQQVIAEKTDGGVDCSVECTGSIEAMVQALECCHDGWGVAVLAGVPRADAVFKTNPVNFLSEKTLKGTFFGNYKPRTDLPGLVEMYLNGELELDKFVTDKVSFSDINKAFDHMLKGEGLRTVIKVIQD

SEQ ID NO: 69559 - protein, 324 aa, Oceanobacillus iheyensis HTE831
MKSLEKVSIFAGNTFAIWVLLFGVISFIFPSGFSWIAPHISLLLGIIMFGMGLTLTPNDFKGVIKTPKSVLIAVILQYTIMPIIAYCLAVVFQLPPAIAVGVILVGCCPGGTASNVMTYLAKGNTALSVSVTTISTLIAPIMTPTLTLLLASEWMAVSFMSMFISIIQVVLLPIVLGVGVRMLFRNQVEKSVSVLPLVSVIGIVAVASAVVAVNTEAIATSGLLIFGVVMLHNLLGLFLGFLIAKLAKLDFSDRKAISIEVGMQNSGLASTLALTAFATTPVAAVPSAIFSVWHNISGPLLATYWSKKGDKDISIIQEKVENLG

SEQ ID NO: 69560 - protein, 374 aa, Pinus banksiana
QVITCKAAVAWGPGQPLKIEEVEVAPPQAMEVRIKVYYTALCRTDLVFWEAKGQTPLFPRIFGHEAAGIVESVGEGVTDLKPGDSVLPVFTGECKECRHCKSEESNMCALLRINTDRGVMISDGKSRFSVNGKPIYHFLGTSTFSEYTVVHVGCVAKINPKAPLSKVCILSCGVSTGMGATLNVGKPKKGSTVAIFGLGSVGLGAAEGARIAGASRIIGVDLNSDRYEQAKLFGVTEFINPQDYEKPVQEVIAEKTDGGVDCSIECTGNVKAMIQAFESCHDGWGVSVLVGVPHSDAVFATHPINFLNERTLKGTFFGNYKPRSDLPGLVEMYLDKKLELDKFITHEVSFADINKSFDYMIKGESLRTVIKVSD

SEQ ID NO: 69561 - protein, 504 aa, Corynebacterium efficiens YS-314
MRYRASNDAKLCEESQHLPRVPSGTHLVERITPISSGLREERRCMSDTPTSALITTVNRSFDGFDLEALARDLEVNLVPIRGDDFDMSKVLAADLLADGPALIVGAGNAHFDAQVAAALGVPMLMLVDKRGSHVTLARTQAKNVGAVVVAAFTAEEEAKPDKLKKAVRNHGNLEPVMSAALFENWLLKRARKEQAHIVLPEGEDDRILMAAHQLLEKDICELTILGDPEQIHSRATELGLHLEKADVINPLTDPKLDEFAEQFAELRKSKGITLEQARETMKDISYFGTMMVHNGDADGMVSGAANTTAHTIKPSFQIIKTVPEASVVSSIFLMVLRGRLWAFGDCAVNPNPTAEQLGEIAVVSAKTASQFGIDPRVAILSYSTGNSGTGPDVDRAIDALAEARRIDPDLKVDGPLQFDAAVDPGVAKKKMPDSDVAGHANVFIFPDLEAGNIGYKTAQRTGHALAVGPILQGLNKPVNDLSRGATVPDIVNTVAITAIQAGGK

SEQ ID NO: 69562 - protein, 228 aa, Vibrio fischeri ES114
MNKYMAEFIGTFWLVLGGCGSAVLAAAFPELGIGFVGVSLAFGLTVLTMAFAIGHISGCHLNPAVSVGLWVGGRFDAKDLVPYIVSQVLGGIAAGGILYLIASGQAGFDLAGGFASNGFGEHSPGGYTMTAALITEVVLTAMFLIVIMGATDSRAPAGFAPIAIGLCLTLIHLISIPVTNTSVNPARSTAVAVYVGDWATSQLWLFWVAPIVGAVIGALIYKVMAKES

SEQ ID NO: 69563 - protein, 526 aa, Burkholderia mallei ATCC 23344
MSPVSAFKLVLLSFLAIVALELLAKRLRLPPAAALLVGGAGIAFLPGLPPVNLDPDLVLIVFLPPLLMDGAYFSVWEEFKRNVGGIMMLAIGAVAFTTLAVGVAVHLVAPGLPWAACFALGAIVSPPDAVAAKAVLERVALPRRLMVLLEGESLLNDAAGLVLFRFAVAAALTGAFSTGDAVVRFAQLGVGGVAVGFIVGWLIVRFLKLVEDDYLVITVAVLAAWISYIAGELFEVSGVIATVTTGMMLGWHQHEVFSASVRNRGTAFWQVIVFLLEALVFVLIGLSLRGVIERLGGLGEVFATMTPAVAAVVAAVVASRFVWVFAVELLKAPVARLRGRGPRGDWKAATVMGWAGMRGVVTLAIALSLPDAMPGRDLILVAAFAVILVTVLLQGTTIGPLIRLLKLRDPGPAAHHLTEPQTWARVEAAQLSAIQPLVHDAEGNVIHPRLLEQYTYRASVTARHQDEPAFPQRERDAHYDVVLAAIAAGRAELLRLHRGGQIHDEMLYLLERDLDLQEIAAQHAKG

SEQ ID NO: 69564 - protein, 765 aa, Parvularcula bermudensis HTCC2503
MSGSPPETGYIPRPRSAPRALLRRIRDIMATETSAQARLDRLATAIAANMVGDVCSIYVRRSDDTLELFATEGLRSDAIHHTRLAVDEGLVGYVANSKTPVQTSDARSHHAFAYRAETGEDGLNAFLGVPITRSGQVLGVLVIQNRSKRVFAEEELEVAQTVATILAEVVATGELLDEQDREDVEAVLTRPAHEIGHPIVPGIGKGVVFRQEPEIAPHATFAVDVASETERLEDAIAAVRKTVDDMVRDGGGDLATSSREILEVFRLLAYDKGWVQKMMEKVTAGITAESAVEQVRAENGQRLRQLSDPYLRERVHDLDDLARRLLRQLSGEKGPQKLEVDSILVATSLGPAELLELNSPHLRGVVLADGATSSHAAIIARSLQVPMVSSVPDLVDQAVSGDLVLIDGESGEVHLRPGEDVLDAFAEKDQLRSRTLAQYWEDRDAPVVTKDGVTVELQMNAGLLFDLGHLSQTGASAVGLFRTEFQFLLGGALPTAAAQEAFYRQVLETVGKREVIFRTADIGSDKRAGYMSGPREPNPAMGWRGLRVALDRNGFLRTQIRALLAAARGRKLNMLLPLVTTKEEFLEAKGLIEKEVDRHRKHVGPPPPIAVGAMIEIPSAAWNIRSLAEVCDFLSIGGNDLAQFFFAADRENDRVSLRYDPLSHGFISFLARTIDEAKRAGKTVGFCGEQATDPLMALALIAIGVARLSVAATAIGPLRATIRSVEFAALQAEMQRLLAEEQDGDLRTALREWAVTQGVVLPVKR

SEQ ID NO: 69565 - protein, 429 aa, Parvularcula bermudensis HTCC2503
MREEASAAAALTTRRDDRLVMKFGGTSVKSIDRIERVARHVMAGRAAGYKVCVNVSAMAGETDRLVDLATSAFGNKAARMAEYDTVVSTGEQVTAGLLSLVLQRHGIAARSWLGWQLPFQTDARHGAATIHEIDTSSLGDSLEAGEVAVVAGFQGIDEEGRITTLGRGGSDTSAVALAIALNAGRCDIYTDVDGVYTSDPRIVPSARRLDQISYEEMLEMASLGAKVLQTRSVGLAMRYGVPLRVLSSLGEPGESKVFTQIMSEQEIMERRVVSAVVPSRSEARVDLLGVPDKPGVSAMIFTALAAAKVNIDMIIQSQSRDSASVNLSFTLKEQDLSIAQSVLAERKSDIGYTEILADQNVAKVSIIGVGMNDRSGVAAQMFETLSSRGINILNISTSEIKISVLVSSEYTELAVRALHDSFGLRQSSA

SEQ ID NO: 69566 - protein, 360 aa, Shigella flexneri 2a str. 301
MTKKGAFTSAFFIYAFSACIIRKSQQHTSEAVMPLHNLTRFPRLEFIGAPTPLEYLPRFSDYLGREIFIKRDEVTPMAMGGNKLRKLEFLAADALREGADTLITAGAIQSNHVRQTAAVAAKLGLHCVALLENPIGTTAENYLTNGNRLLLDLFNTQIEMCDALTDPNAQLEELATRVEAQGFRPYVIPVGGSNALGALGYVESALEIAQQCEGAVNISSVVVASGSAGTHAGLAVGLEHLMPESELIGVTVSRSVADQLPKVVNLQQAIAKELELTASAEILLWDDYFAPGYGVPNDEGMEAVKLLARLEGILLDPVYTGKAMAGLIDGISQKRFKDEGPILFIHTGGAPALFAYHPHV

SEQ ID NO: 69567 - protein, 473 aa, Staphylococcus aureus subsp. aureus MW2
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSIGIIGGGVIGMEFASLMIDLGVDVTVIEAGERILPTESKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDTNEGYSEMVIDQSTEEIVGINMIGPHVTELINEASLLQFMNGSALELGLTTHAHPSISEVLMELGLKAESRAIHV

SEQ ID NO: 69568 - protein, 98 aa, Glycine max
AQMEETGLNLMSEALEWPTAMSLYDEDSEEEDVQNGYSRRSLFWRRMKYYISYGALSANRIPCPPRSGRSYYTHNCYRARGPVHPYSRGCSVITRCRR

SEQ ID NO: 69569 - protein, 858 aa, Gluconobacter oxydans 621H
MMVTGLAAVLLALAFLLTLVSIIQPLAKRLEISEAVLLALTGIGLGLVASLIVRSSATDLLDGAAEALIYFPVNSEAFLLIFLPILVFQGAMAIDVRRLAHETATVLLLAVVAVIVSTATIGFALYPFAQQSLVVCLLLGSIVATTDPSAVAGIFREIGAASRLTRLVEGEALLNDAAAISIFSILLAAVTSHHQIHLADALMDFLTAFIGAIVVGVCLARLTLLLIAGLGGSAASEVTLTLALPYAVYILCDEMLGFSGVVATAAAGLTVSAYGPSTFRPQVWRFLNEMWEQLVFWAGSLVFLLAAMLVPRLLIGMTKWDFVLILIASVAGLIARSAVIFGMLPLLAITKLSPPVPNPFKATMAWGGIRGAITLALALAVTENQSVSSPVAHFVGIIATGFVLITLLVNGTTLRALVLFFKLDQLSPIDQAIRQQIVGIGLGEVAERTRELSEELGFSEQTRAGVISRLERRAEKERAANNFESALSDRNRVDIALITIANQERSLLLDLFRIQGLSRRVMETLLRTTESMADGARLEGRYGYVRALKRRLQPSLRFRIAQELHSRLHIDEPLTNCMMERFEMLIIAHLVSLSLQRFIRQRMEPTLGPRITEIVSEVLGRQRKLLDDALETLRLHYSGYSEALESRILRQIALRLEDEEYDALEADNLISEELHRELHREIERQRARLDAPLRFNLKSGIEQRLRAFPAFNGVPDSVLQKLSRKVSMHFVSPGEILFKRGQRVRVVYAQVAGLAEVNLAERDLLFGSGDLIGAASVIRNETMPGTVRSLQFSHLLAIPRPVFEKLLKEYPIVQRLIIQRSQKRADGLLTPVTVRTLDGDVVSTASAPEMRRLVAPPS

SEQ ID NO: 69570 - protein, 293 aa, Staphylococcus aureus subsp. aureus MW2
MTNLPMNKLIDEVNNELSVAINKSVMDTQLEESMLYSLNAGGKRIRPVLLLLTLDSLNTEYELGMKSAIALEMIHTYSLIHDDLPAMDNDDYRRGKLTNHKVYGEWTAILAGDALLTKAFELISSDDRLTDEVKIKVLQRLSIASGHVGMVGGQMLDMQSEGQPIDLETLEMIHKTKTGALLTFAVMSAADIANVDDATKEHLESYSYHLGMMFQIKDDLLDCYGDEAKLGKKVGSDLENNKSTYVSLLGKDGAEDKLTYHRDAAVDELTQIDEQFNTKHLLEIVDLFYSRDH

SEQ ID NO: 69571 - protein, 351 aa, Debaryomyces hansenii CBS767
MTIADSIPIWLDCDPGNDDAFAILLAAFHPKFNLLGISTVYGNAPNSSTTHNALALLDVLGAEQDQIKVYSGENKPLVKPVKFAPEIHGPTGIGGAKLPKTPRIKESTDQTYLQAMRSAILEHAGKICVICTGTLTNMAILIETYPEVKSKIRFVSIMGGALNKGNATKYAEFNVHCDPLAAANVLNDEELSGKTILTGLNITHKAIATMEVRRNIYDETNPKKDSHVRKLFYDIAMFYAESYRVQHNITLGPPIHDPLAVFLILALVNKQEDLADDVDFKYIKRKLKVIQEGEREGETQIANGDLDELKEEENGVYVGLNVNVELFWSYVLKALDNAEHHVANYNQNSSM

SEQ ID NO: 69572 - protein, 127 aa, Streptomyces coelicolor A3(2)
MAKLSQDDLLAQFEEMTLIELSEFVKAFEEKFDVTAAAAVAVAGPAAPGAPVEAAAEQDEFDVILTGAGDKKIQVIKVVRELTSLGLKEAKDLVDGAPKPVLEKVAKDAAEKAAESLKGAGASVEVK

SEQ ID NO: 69573 - protein, 950 aa, Arabidopsis thaliana
MINLEKEAKEKQILIRDGKRKIVHHVNTTLLVKIYEASAIDDRHLFLKPYYGPPNYYFIKAWLDDTKEYGTYVVKDSFKVNQPPLKIPLNFPAQYLYVELLKGMSYRDPGTSNRTVVMGRAKIRLSPLMTSYKERPISGGIDLVGLNSDQCVVKKVTAAYHPTDVFLFNCGDTSNNVDNSGRNWTVESRQILSSNLVNASFTSEASYQKAGVSRIPYMKARIFRSEFTYSFPVTPGSIFLRLYFYPTQYKSGFDAVNSFFSVKVNGFTLLRNFNADSTVQASIPLSNSLIKEFIIPVHQTLNLTFTPSKNLLAFVNGIEIVSMPDRFYSKGGFDNVLRNVSSDVDFQIDNSTAFESVHRLNVGGQIVNEVDDSGMFRRWLSDDSFGNSGSIVNVPGVKINYTEKTPAYVAPYDVYATSRLMGNSSNLMFNLTGMFLTVDAGYNYLVRLHFCETLPQVTKAGQRVFSIFVEDKMAKKETDVIRLSGGPRIPMYLDFSVYVGFESGMIQPELRLDLVPLKDTNQTYYDAILSGVEILKLNDSDGNLARPNPELLVSTDSTPDDSNVTPPIKGKPHVLVIILIVVGSVIGLATFIVIIMLLIRQMKRKKNKKENSVIMFKLLLKQYIYAELKKITKSFSHTVGKGGFGTVYRGNLSNGRTVAVKVLKDLKGNGDDFINEVTSMSQTSHVNIVSLLGFCYEGSKRAIISEFLEHGSLDQFISRNKSLTPNVTTLYGIALGIARGLEYLHYGCKTRIVHFDIKPQNILLDDNFCPKVADFGLAKLCEKRESILSLIDTRGTIGYIAPEVVSRMYGGISHKSDVYSYGMLVLDMIGARNKVETTTCNGSTAYFPDWIYKDLENGDQTWIIGDEINEEDNKIVKKMILVSLWCIRPCPSDRPPMNKVVEMIEGSLDALELPPKPSRHISTELVLESSSLSDGQEAEKQTQTLDSTII

SEQ ID NO: 69574 - protein, 215 aa, Mycobacterium sp. MCS
MSNQTDPRLQPQARYILPSFIEHSSFGVKESNPYNKLFEERIIFLGVQVDDASANDIMAQLLVLESLDPDRDITMYINSPGGSFTSLMAIYDTMQYVRADIQTVCLGQAASAAAVLLAAGTPGKRLALPNARILIHQPALSGVIQGQFSDLEIQAKEIERMRTLMEVTLARHTGKDPETIRKDTDRDKILTAEEAKDYGIIDTVLEYRKLSAQTS

SEQ ID NO: 69575 - protein, 306 aa, Oryza sativa Indica Group
MAAGAGAGGLSGDYYRRSCPQLELVVDMALAPVFAVDQTSPAALLRLFFHDCQVQGCDGSILLNSDERRNITSELGSDKNFGIRDVSTIGLVKAAVERACPGQVSCADIVVLAARSAVAHAGGPRIRGVPLGRRDATAASAERADAMLPDSFLGIDGALAMFQSKGMTVEETVAILGGHTLGGGHCATVDPARRGRSDAAFEAALRLACPAAAPRAVAAAVPVLSDATPSWFDNLYYWNAASGRGIFAVDAEEAADARTAGHVRRFAADGRRFFRAFSSAFVKLAMSGVLTGDEGEIRRRCDVVNH

SEQ ID NO: 69576 - protein, 195 aa, Mycobacterium sp. MCS
MRGGAPGLTLQDSVYERLLAERIIFLGSQVDDDIANRLCAQILLLSAEDPTKDIHLYINSPGGSISAGMAIYDTMVLAPCDVATYAMGMAASMGEFLLAAGTKGKRYALPHARILMHQPLGGITGGAADIAIQAEQFAAIKKEMFRLNAEFTGQTIERIEADSDRDRWFTAQEALEYGFVDHIITSASINDGVAP

SEQ ID NO: 69577 - protein, 398 aa, Nocardia farcinica IFM 10152
MSPVTDAPNATASLSEITHDEIFAGHLGGKLSVELSAPLETQRDLSIAYTPGVAQVSRAIAQDEALAKRYTWTDRLVVVVSDGTAVLGLGDIGPRASLPVMEGKAALFKKFAGLDSIPIVLDTKDVDEIVETLIRLRPSFGAVNLEDISAPRCFEIEKRVIEALDCPVMHDDQHGTAIVVLAALNGAAKVQGRSIEGLKVVVSGAGAAGVACTNILLAAGVADVTVLDSKGILSRERSDLNAVKAELAARTNPRGLVGGAAEALAGADVFLGLSAGLIAEELIASMAPESIVFAMSNPDPEIHPEVARKYAAIVATGRSDFPNQINNVLAFPGVFKGALDAGARRITEGMKIAAAEAILGVVADELGPDKIVPSPLDPRVAPAVAEAVAAAARAEGVA

SEQ ID NO: 69578 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARMAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLQLEKFITHEVSFADINKAFDYMIKGESLRCVTNVIGN

SEQ ID NO: 69579 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLELEKFITHEVSFADINKAFDYMIKGESLRCVINVIGN

SEQ ID NO: 69580 - protein, 461 aa, Nitrosomonas europaea ATCC 19718
MKIQDFIQNRSKENFALHDKYLNSQMVKVLKTIDFDRHYVRAEGAYLFDEQDNRYLDLLSGFGVFALGRNHAEIVEALKSTLEADLPNLVQLDVSLLAGLLAERLVKLTPDGLKRVFFANSGTETVEAAIKFSRYATGKSKIIFCHGCYHGLSLGSLSATGDDHYKKGFGPMVPDFIEIPFNDLEALEQVLAQGDVAAFITEPIQGHGVWIPDDNYLPEAARLTRKYGALFITDEIQTGLGRTGKWWAVEHWSVEPDILCMSKTLSGGFIPVGALVCKEWIFDRVFNRMDRAVVHGSTFGKNNLAMAAGLATLEVLESGNLIEHSARTGAAIMDALTPLTEKYECFKEVRGKGMMIALEFTEPKSPMLKLSWKMLESANKGLFSQLITVPLFRQHRVLSQVAGHGMNIVKFIPPLILTESDVQWIVTAVSDVVANAHRGPSAVWDFGKTLAFSALRAKLHA

SEQ ID NO: 69581 - protein, 375 aa, Pinus banksiana
KVITCKAAVAWGPSQPLKIEEVQVAPPKAMEVRIKVHYTSLCHTDLVFWQAEGHTPIFPRIFGHEAAGVIESVGEGVTDLKVGDCVLPVFTGECKECKHCKSEESNMCDLLRIDTERGVMMSDGNSRFSINGKPIHHFLGTSTFSEYTVAHAGCVAKINPKAPLDKVCVLSCGVPTGMGATLNAGKPKKGSIVAVFGLGAVGLAACEGARIAGAARIIGIDFNNERSERAKQFGVTEFINPKEYEKPIQQVIAEKTDGGVDCSVECTGSIEAMVQALECCHDGWGVAVLAGVPRADAVFKTNPVNFLSEKTLKGTFFGNYKPRTDLPGLVEMYLNGELELDKFVTDKVSFSDINKAFDHMLKGEGLRTVIKVIQD

SEQ ID NO: 69582 - protein, 308 aa, Geobacillus kaustophilus HTA426
MLVYNQEELVRFVEEAKQYARYGKVADYIPALGKANPNELSIAIYTPDDEVVSAGDVTVKVTLQSISKIIALALVLIDRGEDEVFHKVGMEPTDYPFHSIAKLEEKPAKPLNPMINAGALVVTSMIQGGSVSERLERLLAFVRRLAGNERISYSDEVARSEFETAFLNRSLCYFLKQHRIIDEDVEELMELYTKQCAIEMTCIDLARIGLVLALDGRDPHSSEPLMPLDVARICKTFMVTCGMYNSSGEFAIKVGIPAKSGVSGGILAAVPGRCGIGVFGPALDDKGNSLTGVKLLERLSKTYSLSIF

SEQ ID NO: 69583 - protein, 399 aa, Vibrio fischeri ES114
MMTMFEKIAAAPADPILGLTDEFKNDPRAEKINLGVGIYKNEAGQTPVLTTVKKAEAVLLDTEKTKSYLTIQGTAEYGLAVQKLLFGADAQVITEKRAQTAQAPGGTGALRVAGEFIKRQLGDVKIWISNPTWANHIGVFTAAGIETAQYTYYNAETKSKDFAAMLTDLQQAEAGDVVLLHGCCHNPTGIDPTADEWEELAKLCANKGLLPLFDFAYQGFAKGVEEDAAGLRTFAQYCPELLVASSFSKNFGLYNERVGAFTLVAKDATVAADAFSQVKAIIRSIYSNPPAHGAAVVTHILNDDALRAEWEQEVAEMRDRIQEMRTLFVTTLKEQGVDADFSFIERQNGMFSFSGLSKEQVNRLKDEFAIYIVGSGRISVAGMTKDNMLPLCKGIAAVL

SEQ ID NO: 69584 - protein, 396 aa, Shewanella sp. MR-4
MFNSLVAMPADPILGLLTQYREDSHPQKVDLGVGVYKDPAGNTPILNCVKKAEKFRLDTETTKVYIGPTGSPQFNTLITELAFGSDHSAIIANRIRTVSTPGGTGALRVAGDFIKRCNPNAVLWVSDPTWANHIGLFEAAGLTVKTYPYYDYDTKSLKFDEMLSALAQIGPNDVVLFHACCHNPSGMDLTAEQWDKVVALTKEQGFTPLIDMAYQGFGDGVDIDAYGVRKMAAAVDNMILCSSCSKNFGLYRERIGSCSVVAKDANTASIAQSVLLYVVRCLYSMPPAHGAAIVETILGSAELKQEWLDELKVMRDRINGNRAILVENLKTNGVDRDFSFIARQKGMFSFLGVNPEQVARLQKEFSIYMVGSSRISIAGISEDNVDYLAKSIAEVL

SEQ ID NO: 69585 - protein, 232 aa, Oryza sativa Japonica Group
MLGFRSQTPWSGAGAEPICGDAAAAVVAARKGMETPLTAVAEAFEELARRMEADGGELRLGPFGDTCALVSVLFSCLGMAFRFAEIEYVAKVNDLIGAAKSYGTLNDILDKDVENDCVKKQGSHSRNLRRVRLGLGLIKVLFEQFLSTQECSLYDAATTAYGQVCAPFHSWAVRKAVGAGMYTLPSREQLIVRLNETDCSVQKEMRRYIDASSPIIDYIDNLFLSRSISLDW

SEQ ID NO: 69586 - protein, 477 aa, Geobacter metallireducens GS-15
MSEELYDLIVIGAGPGGYVAAIRAAQLGMSVAVVEKRSALGGVCLNEGCIPSKALLDSSELFALARDRFAGHGIAIDPPRLDLARMMARKDDVVKKLTDGVAFLFKKNKIARVQGTARLTGERDGAHGVDVEGGDQGPGTGDREKQTLRGKRVLLATGSEAAVIPFMPFDGELVVSAREALSFDRVPEHLLVVGAGYVGLELGSVWRRLGSQVTVVEMLPKMLPNTDGQVADTLMGSLKKQGIVFRMETKVTGFAKRDGKAAVTVEAGGATEEIVCDRVLVAAGRRPLTAGLGLEELGVRLEAGRIAVDDNYQTSLRGIYAIGDLIHGPMLAHKAMAEGEVFAERLTGQASVVDYAYIPGIVYTWPEAAGVGRTEEELKTEGVEYRVGKFPFMANGRAKCMDETEGFVKILATPDTGRVLGIHVIGPRASDVIAEAVTVMTYGGSAADIAMTFHAHPTLAEAMKEAALDVEKRAIHA

SEQ ID NO: 69587 - protein, 275 aa, Triticum aestivum
  misc_feature (8)..(8): Xaa can be any naturally occurring amino acid
  misc_feature (16)..(16): Xaa can be any naturally occurring amino acid
VKDSRTLXFGQKEVAXVGCRNPEEIPWAPAGAEYVVESTVVFTDKTKAAAHIKGGAKKVIISAPSQDAPMVVCGVNEKEYKSDIDIVSNASCTTNCLAPLAKVINDSFGIVEGLMTTVHAMTATQKTVDGPSSKDWRGGRAASFNIIPSSTGAAKAVGKVLPELNGKLTGMAFRVPTVDVSVVDLTVRLAKPATYDQIKATIKEESEGNLKGILGYVDEDLVSTDFQGDNRSSIFDAKAGIALNDNFVKLVSWYDNEWGYSTRVVDLIRHMHSSK

SEQ ID NO: 69588 - protein, 243 aa, Candidatus Kuenenia stuttgartiensis
MSIKENLENVKQNIANAAIKAGKKPEDITLVMATKTVDVDRIREAIKAGGNIIGENKIQEALKKYQELKDEKVEWHFIGHLQTNKVKDALKFAHMIHSVDRLPLAEKLDHRLMQEVRSLDILVQVNTSHEESKYGIEPEKAISLIKQIAKYDTLNIRGLMTIGLFTKDEVKIRKCFKVLKALCDIIATEGIDRVQMDYLSMGMTNDYQIAIEEGANMVRIGTAIFGARNTPDAYYWPSEKTDQ

SEQ ID NO: 69589 - protein, 278 aa, Zea mays
MEHRAFDCSGSDDDLPPTYQIRVPRMHFSGNRRPLAGAFSQPRPHNKLDSDIHQIEQQAYTGVLRAFKMQSDALTWEKESLITELRRELKVSDVEHRMLLNMVNEEEAIHRIRQSRQGCGMQSSLPYNSVVDHNLGPIKRQKKSHPIYSLPVDPHSPSMPLKALVGNKAYTVGWLASDGATKGMDGRSGRYHTNEYYASHNDMGLLNFNRTDIPDTETLVKKVERVLSRPDVYSIERAKELLIGQEQSLLDAIAKLDEASDHESEDTLVGSRIHAAIG

SEQ ID NO: 69590 - protein, 278 aa, Oryza sativa
  misc_feature (62)..(62): Xaa can be any naturally occurring amino acid
  misc_feature (152)..(152): Xaa can be any naturally occurring amino acid
  misc_feature (186)..(186): Xaa can be any naturally occurring amino acid
  misc_feature (196)..(196): Xaa can be any naturally occurring amino acid
  misc_feature (229)..(229): Xaa can be any naturally occurring amino acid
  misc_feature (239)..(239): Xaa can be any naturally occurring amino acid
LATLFTISMAVKMLLIPAYFSTDFDVHQNWLRITYNLPMEQWYFDTQSKWTLDYPPLFAYFXYALAHISALINPQIAANINSIASTVHFQRATVMISELPLLIVLYLIIKKVNLTFVLAYFSIPFIILDNIHFQYNIIMQSLFLLSVYLMQXGKFLQGAFAFSTLLNFKHIYLYASIAFVAYLLKXICTQRIRLQXKIKRLVKLGIVTLIPFIISFLPFVLKGGFEQIXQIFSRLFPFXRGLIHDYWAPNFWALYYFMGQLANILFARFFPSSTVSFR

SEQ ID NO: 69591 - protein, 418 aa, Geobacter metallireducens GS-15
MEIKVPSVGESVYEALVGKWLKKNGEAVRKDEPVCEIETDKITMEIDAGADGVLTIMVPEGATVKIGSVIGIIEAGTGDRGPGTGKGKEVPPLSPAVRKIAQELGIKPETVHGSGRGGRVTVDDLLTAGTRDLTAGTGDRGPGTGKGGEVPKDAAVKSGEAAAVGGKQKEFAFEPVPGPRSPVPAAERVTRSPMTPIRKRIAERLLVARQQTAMLTTFNEADLGRVMELRKKYKEHFQKKHGVSLGFMSFFVKACVEALKEYPAVNGSIEGDDIVFHHYYHIGIAIGAEKGLVVPVLRDADRLSFAEIETTIAGFAEKTKANRLELSDLQGGTFTISNGGVYGSLLSTPILNPPQSGVLGMHAVQERPVVRDGQIVIRPMMYLALSYDHRIIDGREAVGFLKKVKEYVEEPEELFLEG

SEQ ID NO: 69592 - protein, 412 aa, Geobacter metallireducens GS-15
MYVTGNLAGNTIAMVLAGGKGERLAPLTLRRPKPGVAFGGKYKIIDFVLSNMFNSGIKKVYILTQYRAYSLMKHIRESWGKWAGLGEFFVAISPETSSESEEWFKGTADAINHYLRFIESSDADYVAIFGGDHIYRMDVSQMIGYHRRNRADITIAALEVPVEEARRFGVFCVDDDNRVTAFEEKPANPVTIPGRETCFASMGNYIFSTRRLIEVLQEGKKLHADLDFGKHVIPMMLAKKDRVFAYNFNDNLIPGMKPEERGYWKDVGTIDSYYEANMELIHVSPQLNLYNYKWPILTNQGNYPPAKTVFDEDGRRGMNIDSYVCAGCITSGSVVRRSIVGPLTKVNSYSLVEDSILFENVNVGRNVKIRRAIIDKNITIPDGTTIGYDHGEDRRRGYTVTESGIVVVSPAE

SEQ ID NO: 69593 - protein, 785 aa, Burkholderia sp. 383
MIGATMPSKSYSNPPAKRHMSTQASSKAKLREAALDYHEFPTPGKIAIAPTKQMINQRDLALAYSPGVAYACEEIVENPLNAARFTARSNLVGVVTNGTAVLGLGNIGPLASKPVMEGKAVLFKKFAGIDVFDIELNESDPHKLVDVIAALEPTFGGINLEDIKAPDCFIVEREARKRMKIPVFHDDQHGTAIVVAAAVTNGLKVVNKDIKKVKLVASGAGAAALACLDLLVDIGLPIENIIVTDLAGVVYKGRTELMDPDKERFARETDARTLAEVIDGADIFLGLSAAGVLKQEMVKGMAERPLILALANPTPEILPELALEVRPDAVLATGRTDYPNQVNNVLCFPFIFRGALDVGATTITREMEIAAVNAIAELAQHEQSDIVATAYGIQDLSFGPEYLIPKPFDPRLIVKIAPAVAQAAMDGGVATRPIEDMEAYRVHLQQFVYHSGTTMKPIFQIARAAPEEKKRVVFAEGEEERVLRAVQIIVDEKLAKPVLIGRPSVIEHRIQRYGLRLTPGTDFTVVNTEHDERYRDFWQTYYKMMARKGISEQLARVEMRRRTTLIGSMLVKKGEADGMICGTISTTHRHLHFIDQVIGKRPGCSVYAAMNGLVLPGRQIFLVDTHVNVDPTPEELAEITIMAAEEVRRFGIEPKVALLSHSNFGTSNAPSAKKMRDTLAILQERAPELKVDGEMHGDVALDAALRKEILPESTLEGEANLLILPNIDAANIAYNLLKTAAGNNIAIGPILLGAAQPVHVLTESATVRRIVNMAALLVADVNATR

SEQ ID NO: 69594 - protein, 508 aa, Neisseria meningitidis FAM18
MNTPLPYSNYLIRILTASVYDVAVETPLEPARSLSVRLKNNILLKREDLQPVFSFKIRGAYNKMSKLPKDALACGVIAASAGNHAQGVALSAQRLGCRAVIVMPETTPKIKVDAVKSHGGEVVLRGVSYNDAYDYAMELAEKEGLTYIAPFDDPDVIAGQGTVGMEIVSQHPDPIRAVFVPIGGGGLAAGVAAFIKQVRPEIKVIGVQTNDSCCMKQSVEAGEIVHLKDVGLFSDGTAVKVVGDETFRLCKELLDEIITVDTDAVCGAVKDIFDDTRSITEPAGALALAGLKAYIAREGAENQTLIAVTSGANMNFHRLRHVSERSELGEGNEGIFAVTIPEERGSFLKFVNILGNRNITEFNYRYGDDEKAHIFVGLQAAGPQDLAVIGSRLDEAGLPNVDLTDDEIAKIHIRYMVGGRTDKVENERLVSFEFPERPGALARFLNHMQGGWNITLFHYRNHGADYGRILVGIDVPPHDAAAFDGFLESLGYSYHEETQNAAYKLFLA

SEQ ID NO: 69595 - protein, 5322 aa, Streptomyces halstedii
MSNEDRLRHFLNEVTSELIDTRQRLNDVTAAAEEPLAIVGMACQYPGDVRSPEDLWKLVAEGRDGISEFPTERGWDVDGLYHPDPEHQGTSYTREGGFLHRAGEFDAGFFGISPREALAMDPQQRLLLETSWEAIESAGIDPLSLKGSSTGVFTGVMYHDYSTQLRTVPDGVEAFLGTGNAGSVVSGRIAYVLGAEGPAVTIDTACSSSLVALHLACQALRQGDCTMALAGGVTVMATPGTFVDFSRQRGLAVDGRCKSFAAAADGTGWAEGVGVLVVERLSDAERLGHPILAVVRSSAVNQDGASNGLTAPNGPSQERVIRQALSAAGLSTADVDAVEAHGTGTNLGDPIEAQALLATYGQGRPEGRPLRLGSLKSNIGHTQAAAGVAGVIKMVMALRHGVLPATLHVDEPTPHVDWASGAVELLTEAMPWPEVGRPRRAAVSSFGISGTNAHIVVEQAPESQIEVAASREETPAGSVAWVVSGHGVDGVQAQAARLREWVLEHPQHSVTDIGFSLLSSRSLHRDRLVVLGSDRQVLVDGLAAAAEGSPWPGLVQSSGDVSLNRAVFVFPGQGSQWVGMGRELYASSPVFRARLDECAAALDPLVEWSLIDVVRGGSGAPGLERVDVVQPVLWAVMVSLAAVWESWGVVPAAVVGHSQGEIAAACVAGALSVEDAARVVALRSRAVRAMAGDGAMVSVALPAAEAEALTGDGVSLAAVNGPSSVVLSGDRSALTPVVEGLTAQGVRTKWVPVDYASHSAHMDRIHDELLEILSGIEPKTSRIPLYSTVSAEVIDTSVMDAGYWFDNIRGTVRFHETVQALITDGLTAFVEISPHPVLAMSVQDTLDQAEATGLSIGTLRRDENEHETFLTAAAQLFVAGLSIDWHTAAFADLDTRRVDLPTYAFQRDHYWLPAGGGQTGDAGSLGLGAVGHPLLGAAVSMAEGDVVVLTGRVSLRTHAWLADHAVLGSVLLPGTAFLELAVRAGDQVGCARVEELVIQAPLVLTGDEAVDVQVMVGADESGYRSVDIYSRHRVEDNWQDQDAWVHHATGTLTSSKTDAQNSDLSVWPPRDAASIEVEDFYAQLAAGGFAYGPAFRGLRAAWRRGDEVFAEVELPESEQDTAAEFGLHPALLDAALHAITFAAHGDFADQPAQGRLPFSWSGVSLEASGASLLRVHLRPAGDEAVSLLAADATGEPVLTVDSLVLRPVTSEQLRTGDSGVVDNLYTVQWGPFAGPVGVSGRDVGEWAVLDLPELGGGVGAVVEGLVACDVAVRVVGRECFAGGGSLPETLIVPVVGGGGDAVDVVCGVLGVVREWLGLVGGVSRLVVVTWGAVSVGSGEGVGDVGGAGVWGLLRSAQSEHPGRFVLVDVEGVEGVGWGGLVDGVVCGEGQVVVRGGGLLVPRLVRAGGGGLVIPETFTGGAEVVGGVGSGWCVGVGVGSGVGTLEGLGVVGAGVGSGVGGGLGVGEVRVAVRAAGVNFRDVLIGLGVYPGEALLGSEGAGVVVGVGEGVVNVGVGDRVMGLFLGGFGPEVVVDARMVVRLPVGWSFVEGATVPVVFLTAWYGLVDLAGVRAGERLLVHAAAGGVGMAAVQLARHWGVEVFGTASEGKWEVLRGLGLDDAHIASSRDLGFVEKFGREHSDGVSEGRSGGVDVVLNSLVGEFVDGSLGLLGEGGRFVEMGKLDVRDAGVVGELWSGVWYRNFDLVEAGLDRIQEMLCELVGLFDVGVLEALPVRCWDVREVVDALRFVQQARHVGKVVLRVPGGWGSGTVVVSGGTGVLGRAVVRYLVGCGVGRLLLLSRSGAAGEGVAGLVGELEGLGVVVDVVACDVGDREALAGVLGGVSGEFPVTGVVHLAGVLDDGMVGSLSEGQVRRVFAGKVDGLVNLDVLTRGMPVEGFVVFSSAAGVFGNAGQGNYAAANACVDAVVARRRVEGLPGVSLAWGLWSEASGMTGHLDAGDHGRMSRGGAGGLSTGEGVALLDAALGLPQSLLVPIRLDGRQLQARADVGDVHPLLRGLVRSRSRRAASAVGIGVGGLGGRLVGLVEGERRRVVLDLVRSHAATVLGHGDVAGVGAGRAFRELGFDSLTAVELRNRLNTATGVRLPATLVFDYPTPTELADYLLVQMVGESGAADSVQVPISVSSEEPLAVVGMACRFPGGVGSPDELWDFVLAGGDGISGLPVDRGWDVAGLFDPDPEREGTSYTREGGFLHDAAEFDPGFFGISPREALAMDPQQRLLLEASWEAVENAGIDPLSLKGTSTGVFAGVTYHDHAARLRTVPDGLEGLLGIGASASIVSGRVAYLLGLEGPALTVDTACSSSLVALHLAGQALRQGECSMALAGGVTVMSTPGTFVDFSRQRGLAADGRCKAFDVSADGFGPAEGVGMLVLERLSDAQRLGHPVLAVIRGSAVNQDGASNGLTAPNGPSQQRVIRQALAAADLSPADVDVVEAHGTGTALGDPIEAQALLATYGQDRPEDRPLRLGSIKSNIGHTQAAAGVAGVIKMVLAMQHGVLPATLHVNEPTPHVDWASGAVELLTEATAWPETGKPRRAAVSSFGISGTNAHTIIEQAPAVDRVSDVPDADSASGVTVPWVVSARGVDGLRSQAARLREWALKHPEHSLVDVGHSLVVSRSAFEDRVVVLGSDRDALLDGLAAAAQGGPWPGVVQGSSVGSGGGVAFLFTGQGAQRLGMGRELAERFPVFASALDEVCVQLDAHLERPLREVLFAEPDTEAAALLDETAFTQAALFAVEVALYRLVESWSLTPDYLLGHSIGGLAAAYVAGVLSLEDAAEVVVARGRLMQALPKGGAMVSLQAAEDEVVESLGGLVSIAAVNGPQAVVISGDEDAVTAVADEWRSRGRKVKRLTVSHAFHSALMEPMLATFEQVLSGVTLNPPRIPVISDSTGLPLTAEQATSPAYWTAHVRNPVLFHQAITHLTGQGVNSFLELGPDGVLSAMTRTSLAEDSDTTVVPLLRSGRQEPEAALTALAELYVNGVAVDWTVLLDGARPVALPTYAFQHQRFWLETGTEIPAEAATEPGDSVFWRAVEQGDAGELASAFAAVGVDASAVEWESVLPALSSWRQAQRVRSVADSWRYRVTWKPRAGRQSSTLTGTWLVVAPAEDLELVDQSVAALEAHGASVIVLRPTEGSDCGDRHMWAESLRRVVPSDEVDSLAGVVSLVGDVAGTLGLVQGLGGVGVVAPLWCVTRGAVGVGGGDVVVSPVQGLVWGLGRVVGLEHPERWGGVVDLPVSVDGRGWERFCSVLAGGGGEDQVAVRSSGVFVRRLVPAPAPAPAPAAVSVGEGGWSPGGGTVLVTGGTGVMGARAARWLAARGAERLLLVSRAGETAPGVSELVAELTAMGSRAEVVACDVADRDALAALLTAVPEEYPLTAVVHTAHHHDDEPLASMSAERYLPVLDAKWVGAWNLHELTKDLPLSAFVLFSSGAGVWGGGGQGAYAAANAGLDALAEYRQGLGLPATAIAWGPWQYQQDSSAVTDQSGALTDMDRRGLHPMAPEPAIDALGVALTRGETALVVADVDWERFYPAFAVARPRPLLHDIPAVAALLAQDRDSDGDVQARSELAERLAGTSESERDRIVLTMVRTHVAAVLGHTGVDGVPAGRAFRDLGFDSLTAVELRNRLSKATGVALPATLVFDHPTPEKVAALVVADVLEQRGTALPGQTVVAASPDEPLAVVGMACRFPGGVASPEELWQLVISGGDAISGFPADRDWDLAALYHPDPDHVGTSYTREGGFLYDAGEFDPGFFGISPREALAMDPQQRLLLETSWEAVENAGIDPLSLRGRKVGVFTGMSYHDYAARLRSVPEGLEGYLGTGNAGSVMSGRVAYVLGTEGPAVTVDTACSSSLVALHWAAQALRQGECSMALAGGVTVMATPGTFVDFSRQRGLAPDGRCKAFAAGADGTGWSEGVGMVLVERLSDAERLGHPILAVIRSSAVNQDGASNGLTAPNGPSQQRVIRQALSTAGLTTADVDAVEAHGTGTNLGDPIEAQALLATYGQDRPEERPLFLGSLKSNIGHTQAAAGVAGLIKMVMALQHGVLPATLHVDEPTPHVDWASGAVELLTEATPWPETGRPRRAAVSSFGISGTNAHTILEQAPVTEPTPVGGPQQSDDTPVGVLPWVLSARGETALRGQSSRLADWVTARPEDTAVEVARSLMASRSAFEDRLVVLGADREELLAGVRAVARGEACSGVIRTPSGVSVPEGRAFLFTGQGAQRLSMGRELAQRFPVFASALDEVCVQLDAHLERPLREVLFAEPDTEAAALLDETVFTQAALFAVEVALYRLVESWSLTPDYLLGHSVGGLAAAHVSGVLSLEDAAEVVAARGRLMQALPKGGAMVSLQASEDEVLESLQALETADRVSIAAVNGPDTVVISGDDEAVTEVAGYWLVQDRKVKRLKVSHAFHSVLMEPMLAEFEEVVSRVTLNAPRIPVVSDSTGELLTAEQATSPAYWVGHVRKPVRFHQAVTYLAEQGVSAFLELGPDGVLSAMVRNSLVDGEVIATPLLRSGRAEPETALTALAELFVAGVAVEWSAVLGGGESGRRVELPTYAFQRERYWLESGAAAAAEPAVGGVIAHGMDAGFWGAVERGDVEGLAGVLGSGVSVDVWGEVLPELSSWWLGRRARSVVEGWRYRVEWRRVGGGLLSGGGGLSGTWVVVVPVGVDVGLVDGCVGALVGCGVRVVVVGVDVGVLGDVEGLGSLVVGGLPEGVGVGDVSGVVSLLGLVEGWFEGLGGVSLGVVGTLGLVRALGGVGVVAPLWCVTRGAVGVGGGDVVVSPVQGLVWGLGRVVGLEHPERWGGVVDLPVSVDGRGWERFCSVLAGGGEDQVAVRSSGVFVRRLVPAPAAVSGGGWVGGLSGGSVVVTGGTGVLGGRVARWLAGCGVGRLVLVSRSGAAGVGVDGLVGELEGLGVVVDVVACDVADREAMAGVLGGVSGEFPLRAVVHAAGASGMGALEGLGVEEFAGVVGAKVGGAVVLDELVGGVPLVLFSSGAGVWGGGGQGAYSAANAFLDGLAEYRRGRGLPAVSIAWGPWADGGMAHGPEGSQDQLVSRGFVPLDPDIAIAAMEEAIEKDETTITVADIDWAKFYPAFALARPRPLLHEIPEVAALLAEDEAGVPEKGAVSALAERLNSLTDGEQRQAVLDMVRTEVAAVLNHAHAENIVETRTFRELGFDSLTAVELRNRLNSATGLRLPATLIFDYPTCEAISDHLCKELLGSSFGAMTTSAVQSDFWSALQQVDYQKLQDAGVVAMVMGLLDGEPAEKTVEEEPEPRPEIDEMDAVELLNLALRNKMQRNSAADSQGEEG

SEQ ID NO: 69596 - protein, 479 aa, Mesorhizobium sp. BNC1
MTTLHQNLIDGAWVGGEGKENINPSNIKDVVGIYAQASAEETKQAIAAAKAAFPAWSRSGILERHAILRKTADEILARKDELGELLSREEGKTLPEGIGEVTRAGQIFDFFAGAVLRLAGEVLPSVRPGIGVEITREPIGVIGIITPWNFPIAIPSWKIAPALAYGNTVVVKPADLVPGSTWAIVDILVRAGLPKGVLNLVMGKGSVVGQTMLESRDVTAITFTGSVGTGKRVAAASVELGRKFQLEMGGKNPTVVLDDADLKVAVESVTQSAFFSTGQRCTASSRVIVTEGIHDRFVEALAERIRGLKVGNALEPGIDIGPVVDANQLKQDTDYIEIGKQEGAKLVAGGERVQKETEGYFLQPALFTEATNSMRISREEIFGPVASVIRVKDYEEALATSNDTEFGLSAGIVTTSLKYATHFKRNAEAGMVMVNVPTAGVDFHVPFGGRKGSSYGPREQGTYAAEFFTVVKTAYTAAG

SEQ ID NO: 69597 - protein, 535 aa, Marinobacter sp. ELB17
MTILQSKINSRSEEFQAKHQSMADAVADLREKVATIQQGGGPSYQERHIARGKLLPRERINRLLDDGSPFLEIGQLAAYDVYEDNIPAAGLIAGIGRVNGTECMIIANDATVKGGTYYPLTVKKHLRAQEIALANRLPCIYLVDSGGAYLPLQDEVFPDRDHFGRIFYNQARMSAEDIPQIAVVMGLCTAGGAYVPAMADESIIVRNQGTIFLAGPPLVKAATGEVVSAEDLGGADVHCKVSGVADHYAENDAHALDIARRCVSNLNRRKPADVQIRKPKAPLFDASEIYGIVGTDLRKQFDVRDVIARVVDGSEFDEFKRYYGQTLVTGFAHVHGYPVGIIANNGVLFSESAQKGAHFIELCCQRNIPLLFLQNVTGFMVGQKHEAEGIAKHGAKMVMAVACANVPKITVLIGGSFGAGNYGMCGRAYSPDFLWMWPNARISVMGGEQAAGVLAQVRRDGMERNGETWSGEDEAAFKQPIIDTYEHQGHPYFASARLWDDGVIDPAQTREVVALSLSATLNRPAQPTRFGVFRM

SEQ ID NO: 69598 - protein, 513 aa, Gluconobacter oxydans 621H
MPASIQSPPDLPGPGRRKTLEQVLFENDTNGLKRSLTATQLIILGVGSTIGAGIYVMTGTAAAEYAGPSVLISFVIAALACLFTAFSYGELSSTLPVSGSAYSYAYISMGEKAAWMVGWLLLLEYGISCSAVAAGLSGYASSLLGVTGFHMPSALTHATLQPVPGTAGAQISADWRFDLIGFTATLLVTALLVRGVEESARINTMIVALKVGVLFVFVALGIGAVNPANWHPFIPASEGGFHYGVRGIFRAASVIFFAYVGFEAVSTASAEARNPTRDVPIGIIGSLLICTIVYMIVATVLLGIVPYRELDVPDPLAIAVKIMHTPWLSLLVNVGATIGLCSVLMGLMYAQSRVLLTISRDGLIPQIFSVIHPKFRTPWIGTIVLGFVVALITATLPIDIISDLVSIGTAAAFGIVCFTVIWQRNTRPDIVRPFSVPLGGIRIRGIWIGTTPALGILFCLVMTIPLVSDMVHAVTSGNPVPLILLVTYLALGIATYAFYGRRHSKMRPEPPLV

SEQ ID NO: 69599 - protein, 728 aa, Saccharomyces cerevisiae [sequence omitted]

SEQ ID NO: 69600 - protein, 259 aa, Escherichia coli
NSLVIIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 69601 - protein, 141 aa, Nitrosomonas europaea ATCC 19718
MAVERTLSIIKPDAVAKNVIGQIYARFEAAGLKVVAARMAHLSRVEAENFYAIHRERPFFKDLVEFMISGPVMIQVLEGENAIARNRELMGATDPRKAEKGTIRADFAESIDANAVHGSDAPETAVVEIACFFPSLEIHSR

SEQ ID NO: 69602 - protein, 343 aa, Triticum aestivum
MNPSRSAPASFRDRTNEFRSAVESARRHVAPSPAAASASGSAGPLDDSRSAASAHSEFNRRASKIGLGIHQTSQKLARLAKLAKKTSVFDDPTLEIQELTAVVKKDIGALNNAVMDLQVLCNSQNESGNLSKDTTNHSTTVVDNLKNRLMSATKEFKEVLTMRTENLKVHENRRQMFSSSAAKDASNPFIRQRPLVPREASDAAPPAPWASDSATTPLFQRKKTNGDHGASSSSSSSPAFMQQQQLAVQQDSYMQSRAEALQNVESTIHELSNIFTQLATMVSQQGELAIRIDENMEETVANVEGAQGQLLKYLNSISSNRWLMMKIFFVLMVFLMIFIFFVA

SEQ ID NO: 69603 - protein, 249 aa, Vitis vinifera
MPKIAFGRFDDSFSLASFKAYLAEFHPTILFVFAGVGSVMAYNKLTSDAALDPAGLVAVAVAHGFALFVAVAISANISGGHVNPAVTFGLVVGGQITILTGILYWIAQLVGSILACFLLKLVTGGLTTPVHSLGAGVGVIDAIVFEIVITFALVYTVYATAVDPKKGSLGIIAPIAIGLVVGANILAAGPFSGGSMNPARSFGPAVVSGDFKDNWIYWVGPLIGGGMGGSVYAIMYMGSDHQPLASSEF

SEQ ID NO: 69604 - protein, 363 aa, Vitis vinifera
MASTQSYSLRAAPVQSVQELIKEPIPAVPQPFILDDPQPPILSASSTPLPLLPTIDMKHLIMSETAGSELEKLHSTCKEWGFFQLVNHGVSSSLVEKLKSEIGEFYKLPLEERMKYKMRPGDVEGYGHLPIRSEDQKHDWGDRFYMITNPIHTRKPYLLPELPSSLRDSLECYLAELQKLAMMLLGFMAKALQLEKGEMEELFEDGMQSVRMTYYPPCPQPELVMGLTPHSDATGITILLQINGVDGLQIKKDGVWIPVSFLPDALVVNVGDVLEILSNGVYTSIEHRATVNAAKERISIAMFFNPKFSSQIKPAPSLINPQNPPLFKQVGMEKYFKDFFSRKLDGKSYLEHMKIKNEEDYST

SEQ ID NO: 69605 - protein, 1595 aa, Oryza sativa
MEFYAYSMLLILPLILYMSYHLTRTLAEKKPTTHGLKAHPLLGHLPAFVRNSHRFLDWSTELIAGSPEMRIGLWIPGMRSGIVTGNPADVEHILRTNFANYPKGQHAIGMLEDFLGHGLFNSDGEQWLWQRKNASYEFSKRSLRKFVVDVVQAEVANRLLPLLRRAAGDGVGGDAVVLDLQDVLQRFGFDTICMVAFGHDPRCLADGGVLEEAKSEFMHNFGEALDLVIGRFMDPIEVSWKIKKWLNIGTERRLKKAIADVHAFAMDIVRARRQSASVKDRDDVLSRFVASDEYRDEVLRDIVLSFLVAGRETTSSGLTWFFWLLSSRPDVVARIADEVRAVRKATGTRPGEPFGFDTLREMHYLHAALTESMRLYPPVPTDPQSCAADDTLPDGTFVRAGWFVNYSAYAMGRLAAIWGEDCMEYRPERWLGDDGAFQPASPFRFTVFHAGPRMCLGKEMAYVQMKSIVANVLEELVVDVVKEVAGGGAPEHVFSISLRMKGGLPVKIRRKGHMRGTVRPSIQAAAPGPRWLRLAATLRPISPATAAVRYPLFPLACGHQVSAVTMAKEVDRFVELVVVRHGETSWNSSRIVQGQMDPELNEIGKQQAVVVARRLARKARPAAIYSSDLKRAAETVKIIAKVCDVSNLVLIEALRERHMGYLQGLTWDDAMNKSPGVFKGFANFEVKNGLDFDGRNHEFPDGGESLNQLSEQGISYLNKVAQNHIGERVIVVGHGAAILELCRHTDPPNSSIRRKIPNTSLNIFRISGVTGRWILERLLPRITPLPRRRLRRSHNPNPLISPAVAASLAGVLATRSTNPTWARSLAALLPSPLSDAHLAAAVSSLPDPDLAVALLSWSQSPDHHVALQDPTPLAHSTLLRLLARSRRFDAVDDTLQSMSLAGAAPTRACLGALVAAYADAGMLGKATEMCERVREQYGSLPEVTHCNRLLKLLVEQRRWDDARKLYDEMLGKDSGADNYSTCVLVRGLCLERRVEEGLKLIEARWGAGCIPHVVFYNVLIDGYCRRGDMGRGLLLLGEMETNGFLPTLVTYGSLINWLGKKGDLEKIGSLFLEMRKRGFSPNVQIYNSVIDALCNCRSATQAMVILKQMFASGCDPDIITFNTLITGLCHEGHVRKAEHFLREAIRRELNPNQLSYTPLIHGFCMRGELMVASDLLVEMMGRGHTPDVVTFGALIHGLVVAGKVSEALIVREKMTERQVFPDVNIYNVLISGLCKKRMLPAAKNILEEMLEKNVQPDEFVYATLIDGFIRSENLGDARKIFEFMEHKGVCPDIVSCNAMIKGYCQFGMMSEAILCMSNMRKVGCIPDEFTYTTVISGYAKQGNLNGALRWLCDMIKRKCKPNVVTYSSLINGYCKTGDTDSAEGLFANMQAEALSPNVVTYTILIGSLFKKDKVLRAGLYFETMLLNHCSPNDVTLHYLVNGLTSCTPCVINSICCNTSEVHGKDALLVVFKKLVFDIGDPRNSAYNAIIFSLCRHNMLREALDFKNRMAKKGYVPNPITFLSLLYGFCSVGKSVNWRTILPNEFQQEEFEIIFRYKFLFDQYATESVCCEVSRVLQHLAGCKSLQRVEQKFANS

SEQ ID NO: 69606 - protein, 378 aa, Nocardia farcinica IFM 10152
MPVVTESDVRGALAKVDDPEIRKPITELGMVKSVAIDADSNVHVEVYLTTAGCPLRTEITQRVTKAVADVPGVGAVSVDLDVMDDAQRTELRKQLRGDSADPVIPFAQPGSLTRVYAVASGKGGVGKSSVTVNLAAAMAARGLSVGVLDADIYGHSVPRMLGTDARPTQVERMIMPPIAHEVKVISIAMFTQGNTPVVWRGPMLHRALQQFLADVFWGDLDILLLDLPPGTGDVAISIAQLIPNAEILVVTTPQAAAAEVAERAGSIALQTRQRIAGVVENMSWLDLPDGTRMELYGSGGGQQVADSLTRAVGANVPLLGQIPLEQGLREAGDEGTPIVLRDPDSPAATALREVADKLAVRRRGLAGMSLGIDTTRHL

SEQ ID NO: 69607 - protein, 360 aa, Lolium perenne
MGSTAADMAASADEDACMFALQLASSSVLPMTLKNAIELGLLEILVAAGGKSLTPTEVAAKLPSAANPEAPDMVDRILRLLASYNVVTCLVEEGKDGRLSRSYGAAPVCKFLTPNEDGVSMAALALMNQDKVLMESWYYLKDAVLDGGIPFNKAYGMSAFEYHGTDPRFNRVFNEGMKNHSIIITKKLLELYHGFEGLGTLVDVGGGVGATVAAIAAHYPTIKGVNFDLPHVISEAPQFPGVTHVGGDMFKEVPSGDTILMKWILHDWSDQHCATLLKNCYDALPAHGKVVLVQCILPVNPEANPSSQGVFHVDMIMLAHNPGGRERYEREFQALARGAGFTGVKSTYIYANAWAIEFTK

SEQ ID NO: 69608 - protein, 235 aa, Glycine max
  misc_feature (30)..(30): Xaa can be any naturally occurring amino acid
TNEGSLPLTSQYTPRDFVLSLQRPKSVIIXVKTGSPVDHTIATLSDHLDPGYCIIDGDNEWYENTERCMNLVADKGLLYLGIGTSGGENGACHDPSLMPGGSHHAYSNVQDILHKIAAQVEDDPCVTYIDEGGSGNWAAMVGFRGCFIGGRLCEGEGKGCGLVVPDEEEGNVRGEGEMEGHARGRWRGRRRVAGAGRGKEGCWCRKGGGRPPVPGGKGEKGGLVRGRRKGKSEKK

SEQ ID NO: 69609 - protein, 351 aa, Lolium perenne
MADEEACMFALQLANSAVLPMAIRTSIELGLLETLVGAGGKLLTPEEAVKKLPSKAKHPDAASMIDRMLRVLASYKVVTCEVEEGKDGSLSRRYGATPVCRWLAPNEDGASMAPFALLTQDRVFMEAWCHMKDAILEGGSAFHRAFGTSWFEYAGQDARFNRLFNEAMEHHSVILTKKLLELYKGFDGIGTLVDVAGGVGAVIHAITSKYPSIKGINFDLPHVIADAPPYPGVEHVSGDMFKKMPSGDAILMKWILNCFSDDECATLLKNCYDALPAHAKVINVECILPVNPDATNGAQALIAVDLSLLVYSPGGKERYHRDLEKLAKGAGFTSVTATYIFADFWAMEYTK

SEQ ID NO: 69610 - protein, 561 aa, Zea mays
MEEQNSWLRTKFSNTVYARVDPRRVPVAPLSKDVERKLHKFFKMKKTVSMPVDRDDGDTGTAFKHCASLPLVRSQPQLDREKVNKPERASLEIPSSSQMISESCKTPKARSLVKTPSSMMLLSYLNKSPSNQGHSSHKAYGSRPRSKSPLPSIVPSEVFREAKSSSQRFASPPPQRGGSAKSIYGKSFGRQVSDMGQSPRWRSTPVVSGKHKSQKDNAWTRKYSGGRRVSAVNPADDRRAQMVRMNQAVQTTVDWTLDPSKLLVGHRFASGAYSRLYRGYYDDNPVAIKFIRQPDDDDNGKMAAMLEKQYNSEINSLSHLYHKNVIKLVAAYKCPPVFYIITEFLPGGSIRSYLNNPENHPIPLERTISIALDVARGLEYIHSQGIVHRDIKPENILFDENLCVKIADFGIACQEALCDVLVEDEGTYRWMAPEMIKQKAYNRKVDVYSFGLLLWEMVSGRIPYENLTPYQVAYAVANRKLTPTISPECPPALRSLIEECCALRPDKRPDFWQIVKVLEQFHSVLLQGGCLDTPKSGPGTCQDPKKRLMRWIQKLKPKHST

SEQ ID NO: 69611 - protein, 369 aa, Brassica napus
  misc_feature (84)..(84): Xaa can be any naturally occurring amino acid
MSRRQSLSLLKNIGRFTTGSQTQTRSVTYMPRPGDGKPRPVTLIPGDGVGPLVTNAVEQVMEAMHAPVYFEPFDVHGDMKSLPXRGLLESIKKNKVCLKGGLKTPVGGGVSSLNVNLRKELDLFASLVNCFNLPGLGSRHENVDIVVIRENTEGEYAGLEHEVVPGVVESLKVITKFCSERIAKYAFEYAYLNNRKKVTAVHKANIMKLADGLFLESCQEVAKKYPSIAYNEIIVDNCCMQLVARPEQFDVMVTPNLYGNLVANTAAGIAGGTGVMPGGNVGAEYAVFEQGASAGNVGKDTTEEQKNANPVALLLSSAMMLRHLQFPSFADRLETAVKRVIAEGKCRTEDLGGKSTTQEVVDAVISNLD

SEQ ID NO: 69612 - protein, 361 aa, Lolium perenne
MGSTAAEIAASADEEACLYALQLGSSSILPMTLKNTIELGLLETLMAAGGKSLTPTEVAAKLPCAAKNPEAPDMVDRMLRLLASYNVVSCLVEEGTDGRLSRRYGAAPVCKFLTPNEDGVSMAALALMNQDKVLMESWYYLKDAVLDGGIPFNKAYGMSAFEYHGTDPRFNRVFNEAMKNNSIIITKKLLQLYDGFQGLGTLVDVGGGVGATVAAITAHYPTIKGINFDLPHVISEAPPFPGVTHVGGDMFKKVPLGDAILMKWILHDWSDQHCGTLLKNCYDALPMHGKVVLVECILPVNPEAKPSSQGVFHVDMIMLAHNPGGRERYEREYEALARGAGFAGFKSTYIYANAWAIEFTK

SEQ ID NO: 69613 - protein, 515 aa, Geobacillus kaustophilus HTA426
MKHLRQLTDELMAKKARAALGGGEEKIAKQHAKGLLTARERIDLLVDAKTFVEFGQLNASDQPGLEETTYGDGLVAGIGKVNGRPAVIIAGDKTVLAGTEGSVHLRKSRQMHALAVRNGLPMFFLHEGGGLRMPDGMGSDGISDKLFPRELLTHHRKVPTMAAILGDSYGGPTWTAVSCDFVTQLKGTCMAIAGPRMLELANGQRVSPEELGGVDIHHQYTGQIDADGETEAECIEQLKRFFSYIPQNENERPPMRKTDDDPYRMVEEVFSILPDKRSRVYDMRNIIACLVDEGDYFEYQKQFGKALIAALAHLNGHVVGIIANQPNQYAGAPGPQECQKATEFICLCDSYHIPLIFLHDTPGFRISVEAEKAKMATKIMVWNQALALSTVPKISVVIRKSIGAAYGNMCGPGMGADVVVAWPSAEINFTGPEVGVNVVYGRELERADNPHERRQELLKQWSFDSSPYGAARKHLIDDVIHPAETRKFLCQTLEYLLTSKREKSERLLAAWPTGF

SEQ ID NO: 69614 - protein, 89 aa, Brassica napus
MANPPATGGKSFLQAMSTVTEEAAVQLRVVQMEGLAVLKIIKHCEEFAPALVTGQLLGLDVGSVLKVTNCFPFPIREDDEEADADGANY

SEQ ID NO: 69615 - protein, 265 aa, Shewanella sp. MR-4
MLNTTMFNYQGKNVVVVGGTSGINLAIANAFALAGANVAVASRSQDKIDAAVLQLKQSNPDGIHLGVSFDVRDLAAVEQGFDTIASEFGFIDVLVSGAAGNFPATAAKLSANGFKAVMDIDLLGSFQVLKTAYPLLRRPQGNIIQISAPQASIAMPMQAHVCAAKAGVDMLTRTLAIEWGCEGIRINSIVPGPIAGTEGFNRLAPSAALQQGVAQSVPLKRNGEGQDIANAAMFLGSELASYITGVVLPVDGGWSLGGASIAMSD

SEQ ID NO: 69616 - protein, 129 aa, Zea mays
  misc_feature (32)..(32): Xaa can be any naturally occurring amino acid
KGWGLNLGELARIWKGGCIIRAIFLDRIKKAXDRNPNLANLLVDPEFAQEIIDRQAAWRRVVCLAINNGVSTPGMFASLAYFDSYRRDRLPANLVQAQRDYFGAHTYERVDMPGSFPPEWFKIARNSKI

SEQ ID NO: 69617 - protein, 3809 aa, Streptomyces halstedii
MESKELIEALRDSLKEIQTLKDEKAEILEKQGEPLAVIGMACRFPGGVSSPEQLWNLVVSGGEGISGFPTNRGWDTGNLYDPETQRQGTSYTQEGGFLHDAGQFDPGFFGISPREALAIDPQQRLLLETSWEAIESAGIDPMSLRGSATGVFTGLSYHDYLSQIGSVPDELEGYLGTGNAGSVASGRVAYVLGTEGPAVTVDTACSSSLVALHLAAHALRQGECSMALAGGVTVMATPGAFVDFSRQRGLAEDGRCKAFSAAADGTAWAEGVGTLLVERLSDAQRLGHPILAVVRSSAVNQDGASNGLTAPNGPSQQRVIRQALAAADLSTADVDVVEAHGTGTTLGDPIEAQALLATYGQGRPEGRPIRLGSLKSNIGHTQAAAGVAGVIKMVLALRHGVLPATLHVDEPSPHVDWASGAVELLTEATPWPETGRPRRAAVSSFGVSGTNAHVILEQALDDGDTEVSTTDDESLVPWVLSGRGADGVRAQAARLREWLLERPEDRPVDVGFSLLSSRSVFEDRLVVLGSQREALLDGLAAAAEGAPWPGLVQSSGDVSLNRAVFVFPGQGSQWVGMGRELYASSPVFRGRLDECAAALDPLVDWSLIDVVRGESGAPGLERVDVVQPVLWAVMVSLAAVWESWGVVPAAVVGHSQGEIAAACVAGALSVEDAAQVVALRSRAVRAMAGDGAMVSVALPAAEAEALTGDGVSLAAVNGPSSVVLSGDRSALTPVVERLSAEGVRTKWVPVDYASHSAHMERIREELASLLSGIEPRTSRIPLYSTVSAARIDTSRMDASYWFDNIRGTVRFHETVQALIADGLTAFVEISPHPVLAMSVQDTLDQAEATGLSIGTLRRDENEHEAFLTAAAQLFVAGLPIDWNTAAFTDLDTRRVDLPTYAFQRDWFWLSGRAGAVGDVGSLGLGAVGHPLLGAAVSVAEGDVVVLTGRVSLGSHPWLADHVVLGSVLLPGTAFVELAVRAGDQVGCGRVEELVLHAPLVLTGDEAVDVQVVVGAEESGFRSVDIYSRPHSESGWQDQDAWTHHAVGTVTAGTEDPADADLSVWPPRDATPVVIEDFYAQLDASGYGYGPAFRGLRAAWRRGDEVFAEVELPESERDTAAEFGLHPALFDAALHGTGLMGSREKGMLPFSWNGVSLHASGASVLRVRLRSAADDAIEVLATDVTGAPVLSVGSLVLRSVTADQVRANEQRDLYEVQWGPFAGPVGVSGRDVGEWAVLDLPELGGGVGAVVEGLVACDVAVRVVGRESFAGGGSLPETLIVPVVGGGGDAVDVVCGVLGVVREWLGLVGGVSRLVVVTWGAVSVGSGEGVGDVGGAGVWGLLRSAQSEHPGRFVLVDVEGVEGVGWGGLVDGVVCGEGQVVVRGGGLLVPRLVRAGGGGLVIPETFTGGAEVVGGVGSGWCVGVGVGSGVGTLEGLSVVGAGVGSGVGGGLGVGEVRVAVRAAGVNFRDVLIGLGVYPGEALLGSEGAGVVVGVGEGVVNVGVGDRVMGLFLGGFGPEVVVDARMVVRLPVGWSFVEGATVPVVFLTAWYGLVDLAGVRAGERLLVHAAAGGVGMAAVQLARHWGVEVFGTASEGKWEVLRGLGLDDAHIASSRDLGFVEKFGREHSDGVSEGRSGGVDVVLNSLVGEFVDGSLGLLGEGGRFVEMGKLDVRDAGVVGELWSGVWYRNFDLVEAGLDRIQEMLCELVGLFDVGVLEALPVRCWDVREVVDALRFVQQARHVGKVVLRVPGGWGSGTVVVSGGTGVLGRAVVRYLVGCGVGRLLLLSRSGAAGEGVGELIGELEGLGVVVDVVACDVGDREALAGVLGGVSGEFPVTGVVHLAGVLDDGMVESLSEGQVRRVFAGKVDGLVNLDVLTRGMPVEGFVVFSSAAGVFGNAGQGNYAAANACVDAVVARRRVEGLPGVSLAWGLWSEASGMTGHLDAGDHGRMSRGGAGGLSTGEGVALLDAALGLPQSLLVPIRLDGRQLQARADVGDVHPLLRGLVRSRSRRAASAVGIGVGGLGGRLVGLVEGERRRVVLDLVRSHAATVLGHGDVAGVGAGRAFRELGFDSLTAVELRNRLNTATGVRLPATLVFDYPTPTELADYLLVQMVGESGAADSDQASSVVVVSEEPLAVVGMACRFPGGVGSPDELWDFVLAGGDGISGLPVDRGWDVAGLFDPDPEREGTSYTREGGFLHDAAEFDPGFFGISPREALAMDPQQRLLLETSWEAVENAGIDPLSLKGTSTGVFAGVTYHDYASRLRSIPQGLEGLLGTGASASVVSGRLAYVLGLEGPALSVDTACSSSLVALHLAGQALRQGECSMALAGGVTVMATPGTFVDFSRQRGLAEDGRCKAFDVSADGFGPAEGVGMLVLERLSDAQRLGHPVLAVIRGSAVNQDGASNGLTAPNGPSQQRVIRQALASAGLSTMDIDAVEAHGTGTALGDPIEAQALLATYGQGRPEDQPLRLGSIKSNIGHTQAAAGVAGVIKMVLAMQHGVLPPTLHVNEPTPHVDWASGAVELLTEATAWPEVDRPWRAAVSSFGISGTNAHTIIEQAPQKEAEAPESTVKGDALVPWVVSGRGADALRAQAARLREWVLEHPEHSSADIGHSLVTSRSSFENRAVVLGADRAGLLAGLEAAAQGEPRSYLIQSPPNGRASGGGVAFLFTGQGAQRVGMGRELAARFPVFASALDEACVQLDAHLERPLREVLFAEPGTEAAALLDETAFTQAALFAIEVALYRLVESWSLTPDYLLGHSIGGLAAAHVSGVLSLEDAAEVVAARGRLMQALPKGGAMVSLQASEDELVESLQLLVDDKERVSVAAVNGPDTVVISGDDEMVTEVAGYWLVQDRKVKRLKVSHAFHSVLMEPMLAEFEQVLSRVTLNPPRIPVISDSTGLPLTAEQATSPAYWTAHVRNPVLFHQAITHLTEQSVSAFLELGPDGVLSAMTRTSLADDSDTTVVPLLRRDRDESEAALTALAELYVNGVAVDWTVLLDGARPVALPTYAFQRQRFWLEAGTDPVRQGAFEMESRFWEVVEQGDAAELASAFAAMGLDASAEEWEPVLPALTSWRQAQQTRSAVDSWRYRIIWKPRTGTPLSSTLTGTWLVAVPTGPEHKELVDQCAEALERHGARVVLVRPDASAPADRRTWLAALRQALPEQPHQNLTQTQTQAQEAADAGQSLAGVVSLVGDVAGTLGLVQGLGGVGVVAPLWCVTRGAVGVGGGDVVVSPVQGLVWGLGRVVGLEHPERWGGVVDLPVSVDGRGWERFCSVLAGGGGEDQVAVRSSGVFVRRLVPAPAPAPAPAAVSVGEGGWSPGGGTVLVTGGTGVMGARAARWLAARGAQRLLLVSRAGETAPGVSELVAELTAMGSRAEVVACDVADRDALAALLAAVPEEYPLTAVVHTAQVQDDGALAEFSSERLEPALRAKCSGAWNLHELTTDLSLSAFVLFSSGAGVWGGGGQGAYAAGNAYLDALAEYRRGLGLPATAIAWGLLEQDTPPGGATAPDPRTDTSDGSDSGTGTDSDSGSGTGTGTGTDSGSGSGIGGTRMDRRGLAAMDPQAAFDALHDVLSHGETALTVADVDWERFYPAFAVARPRPLLHDIPAVAALLAEDRDSDGDVQARSDLAERLTALPAEEQQRAVLDLVRTHVAAVLGHSAPDGVQAGRTFRDLGFDSLTAVELRNRLSSATGVALPATLIFDYPNPSAIADHLRRQLCGGENTLASTLTSVSDLEQEAEKAVARFKEDPDQVDLEEITPVISRLKAVLAQYESLRAPSTGTSSASSDLSSATATELIDIINQEFGSVSE

SEQ ID NO: 69618 - protein, 511 aa, Saccharomyces cerevisiae
MVLPRLYTATSRAAFKAAKQSAPLLSTSWKRCMASAAQSTPITGKVTAVIGAIVDVHFEQSELPAILNALEIKTPQGKLVLEVAQHLGENTVRTIAMDGTEGLVRGEKVLDTGGPISVPVGRETLGRIINVIGEPIDERGPIKSKLRKPIHADPPSFAEQSTSAEILETGIKVVDLLAPYARGGKIGLFGGAGVGKTVFIQELINNIAKAHGGFSVFTGVGERTREGNDLYREMKETGVINLEGESKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDAAVVGQEHYDVASKVQETLQTYKSLQDIIAILGMDELSEQDKLTVERARKIQRFLSQPFAVAEVFTGIPGKLVRLKDTVASFKAVLEGKYDNIPEHAFYMVGGIEDVVAKAEKLAAEAN

SEQ ID NO: 69619 - protein, 336 aa, Burkholderia sp. 383
MTIRVAINGYGRIGRNTLRAFYENGKKHDIEIVAINDLGDAKTNAHLTQYDTAHGKFPGEVSVDGDYLIVNGDRIRVLANRNPAELPWGELGVDIVMECTGFFTTKEKASAHLKGGAKKVIISAPGGKDVDATIVYGVNHDVLKAEHTVISNASCTTNCLAPLVKPLHDKIGLETGLMTTIHAYTNDQVLTDVYHEDLRRARSATHSQIPAKTGAASAVGLVLPELNGKLDGYAIRVPTINVSIVDLSFIAKRDTTVEEVNAIMKEASEGALKGILGYNTAPLVSIDFNHNPASSTFDSTLTKVSGRLVKVSSWYDNEWGFSNRMLDTAVAFANAK

SEQ ID NO: 69620 - protein, 446 aa, Debaryomyces hansenii CBS767
MRDLFVLGGSSHPNLTRSICRNLTIDQAFVDSKKFSNGETSIEIQDSVREKDVFIIQSGCGHVNDNFLELLIMIAACKTASAKRVTAVLPLFPYSRQPDVPHAASLTGAPSVSTKKDKYTFESAPGTPRPLSRGESEAEGPVSPTPSSANSSQQTETLLSKATMNNVKQPVPTRVNTKIPSYTPTSIVTNSAATNLPCVDVYGKTESGYKQWIAQNGTLIANLLTTAGADRCITMDLHDPQFQGFFNIPVDNLYSKPLLKHYIIDYIPNYLDCVIVSPDSGGAKRATSIADALGCSFALIHKERRAKVANTPPSTNATNTGLHSVQNSLVATTMLVGDVKDRVCVLVDDLVDSSYTITRAAKLLKDQGAKYVYALVTHGIFSGDAINRINKSAVDKLIVTNSVPQNDNIGVLGDKLEVLDISRILAESIRRIHNGESVSMLFDHGW

SEQ ID NO: 69621 - protein, 253 aa, Bacillus subtilis
MNLTDKTVLITGGASGIGYAAVQAFLNQQANVVVADIDEAQGEAMIRKENNDRLHFVHTDITDEPACQNAIRSAVDKFGGLDVLINNAGIEIVAPIHEMELSNWNKVLNVNLTGMFLMSKHALKYMLKSGKGNIINTCSVGGVVAWPDIPAYNASKGGVLQLTRSMAVDYAKHNIRVNCVCPGIIDTPLNEKSFLENNEGTLEEIKKEKAKVNPLLRLGKPEEIANVMLFLASDLSSYMTGSAITADGGYTAQ

SEQ ID NO: 69622 - protein, 462 aa, Oryza sativa Japonica Group
MAAAAAVWFSAIAAVLLAASTIAVVVVAKMTGKRNGGAAAAAAAAAEAELPLPPVANFLVGPKLQGGFYLRPESEVHQGGTYRMTVPMFGRGVMYDVDVATRSEQIAVCFEALRPTKLRSSTVTMVRETEEYFAKWGEQGTVDLKRELDLLILTIASRVLLGKEVRETMFADVVASFHELMDNSMHLISLCFPNLPIPRHRRRDTASARLKELFSRAIQLRRGSGRAEDDVLQRFLESRYRDGRAMSDNEITGMLIALVVAGQHMSSSASTWTGAFLLRDPKHLAAAVDEQRRLIGDDRVDYDALTTGMSTLHRCIKEALRMHPPAPALVRTVRRGFAVWTREGKEYRMPAGHSVVSYAAFNHRLGYVYRDPDEYDPERFGPERKEDRVAGKFSFTAFGGGRHACLGEHYAFLKMKVIWSYLLRNFELELVSPFPEVELNNIMLGPRGEVMVRYKRRKLTST

SEQ ID NO: 69623 - protein, 321 aa, Candida sp. GCY 2005
MTTSSTIKLNSGYEMPIVGFGCWKVTNETAADQIYNAIKIGYRLFDGAQDYGNEKEVGEGINRAIKDGLVKREELLITSKLWNNFHDPKNVELALDKTLSDLNLGYLDLFLIHFPIAFKFVPIEEKYPPGFYCGDGNNFHYENVPLLDTWKALEKLVQKGKIRSIGISNFTGALIYDLIRGATIKPSVLQIEHHPYLQQPKLIEYVQKQNIAITAYSSFGPQSFLELESKRALDTPTLFEHKTIKSIAEKHGKTPAQVLLRWATQRNIAVIPKSNNPARLAQNLSVVDFDLSKEDIQEISALDIGVRFNDPWDWDNIPIFV

SEQ ID NO: 69624 - protein, 395 aa, Neisseria meningitidis FAM18
MNTLLNQLKPYPFARLREAMQGISAPEGLEAVPLHIGEPKHPTPKVITDALTASLHELEKYPLTAGLPELRQACANWLKRRYDGLTLNSDTEILPVLGSREALFSFVQTVLNPVSDGLKPVIVSPNPFYQIYEGATLLGGGEIHFANCPAPSFNPDWRSISEEVWKRTKLVFVCSPNNPSGSVLDLDGWKEVFDLQDKYGFIIASDECYSEIYFDGNKPLGCLQAAAQLGRSRQKLLMFTSLSKRSNVPGLRSGFVAGDAELLKNFLLYRTYHGSAMSIPVQRASIAAWNDEQHVIDNRRLYQEKFEWVIPILQQVFDVKLPDASFYIWLKVPDGDDLAFARNLWQKAAIQVLPGRFLARDTEQGNPGEGYVRIALVADVATCVKAAEDIVSLYR

SEQ ID NO: 69625 - protein, 464 aa, Gluconobacter oxydans 621H
MSLPYPMPDPSAQRQTRTGALSAMSMPDTPVHDQVSGRADPHAAIKGESGKRKTVVMKFGGTSVGNIERIRNVAKRVKAEHDRGRRVAVVVSAMAGVTNRMVGYCAELDPLADPKEYDAVVAAGEQVTSGLVSIALQALGVKARSFQGWQIPLVTDDAHGKAAIESVDGTALLACLDDDVVPVVAGFQGVGPDGRIATLGRGGSDTSAVAVAAAINADQCDIYTDVDGIYTTDPRIVKRAKKLDRITYEEMLELASVGAKVLQTRSVGLAMREGVRVRVLSSFAETDDDSGSIVVDEDEIMEKELVAGIANSHDEAKISVRNIPDRPGIAAAIFDPLAAANINVDMIVQSVGVDNMTNMTFTVSKADEAAARAVLEKAREYVQYGELITSHNVVKISVVGIGMRSNAGLAARMFRTLADRGINVQVISTSEIKISVLIDSEYTELAMRALHTAYGLDAKEGADA

SEQ ID NO: 69626 - protein, 495 aa, Marinobacter sp. ELB17
MVNTFKHQWLSNVRGDLLAGVVVALALIPEAIAFSIIAGVDPKVGLYASFCIAVIIAFVGGRPGMVSAATGAMALLMVTLVKEHGLEYLMAATLLTGLIQLVAGYLKLGSLMRFVSRSVVTGFVNALAILIFMAQLPELTNVTWHVYALTAAGLGIIYLFPYIPKLGKVLPSPLVCIVGLTVVAFLFDIDVRTVGDMGDLPDTLPIFLWPDVPLNLETLMIILPYAIPLAAVGLLESMMTATIVDDLTDTESGRNRECKGQGIANIGSGLLGGMAGCAMIGQSIINIKSGGRGRLSTLTAGVFLMVLILVLDDFLVRIPMAALVAVMIMVSIGTFSWESIRNLKTHPLSTNIVMLVTVVVVVFTHNLALGVFAGVLLAALFFANKIGHYMGVNSVLNEADSTRTYKVTGQVFFSSSEKFIAAFDFREVVDKVVIDVSRAHFWDITAVAALDKVVIKFRREGAEVEVIGMNEASATIVDRFGVHDKPEGVDQLIGH

SEQ ID NO: 69627 - protein, 560 aa, Mycobacterium sp. MCS
MELILVVVGAIVVTAIAHRRGLEPALVLVVVGFAVSFAPDFNGIELESDVLLSVVLPPLLYSAALSFSFPTFLRNIRPILGLGVGLVVITTFAVAGLASWLVPSLTFGTALILGAVVAPPDAVTAVAVGRRLGLPKKVMAILTGESLVNDAAALSLFSIAVAQVAGTRAFIENPVLLFGYSALLGPVVGAALGFITLWIRRRLANPGLETIQGLVVPFAAFISAEHLHASGVLAVVVAGFVVGHGSLDAGYQTRLQERYVWNSVDVMLEAFVFAYIGLQLRFVLEDLNEAHESLAEVAVASAVVLLVVLLIRPVCVFAMFGRGVLSRKVESKLSVPKPEQGGRGALGVRRRGGAGRLSGLVDRRMLTWQENVVVSWTGMRGVVTLAAASGIPMMTIDGEPFPERATIQAIAFVVSVGTLLLQGWTLPPLIRWLQPSFEHDRQSDETETRKAEQVVHAAADDVLNRFADAPPPGLDDATLANIRQTIARHAQDADEMPDPESHTPRAEVFSKLYRDVLCAQRNALIAERDAGRIEDEAVRAMLERLDLQEAGVSARLESRI

SEQ ID NO: 69628 - protein, 1627 aa, Nostoc sp. PCC 7120
MKILIVEDDELNAYALTAVLTNQNYAVEVGSDGITAWELIQTYDYDLILLDVMLPRLDGISLCRQIRSSGRQMPILLLTGCDSSHEKAIGLDAGADDYVVKPFDEEELVARVRALLRRGVTTAQPILEWGNLQLDPSSCEVRYNQNLLSLTPKEYALLELFLRHSRRVFSCSMILEHIWSYEDTPGEEAVRTHIKGLRMKLRNAGAPGDLVETVYGIGYRLKAQEEEQGSKEEVKQPTSKGKSQQQTLTAIAGIWQKFYVRVDEQVKVLEQAAMTFERSQMITLTQEALNSELYSQAIREAHTLAGSLGTFGLPEGSKLARKIEQLLKSGKRLTPTEIQSLQNWVKLLRQEVAAHEPQAASPETTSAAILQPQPPQAEAKVLAVDDDPQILAILQTLLHPWGLQVITLDDPRQFWETLRDVNPDLLILDVEMPYTNGIELCQVVRNDPQWSELPILFLTVHKDGEIVNQVFSVGADDFVSKPIVGPELVTRIINRLERVKLLRRVSESRGVGEKISPPSPSFTDWRTIFNAEPECVMIVATDGTLLDINPAGVAAIEADSVGAVIGKRVYSLVVPECQQAFRQLNESVCQGKQGTLEFEIITCRGNRRWMATHAVPVRNEKDGNLVQLSITRDVTQYKQAELEIKRINRTLQTLSDCNQLVIRTQDESELLQKVCQILVDVGNYRLAWVAFAENDAEKSIHPVAQAGYEEGYLQSLNLTWADTVRGQGPTGTAIRTGKTAIIQNILTDPRFEIWRCQANNRGYASSISLPLMNNGQAFGALNIYAAEANAFDSDEVKLLEELTADVAYGIVALRNRRDRQIAEAALRESQERLSLTLEAVNLGIWDWNITTNQIIWSEGHARLFGIESGKFDGTYEAFQACIYPEDRGGLAEVINSARQQKTDYSHEFRIISPDGNIHWIEGTGKLYYNEMGEAVRMLGIVRDITSRKQIEATLQKINNELELRVAERTAELVNVNRQLQSELDERQRIEEALRISQVRLARILDIADDAIISINGNQQITLFNQGAEKIFGYSAEEIIGQRLDTLIPQRFTQTHRQHVADFGQAPSLARRMGERREIFGCRQDGTEFPAEASISKFQLDKEVFYTVILRDVTERKQIERMKDEFVSVVSHELRTPLTSIHGSLGMLASGLLSADSEQGKRLLEIATDSTERLVRLINDILDIERIESGRVKMERESCDLSDLIESAVSIMQPLANKAGVKLSVSSPSIQLWVDPDRIVQTLTNLLSNAIKFSTAEKTVWLVAQHYGDELLLTVKDNGRGIPADKLDSIFERFQQVDSSDSRNHDGTGLGLAICQSIIQQHGGRIWAESVLGEGSNFYFTLPILPISQNSELPDSLPHHPLSPEESPPSLISSTHSPLVLVCDDDPLIRTELQSLLEQGGYRVFTVATGQEAIASASTQHPDVIVLDLLMPGMNGWETMAMLKESTETKHIPIVICSVYKPTSNHQPSRDFVDWVSKPVQESYLLHSLRQAIAKSSHRVRILIVEDDADLAELFVTLFERHDIETFSAKTGREAIHLSQEVNPDLLILDLILPETDGFAVVDWLQKHQRLCNIPVVVYSAKDLDESERKRLKLGHTEFLTKGRVTTKEFEQRVIELLQRITPTNVRD

SEQ ID NO: 69629 - protein, 420 aa, Staphylococcus aureus
MKLTVVGLGYIGLPTSIMFAKHGVDVLGVDINQQTIDKLQSGQISIEEPGLQEVYEEVLSSGKLKVSTTPEASDVFIIAVPTPNNDDQYRSCDISLVMRALDSILPFLEKGNTIIVESTIAPKTMDDFVKPVIENLGFTIGEDIYLVHCPERVLPGKILEELVHNNRIIGGVTKACIEAGKYVYRTFVQGEMIETDARTAEMSKLMENTYRDVNIALANELTKICNNLNINVLVVIEMANKHPRVNIHQPGPGVGGHCLAVDPYFIIAKDPENAKLIQTGREINNSMPAYVVDTTKQIIKALSGNKVTVFGLTYKGDVDDIRESPAFDIYELLNQEPDIEVCAYDPHVELDFVEHDMSHAVKDASLVLILSDHSEFKNLSDSHFDKMKHKVIFDTKNVVKSSFEDVSYYNYGTIFNFIDK

SEQ ID NO: 69630 - protein, 466 aa, Ricinus communis
MPPQAGSKWYDDDGKLKRTGTVWTASAHIITAVIGSGVLSLAWAVAQLGWVAGPAVMFLFSLVTYYTSTLLSACYRTGDPVNGKRNYTYMDAVRSNLGGAKFKICGYVQYVNLIGVAIGYTIASSISMMAVKRSNCFHKSEAKNPCHMKCQSLHDCILEVVESSSSQIPDFDQTMGGLSIVAAIMSFTYSTIGLGLGIAEVTKNGKAMGSMTGISIGTVTETQKIWRSFQALGDIAFAYSYSLILIEIQDTIRSPPAESKTMRKATLISVSVTTLFYMLCGCFGYAAFGDMSPGNLLTGFGFYNPYWLLDIANVAIVVHLVGAYQVYCQPLFAFVEKAAVQRFPDSEFILKDIKIPIPGCKPYNLNLFRMVWRTVFVIFTTVISMLLPFFNDIVGLLGALGFWPLTVYFPVEMYIAQKKIPKWSTRWLCLQILSAACLIITIAAAAGSIAGVIVDLKTVKPFQTTY

SEQ ID NO: 69631 - protein, 328 aa, Geobacillus kaustophilus HTA426
MILVCGGAGYIGSHAVYRLLEKGERVVVVDNLQTGHREAVHPDAVFCQGDIRDRDFLREVFRQHDIEAVIHFAANSLVGESMEEPLKYYDNNVYGTQVLLEVMREFGVKQIVFSSTAAVYGEPKQIPIVETDPTEPTNAYGETKLAMEKMMKWADRAYGIRSISLRYFNVAGAYGTTIGEDHNPETHLIPLILKVPLGQREEIYIFGDDYDTPDGTCIRDYIHVLDLVDAHWLALEKLRSGADSDVYNLGNGNGFSVKEVIEAARQVTGHPIPARVVARRPGDPARLVASSEKAKRELGWEPKYPSITDIVASAWEWHQARPNGYRGV

SEQ ID NO: 69632 - protein, 254 aa, Bacillus amyloliquefaciens
MNLTDKTVLITGGASGIGYAAVQAFLNQQANVVVADIDEAQGEAMIRKENNDRLHFVQTDITNEPACQNAILSAVDKFGGLDVLINNAGIEIVAPIHEMELSDWNKVLNVNLTGMFLMSKHALKYMLKSGKGNIINTCSVGGVVAWPDIPAYNASKGGVLQTDAFYRPSIIAKHNIRVNCVCPGIIDTPLNEKSFLENNEGTLEEIKKEKAKVNPLLRLGKPEEIANVMLFLASDLSSYMTGSAITADGGYTAQ

SEQ ID NO: 69633 - protein, 552 aa, Geobacillus kaustophilus HTA426
MAFSSKHRSDVLQTMSEKQYDLLIIGGGITGSGIALDAVSRGMTVALVEMQDFAAGTSSRSTKLVHGGLRYLKQFEVKLVAEVGRERAIVYENGPHVTTPEWMLLPIYRGGTFGKWSTSVGLWLYDRLAGVKQSERRTMLDARQTLEKEPLLKRDGLLGGGYYVEYRTDDARLTIEVIKKAVELGADAVNYVKAEQFLYDERGRAIGARCRDLIGGRVYDIRAKKVVNAAGPWVDALRDKDGSKTGKRLRLTKGVHIVIDQKRFPLKQAVYFDTPDGRMVFAIPRDGKTYVGTTDTFYDDDPAHPAMTEEDRDYLLQAIHYMFPSVGVTADDVESSWAGVRPLIYEEGKNPSEISRKDEIWTSPSGLITIAGGKLTGYRKMAETVVDLVAKQLEKEERKTFRPCQTKQLPISGGDVGGSHRLPAFIAEKAEEAVRYGLTKEAGARLARQYGTNVDRLFALSQQYDRSSGLTRETFIRLVYAMEEEMAAKPVDYFIRRTGALLFDIDSVWREKEAVVAFMARYLGWTGEERDVYEKELDKELRRAVLAEEGAK

SEQ ID NO: 69634 - protein, 129 aa, Brassica napus
MAAAPSLNLLIITLFLLIISLPRSESLPENPSLLLLGDGFDWPISDGGIGGGESFEDAEEEEDNVGVGDRRSLYWHRKRYYISYGALSANRVPCPPRSGRSYYTHNCFRARGPVHPYTRGCSSITRCRR

SEQ ID NO: 69635 - protein, 520 aa, Burkholderia mallei ATCC 23344
MSPHPNSDNSTAQSNPPQLRRSLKARHLTMIAIGGSIGTGLFVASGASISQAGPGGAMLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVIAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLIPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSSLYPYGPIFAFALCIVIALGQDYQAFLANRIDWIGVLATYVGIPLFLVVWLGYRLVHKTRVVRYEDMDIASWVAEHERAAAHEAREAAAVRVPSSPEAAS

SEQ ID NO: 69636 - protein, 400 aa, Picrophilus torridus DSM 9790
MNFEIKDTNIRKIFDSRGNFSAEVTVILENASGTASAPAGASTGKTEVIAYPDNNIDNGIDFFYRHVKKALKGFNSINQEGLDRMLHEIDGTDNFSNLGGNIATAISIANAKAVSNALGIPMYRYVGGINYSMPRPIGNVIGGGKHSKNGTTIQEFLVSAQGKTVLDSIYYNILIHRRIGEILSGMFKNQSIGLGDEKAWTCDISDEDAIEIIKNASKDISSEYKIKVLNGVDFAADSFYDGNYYIYKNRKLTRDQQIDYAISISRDHGFYYIEDPLNDQDFDGFSEITSKVGDKSLIVGDDLYTTNPERIKKGIEKRSTNGVLIKVNQIGTLSDTARSVRIATEHGLKTVVSHRSGETTDDFIAHLAVAFGSPLIKTGTIGGERLAKLNELIRIEEELI

SEQ ID NO: 69637 - protein, 646 aa, Schizosaccharomyces pombe
MLLRDGRIPQYSIYPLPVPPMNSKTPTLGIVCSEGTISLSLEEGLEFVGVPLSGEGLKLRVEALAPSERLQEFLDDEVAYHPEENVHKVVGLSSAWLELDSEDTLIADRSEEVLLKEASYASYCGLSSIILNGSNFTQCNVMRYARAVSSALNSTMNLKFLVQLAIESGHEDYFETWKMWDTIRSACGYHPRLKVGLELPPACSPPIELVNRWYAEPIEMITMSCMAFVPNPNGYPVLGRKLRAIYALYLRLNPRILLWDNDAPEKIGDSPDYSIYMKHLFDSQPPAPLVEDLADSYKDYLQVPLQPLSYNLENITYEIFERDPVKYAQYEQAIFSALMDRDESSVTRIAVVGAGRGPLVDCALRAAISSSRTVDMIALEKNPNAFSMLLMRNRQDWAAKVTLVFGDMRTWNPDYKIDILVSELLGSMGDNELSPECLDGVQHVLDEETGICIPSSYISYVTPIMSPKLWSEARNMNDPNAFERQYVVLMNSFDFLAADDEFRFQSLWSFHHPNKDSEVYTKNLHNKRFASVRFQASSPGILHGFAGYFEATLYKDISLSIMPATMEAKSPDMFSWFPIYMPIKKPMYVPENSQLEFHMWRLTDGMRVWFEWCANAYLVLRNGSQIKLSSTEVHNISGKAFSCNMY

SEQ ID NO: 69638 - protein, 202 aa, Mesorhizobium sp. BNC1
MSQQSMSQQRAFNLPNLLTYARIMAVPLIVLCFFLEGRLQSSDFARWSALGLFLAASVTDYLDGYLARSWKQTSNIGRMLDPIADKLLVATCLLLLAADTDRTIAGWTLWAAIVILCREILVSGLREYLAGLKVSVPVTQLAKWKTAIQMVAIGFLLAGPAGDKIVPYITETGIALLWFSALVTLYTGYDYFRAGLKHIIEE

SEQ ID NO: 69639 - protein, 269 aa, Marinobacter sp. ELB17
MTSYPIYQVDAFTSEIFKGNPAAVMPLKAWLPDGVLQALAAENNLSETAFFVPEPEASEADFHIRWFTPEIEVPLCGHATLASAWVIFNKLGWTSDRIRLRSKSGPLGVHKQSDGWLVLDFPNLAVTEQSTPSIILDALADAPTTIFYVAKDTNYMLVLENEAAVKAAQPDMQKIKQLKSLGLIVTAPGTDSDFVSRYFVPCAGINEDPVTGSIHSALVPYWAEKLGKKALEARQLSARGGLLRCELKGERVAIAGQAAFYMEGTVYLQ

SEQ ID NO: 69640 - protein, 86 aa, Escherichia coli
MSKQQIGVVGMAVMGRNLALNIESRGYTVSIFNRSREKTEEVIAENPGKKLVPYYTVKEFVESLETPRRILLMVKAGAGTDAAIAS

SEQ ID NO: 69641 - protein, 461 aa, Streptomyces coelicolor A3(2)
MPAVPERAPVTTRSETQSTLDHLLTEIELRNPAQPEFHQAAHEVLETLAPVVAARPEYAEPGLIERLVEPERQVMFRVPWQDDQGRVRVNRGFRVEFNSALGPYKGGLRFHPSVNLGVIKFLGFEQIFKNALTGLGIGGGKGGSDFDPHGRSDAEVMRFCQSFMTELYRHIGEHTDVPAGDIGVGGREIGYLFGQYRRITNRWESGVLTGKGQGWGGSLIRPEATGYGNVLFAAAMLRERGEDLEGQTAVVSGSGNVAIYTIEKLTALGANAVTCSDSSGYVVDEKGIDLDLLKQIKEVERGRVDAYAERRGASARFVPGGSVWDVPADLALPSATQNELDENAAATLVRNGVKAVSEGANMPTTPEAVHLLQKAGVAFGPGKAANAGGVAVSALEMAQNHARTSWTAARVEEELADIMTSIHTTCHETAERYDAPGDYVTGANIAGFERVADAMLAQGVI

SEQ ID NO: 69642 - protein, 140 aa, Mesorhizobium sp. BNC1
MAIERTFSMIKPDATKRNLTGAITKMLEDAGLKVVASKRVWMSRRQAEGFYAVHKDRPFFDELCEFMSSGPTVIQVLEGENAIAKNREVMGATNPANAAEGTIRKVFALSIGENSVHGSDAPETAEQEIRYWFSETEIVG

SEQ ID NO: 69643 - protein, 762 aa, Gluconobacter oxydans 621H
MIKPLKKAVLPVAGLGTRFLPATKTMPKEMLPVVDKPLIQYAIDEAREAGIEEFCLVTGRGKDSLIDYFDIAYELEATLKERGKKSALEALAPSSVEAGSLVAVRQQEPLGLGHAIWCARSFIGDDPFAILLPDDIVKGRSCIGQLVEAYNQTGGNVVAVTEVPSEHTNRYGILDVGSDDGKLVEVKGLVEKPAPEDAPSNLSIIGRYVLTPDVMKYLAKLERGAGNEVQLTDAMAKTIGEVPFHGLRYEGTRYDCGDKAGFLEAQIAFSIDREDLGGSVKAFLKKYKQYVDPLMPFRHDFDPTSLREYDIRGIVGKTLHPADAFAIGRTFASMVIRAGGKRIVVGYDGRLSSPTLEEALVRGAVESGAEVTRIGCGPTPMLYFASVADSADGAVMVTGSHNPPDYNGFKMMMGGKPFYGDQIRKLGRLSASGDVLPATNGTATKIDISDRYIDRLVQDYDGIRPLRVVWDNGNSAAGVVLSRLVERLPGEHTVLFGEIDGHFPNHHPDPTVEKNLQDLIRVVDEKQADLGIAFDGDADRIGIVDNRGQIFWGDQMLVLLAQDVLSRHPGATIIADVKASQILFDEIAKAGGQPLMWKTGHSLIKTKMAETGSPLAGEMSGHIFFADKWYGFDDALYAAVRVLGIVSRLPGPLSDFRDSLPVTVTTPELRFNCDDKRKFEVITEVAERLRREGADVSEIDGVRVNTPDGWWLLRASNTQAVLVARAEARDDAGLDRLKAALAAQLEASGLEAPDFSGENAGH

SEQ ID NO: 69644 - protein, 400 aa, Agrobacterium tumefaciens str. C58
MQESTMKFGIVIVAAGRGERAGSPEEGPKQYRPIGGRAVIEHTLATFLRWNDACPIVVVSHADDAALLSPILARLDAGERITTVTGGATRQQSVLAGLEALSSHGLTHVMIHDAVRPFVAADMLERIAALHRAGAGGVLPALPVTDTLKRGLEDRVVETVSRQGLYAAQTPQSFSYSDILDAHRAAAASGKTDFTDDASIAEWTGLTVTLTEGSVDNVKLTLKRDIAMADEKLSHALPDVRTGNGYDVHQLEAGDGVTLCGIFIEHDQRLKGHSDADVALHALTDALLATCGAGDIGDHFPPSDPQWKGAASRIFLEHAAKVVRDNGGTIMNADVSLIAEAPRIGPHRQAMREALSDMLGIALERCSVKATTNETIGFVGRREGIAAIATATVVYQGRPL

SEQ ID NO: 69645 - protein, 339 aa, Oryza sativa
  misc_feature (77)..(77): Xaa can be any naturally occurring amino acid
  misc_feature (183)..(183): Xaa can be any naturally occurring amino acid
MPLAEGEFALPDEVLAVMPRDPYEQLDLARRITALAVAGRVTGLEREAARLRESAADKDRENGELRERVALLDRALXQETNSRLRAALEDNIKLSKERDSLAQTSKKLARDLQKLESFKRHLMQSLRDDSPSPQETVDITTCDQSISSKASSCGDGDSITHTTTNLLSTSLDVGSTVQEGTVXKPPIQKYALSSHITPRLTPEATPKIMSTSASPRRMSTTATPKLMSGTTSPSKTRIEGYMSMTPWYPSSKQSSAANSPPRGRPNPGRTPRIDGKEFFRQARSRLSYEQFGAFLANIKELNAHKQSREDTLKKAEEIFGPDNKDLYLSFQGLLNRSLP

SEQ ID NO: 69646 - protein, 441 aa, Sulfolobus tokodaii str. 7
MDDDKKIIREHTFKTWSKQSSWEPIIVTSSRGVYFYDSNGKKYLDFSSQFVNVNLGYGNERVINAIKEQLDTLQYINPSFGAVVRAKATKALLEVMPKNLTKFFFSTSGTEANEAAVKVSRLYKKPSYKILARYRSYHGSTEASISLTGDYRRWFVEPNTMPGVVRFPEPYCFRCPLKLKYPECNLACANYVDYIIKQEKNVAAIIVEPITGTNGVIVPPKEYMPLLWKIAKENDVLFIADEVMTGWGRVGEWFAVNLWNIQPDILTTAKGASASYVPIGITAFNKEIGEFFEDHIFAHGHTFEAHPVSLAAIPAVIEEYKRLNLLSHVKVMGEYLGKRLLELKERHKSIGDIRGIGLFWAVELVKDKNNTPFGDYEDKYEGKPTVVDIISKKALEKGVYVYNGPSWLIISPPLIINKEEIDQGIETLDEVIKEADSAFKD

SEQ ID NO: 69647 - protein, 390 aa, Brucella melitensis
MAAGRGERAGQSAEGPKQYRLIGAEAVLARTLRAFTDCPLIGTIAVVIHPDDHALYRRAVPEKHENVILVTGGPTRQESTRLGLLALKDEAPQYVLIHDGVRPFIGQDLLERIIANLTPDNGVLPALAVSDTLKRAAADGMVETTISRTGLFAAQTPQAFPYAPILDAHEKAFAINRTDFTDDAAIAEWQEIAVRIIEGSADNTKLTWAKDIEMADKRLRQDHAVFPDIRTGNGYDVHSFEPGDHVTLCGVKIPHEAKLNGHSDADVALHALTDALLATRGAGDIGTHFPPSDPQWKGAASRIFIEHAAKIVREAGGRIANVDVTLISEAPKIGPHRAAMTQALCDMLGIAADRVSIKATTNEKLGFVGRREGIAAIATATVIYPGEVPE

SEQ ID NO: 69648 - protein, 602 aa, Idiomarina baltica OS145
MSDLSMLALIGVLSICCQWLAWRIKLPAILPLLVCGLLVGPTLGWLQPDQLFDHLLFPVVSLAVAVILFEGSLTLKFDEIRGHGRMVTNLVSIGMVVTWITISVATHFIMDWRWEIASLFGALVVVTGPTVIQPMIRSIRPINKLANILRWEGIIIDPLGALLAVLVYEFIIASQDVAMLHALQAFAKTIGIGFFFGWAAAKLLGLALGRGWFPHYLQNVATLTIVLGVFALSNAIQHESGLLTVTVMGMAMANTKNLNLDEILEFKETLSVLLISALFILLAARLDFADFDALGVPSIILLAVIMFLVRPLSVWLSAIGTELRFKDKLLLSWIAPRGIVAAAVSALFALKMEQSGWTDASAIVPLVFLVIMTTVVLQSLTAKPLARLLGLIEPPARGFLIFGANQMARAVASVLKEHEIPVRLADTNWENIRLARMDNLPVYFGNPASEHASNNIDLTGIGRLLVMSPYKQLNPLVSVYYQDWFGSSKVHGLNSGESDFRASHQLSENYKNTLNLFGDSITYSKLASLHFQGAKVKSTPITENFGFEEYQQQYGARAVPMFALDDQKKIHIFTTERELKPAPGWVVIAMITPEKNTDEGGE

SEQ ID NO: 69649 - protein, 434 aa, Mycobacterium avium 104
MSTEPLVGVVGVGYVGLTTAVCVAAAGRKTVAVDINPDRVGRLRAGVAVIDEPGLSELLGDGLAGGVLRFSADFAELADRDVVFVCVPTPSAPDGHADLAAVESVIDRLGRVLRRGAVVALKSTVPVGTTSTMAQRLCHKGIRVVSTPEFLREGRAVDDFRNPDRLVIGSHDELAAQLVHQAYGLAGHRVLRMSPESAELAKYASNAFLAVKLSYTNSLAALCARVGADIDDVTCCMGADRRIGAEFLRPGPGWGGSCLPKDTAALLDIAHRHRVSFAEVEAARQTNTAQARRIVTALRHTLGRPLSGRRITALGLTFKAATSDTRESPALAACRELAAAGAQVAGYDPQLPNIDPAVLQQNRVTAVDDPYRAAKAADAVVVLTEWPQFRSLDWRAVAQDAPLAVVLDARNSLDPATVREAGLRYLGNGVPQGF

SEQ ID NO: 69650 - protein, 487 aa, Triticum aestivum
MNETNRDGIAHGSSTEKRPAEARRIQANSGSQLRKPLCSLLPASMPSPSLRLAVVGAGAAGLAAARELRREGHAPVVFERAAAVGGTWLYASPAPAAAADPLGAAATHSSLYASLRTNLPREVMGFLDFPFTAARGSVVDARRFPGHQEVLRYLEDFTQRFDLYGLVRFQTEVVGVRREAGGRWAVTSRKLGEKGEHDEELYDAVVVCNGHYSEPRVASIPGADAWPGKQMHSHNYRVPEPFLDQVVIVIGASASAVDISRDIASVAKEVHIADRSAPTSTCEQQPEYDNMWLHSMIDHAQGDGTVVFQDGSSIKADVIMHCTGYLYDFPFLGDDSTIAVDDNCVDPLYKHVFPIEVAPDLSFIGLPWKVIPFPLVELQSKWVAGILSGRIKLPSKDEMMEDVKAIYSRLETRGWPKRYTHNFSGGYQFEYDDWLAEQCGHPPIEEWRKLMYAANAKNKAARPERYRDEWDDDGLVALANEDFKKYF

SEQ ID NO: 69651 - protein, 265 aa, Oryza sativa Indica Group
MRAVLIDWLVEVTEEYRLVPETLYLTVNYIDRKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKAQLPRANLMAKAHGSSSTFQFEKWRLRNLSLRKMENERRCARFCHQDDTRQLTPWDVLKAHDNEKLRASRKIVKIE

SEQ ID NO: 69652 - protein, 469 aa, Mycobacterium sp. MCS
MGLVDRFERKLESTVGDAFARVFGGSIVPQEVEALLRREAEAGIRELGRGRILAPNEYVITLSVPDHKKVSADPDLTATTFAKHLEGYIREQGWQTYGDVVVKFEQAPNLHTGQFRARGAVNPDSTTGEPAPAHRDHAFPAEPGVPPMSDNPTYRGGGQGQGRPGDEYYDDGYGRPQEEPRGQEPRAPYPPEQGGYPPRGGYPEQGGYPDRGGYPDQGGYPDQGGYGGGYEQRGPGGYGPPGGGYDQGYRQGPGGYAPPPPPGGQPGYGAPGADYDYGRPPGGPGRHEDGGYGRPGYPDQGGYPDQGGYGGGYGAPAGGRQDYGQDYGRGYAEPAGGYGDPGYGEPAGRDYDYGQGAGGYGGGYGQADYPAAGVGTTVTLQLDDGSGRTYQLREGANVIGRGQDAQFRLPDTGVSRRHLEIRWDGQVALLSDLNSTNGTTVNNAPVQEWQLADGDVIRLGHSEIIVRVH

SEQ ID NO: 69653 - protein, 315 aa, Zea mays
  misc_feature (202)..(202): Xaa can be any naturally occurring amino acid
AKAAGAARVFAGVPSSLVDGNWKWVDLRDRHALVDIFSSHRFEAVIHFAGLKAVGESVHKPLLYYDNNLVGTITLLEVMAANGCKKLVFSSSATVYGWPKEVPCTEEFPLCATNPYGRTKLVIEDICRDVHRSDPDWKIILLRYFNPVGAHPSGYIGEDPCGVPNNLMPYVQQVAVGRLPHLTVYGTDYSTKDGTGVRDYIXHVVDLADGHIAALRKLHEDSDKIGCEVYNLGTGKGTSVLEMVAAFEKASGKKIPLVFAGRRPGDAEIVYAATAKAEKELKWKAKYGIEEMCRDLWNWASKNPYGYAGSRDNSK

SEQ ID NO: 69654 - protein, 561 aa, Corynebacterium efficiens YS-314
MCPLSQRLIRCHLAHNTDPWWGTVTLRSSLLSPPAVARDPLCGRLICDFPSEGDTMTVYANPGTEGSIVNYEKRYDNYIGGQWVPPVEGQYMDNITPVTGEVFCEVARSTAADVEAALDAAHKAAPAWGRTSVAERALILHRIADRMEEHLEEIAVAETWENGKAVRETLAADIPLAIDHFRYFAGAIRAQEDRSSQIDHNTVAYHYNEPIGVVGQIIPWNFPILMATWKIAPALAAGNAIVMKPAEQTPASILYLMNIVGDLIPDGVLNIVNGLGEEAGTALSSSDRIGKIAFTGSTQVGKIINRAASDKIIPVTLELGGKSPSIFFADVMAQDDAFREKAVEGFAMFALNQGEVCTCPSRALVHESIADEFLELGVKRVQNIKLGNPLDTETMMGAQASQEQMDKISSYLKIGPDEGAETLTGGKVNKIDGLDNGYYIEPTVFRGTNDMRIFREEIFGPVLSVATFSDFDEAIQIANDTNYGLGAGVWSRDQNTVYRAGRAIQAGRVWVNQYHNYPAHSAFGGYKESGIGRENHLMMLAHYQQTKNLLVSYDPNPTGLF

SEQ ID NO: 69655 - protein, 252 aa, Zea mays
  misc_feature (136)..(136): Xaa can be any naturally occurring amino acid
  misc_feature (145)..(145): Xaa can be any naturally occurring amino acid
  misc_feature (152)..(152): Xaa can be any naturally occurring amino acid
  misc_feature (164)..(164): Xaa can be any naturally occurring amino acid
  misc_feature (168)..(168): Xaa can be any naturally occurring amino acid
  misc_feature (186)..(186): Xaa can be any naturally occurring amino acid
  misc_feature (244)..(244): Xaa can be any naturally occurring amino acid
MTPSLQDAKITFLGGGNMAAAIIGGLLAKNTNKQNIYVSEPWDVNRNKMADLGVRTTADNKEAAADADVVILAVKPQVAKGVCEELSSAWAGRDSLPVVISIAAGITLASIAQWFKGDSGKAPHIVRVMPNTPALXGEGASGLYXAAEDVTXAAEKELTSALLXSVSXATEWVDKEELLDVVTGIXSGSGPAYFFAFVEHLISSGVSLGLSEEQATRLAAQTCLGAGKMLVESSDEPFSLRKNXTSPNGTTH

SEQ ID NO: 69656 - protein, 585 aa, Glycine max
MKQEMEKRKGGRIEESDEEKWVHDASVDYKGRIPLRASTGVWKASLFVLAIEFSERIAHFGISSNLIMYLTEVMHEDLKTATNNANLWKGATTLLPMIGGFLGDAYTGRFRMVVFSSLVYFKGLSLLTMSQFIPNLKPCNNDICHQPRKVHEVVFFLALYCIALGTGGFKPCLESFGGDQFDGDNLEERKKKMSFFNWWTFTFSIALLLATTVVVYVQDFVSWGVAYLILAMFMALTIIAFYVGIPFYRYRMRPNANPFIPILQVLIASIRKRNLSCPSNPALLCEVPMSENSQGRLLNHTSRLRFLDKAAIVEEKYIEKKAGPWRLATVTRVEETKLILNVVPIWLTSLMIGVCIAQGSTLFVKQAAAMNLKISDNFKIPPASMASLSAFSTIISVPIYDRIIVPILRKVRGNERGISILGRIGIGLIFLVILMVVAALVENMRLRMPGHETMSVMWLIPQYLILGIGNSFYLIALQEYFYDEVPDSMRSVGMALYLSVIGIGFFLSSFLIIIVDHVTGKNGKGWIAKDVNSSRLDKFYWMLAVISALNLCLFLFLAKRFTYKTARRKATEIDCSNCDGVDTVA

SEQ ID NO: 69657 - protein, 260 aa, Oceanobacillus iheyensis HTE831
MERFQDKVILITGGGSGLGKATALQVAKEGAILSLVDLNEQGLEETKKEILEIVPNAKIALIKANVANEEEVKAYVQETINQFGKIDGFFNNAGIEGKQNLTEDFGSDEFEKVVDINLNGVFYGMKHVLKVMKEQGSGSIVNTASVGGIRGVGNQSGYAASKHGVVGLTRNSGIEYGQYGVSIKAIAPGAILTPMVEGSLKQMGGENWEEAGKEFVSVNPMKRFGKPEEVGYLVAFLLSDHAGFINAAVVPIDGGQSYKY

SEQ ID NO: 69658 - protein, 237 aa, Shewanella oneidensis MR-1
MTTIADRLAVAQSRIAQAAQKCARLPHSIHLLAVSKTKPIADIIAAYDAGQRCFGENYVQEGVTKIESLKTTHPDIEWHFIGPLQSNKTTLVAQHFDWMHTLSREKIALRLNEQRPANLAPLNVCIQINISDEDTKSGINAQQMLPLANSISQLPQLRLRGLMAIPSATDDTEQQTRELSELKHLFDTLKQHYPDVDTLSMGMSNDLDLAIAYGSTMVRIGSAIFGERDYSSKETTI

SEQ ID NO: 69659 - protein, 351 aa, Parvularcula bermudensis HTCC2503
MTEPRAALGRRFQSILETIGATPVVKINRLSPEGVDLFVKAEFFNPGASVKDRLALSIIEHGERTGALKPGQTVIEATSGNTGIGLAMVCAAKGYPFVCTMIETFSIERRKLMRYLGAKVILTPKEEKGVGMVRKAKELAEANGWFLARQFETEANADIHEKTTGPEILADFDGHRLDAFVTGFGTGGTVTGVARVLRQHRPDTKIILSEPDTAQMLASGTPQERATDGSAAATHPAWSPHPIQGWSPDFIPLVLQESIDKKLYDALIPVKGEDGIHWAKRLAAEEGILTGISGGSTFAVAHDLAQQAEIGSAILCMLPDTAERYLSTPLFADISAEMNDEEVAIFNGPII

SEQ ID NO: 69660 - protein, 272 aa, Shewanella oneidensis MR-1
MSQQKICFIGAGNMTRSIISGLIRSGYPASQVQATNPSQGKLDALATDFGVRVSQDNVSAAQDADVIILSVKPQLMEQVCQALQGIDMSNKLLITIAAGIKASRYSEYLAQPITLIRTMPNTPMQIGVGMTGLYAPQSLSDAQKAIAERLMSSGGEIVWVNEESDINQVIALAGSSPAYFFLLMESMIDAGKQMGMDEAKARSLVQQAALGAAMMAKQNPELTLGNLRENVTSKGGTTAQAIATFEAADLRGVVKKAMENCINRAEEMAKTF

SEQ ID NO: 69661 - protein, 471 aa, Robiginitalea biformata HTCC2501
MATLGPATSDKEVLRRMIEAGVDVFRINFSHANYEDVGNRIRMIRELSEELGLYTAILADLQGPKLRVGVMSGEVVVAPGDEILFKTGKPFEGTAEEVYMNYENFPRDVKPGERILLDDGKLIFEILETNGKDSVKAKVIQGGPLKSKKGVNLPNTNISLPALTEKDIKDAEFAISQDVDWMALSFVRHSQDLMDLQELINKHSEHKIPIIAKIEKPEAVDNIDKIVAYCDGLMVARGDLGVEVPAQEVPLIQKRLVLRAKKARIPVIIATQMMETMITSLTPTRAEVNDVANSVMDGADAVMLSGETSVGNYPVQVIERMSSILKSVESSELIKVPHDPPHVRTKRYITKSVCYHAALMANEIKAKAISTLTNSGYTAFQISAWRPGAHILVFTSNKRILSQLNLLWGVKAFYYDRFVSTDETIEDVNKIACQKGYLEAGDMLISLAAMPIKDKGMVNTLRVTEIDSCNF

SEQ ID NO: 69662 - protein, 588 aa, Parvularcula bermudensis HTCC2503
MAAGGGTEFLVDAALYLGATAVAVPLFRKLKLGTILGYLGAGVLLGPSALNLLYNGDGVFAIAELGVVLFLFVIGLELSLSRLWSLRHTIFGLGLMQLLVTGTAIGWVIDYIDVLSTGPAYIVGFGLACSSTAFALSLLEERHELNTPHGTKAFSVLLLQDVAVIPLFAAIPFVATQGDNAADGLPIDWQAIGLAAGAIAAIVFLSHFVLDRVLRLVAISGSREAFTAAALLIVAVTALIVDAAGLSMALGAFLAGVLLAESTFRHQIESDIEPFRELLLGLFFIGVGMQLDLAVLRNAWVVVLFGAAALIVFKAAVIFVLARILKSATPTALKTAAVLSQGGEFGFVVFSLSVGEGLLTSADATMFSAIVTLSMMATPLIMMAVSKLEHNPSGAAIPVTDMEDHGSVLIVGFGRMGQLVNQVLRSSNVKTICIDNSPRRIEVASRFGNKVYFGNGTDVHLLFQAGALDVDAIVFTLNAKEKLKPVVQAVRERCPKVRILARVYDRLHEIEMMDVKADFVVREMYESSMALAGETLAGLGFSEQLIADIMAEYRERDRDRLLAQKAEGIYAKKDVLSKPFEAVEQELS

SEQ ID NO: 69663 - protein, 200 aa, Zea mays subsp. parviglumis
VAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEIN

SEQ ID NO: 69664 - protein, 355 aa, Sclerotinia sclerotiorum
MGACMSSNVEDTEQRKRSQRIDKTLEEDSKRLRRECKILLLGSGESGKSTIVKQMKIIHQNGYTVDELALYRLTIYKNLIDCAKALVGAMRQMEIEPTNPANKEYGSFLLEYIVDPDPHTPLNPRVGTAVASVWKDGSMERLLARQSEFYLMDSAPYFFEEAGRIAAHDYIPTEADVLRARTKTTGIYETRFTMGSLSIHMFDVGGQRSERKKWIHCFENVTSIIFCVALSEYDQVLLEESNQNRMMESLVLFDSVVNSRWFMRTSIILFLNKVDLFKQKLGRSPLENYFPDYSGGNDLNRAAKYLLWRFNQVNRAHLNLYPHLTQATDTSNIRLVFAAVKETILQNALKDSGIL

SEQ ID NO: 69665 - protein, 114 aa, Triticum aestivum
IEVTGAAGTLYAGETYQLQVDFPEHYPMEAPQVIFLNPAPMHPHIYSNGHICLDILYDSWSPAMTVSSVCISILSMLSSSPAKQRPADNDRYVRNCRNGRSPKETRWWFHDDTV

SEQ ID NO: 69666 - protein, 177 aa, Candidatus Kuenenia stuttgartiensis
MEGNMGIQVGQCAPCFTLQGVVGEKFEDFSLDNYKGKWVVLFFYPLDFTFICPTEITEFSKKDGDFKSLNAQVFGVSIDSVFSHKAWLKDLGKLNYPLLSDITKEVSRKYGVLIEDKGIALRGTFIIDPEGKIKYQLVHDLGVGRSVEEILRVLNALQTGELCPVEWKPGKKTLGKG

SEQ ID NO: 69667 - protein, 453 aa, Arabidopsis thaliana
METVRPMVVAPKGNKLRRKFAKVLNIHKLTGVAPEGEMKKIKFDSKTAKLSESFYKLEEEYERSQGLEALLAKLFATVSSIKAAYAQLQHSQSPYDSIGIQKADNLVVAELKTLSELKQCFMKKQVDPNPERTLVLAEIQELRSLLKTYEIMGKKLESQYKLKDSEIIFLREKLDESMKQNKLTEKRLNQSGQLCNPLDNLHLSALNPTHFVTYLHHTVKSTRGFVKLMIEQMKLAGWDISSAANSIHPGVFYYKQDHKCFTFEHFVSNVMFEAFHLPYFSTSSESRSYKKKKQSNADREMFFERFKELRSMKAKDYLTARPKSRFARFCRAKYLQLIHPKMEQAFFGHLHLRNQVSAGEFPETSLFSGFLEMAKRIWLLHCLALSFEREAEIFRVPKGCRFSEVYMKSVAEEAFFPAAESSPESEPRVAFTVVPGFRIGKTSIQCEVYLSLS

SEQ ID NO: 69668 - protein, 209 aa, Aspergillus nidulans FGSC A4
MANYLASIFGTEQDKVNCSFYYKIGACRHGDRCSRKHVKPSYSQTILMPNMYQNPAYDPKSKMNPSQLQNHFDAFYEDVWCEMCKYGELEELVVCDNNNDHLIGNVYARFKYEEDAQAACDALNSRWYAARPIYCELSPVTDFREACCRLNSGEGCVRGGFCNFIHRKDPSSELDRELRLSTKKWLKERGRDARSVSRSPSPEPTRRRY

SEQ ID NO: 69669 - protein, 482 aa, Anabaena variabilis ATCC 29413
MVTTAEKTNIGYITQIIGPVVDVKFPSGKLPQIYNALTIKGTNEAGQELNLTVEVQQLLGDNQIRAVAMSSTDGLVRGLEVVDTGAPISVPVGKATLGRIFNVLGEPVDNRGPVNNQETLPIHRPAPKLTELETKPSVFETGIKVVDLLTPYRRGGKIGLFGGAGVGKTVIMMELINNIATQHGGVSVFAGVGERTREGNDLYNEMIESGVINKDNLNESKIALVYGQMNEPPGARMRVGLSGLTMAEYFRDVNKQDVLLFIDNIFRFVQAGSEVSALLGRMPSAVGYQPTLGTDVGQLQERITSTTEGSITSIQAVYVPADDLTDPAPATTFAHLDGTTVLSRGLAAKGIYPAVDPLGSTSTMLQPNIVGDEHYNTARAVQSTLQRYKELQDIIAILGLDELSEEDRLIVARARKVERFLSQPFFVAEVFTGSPGKYVKLEDTIKGFQKILSGELDDLPEQAFYLVGDINEAIAKAEKLKG

SEQ ID NO: 69670 - protein, 606 aa, Nostoc sp. PCC 7120
MALIVQKFGGSSVGSVERIQAVAQRVYKTVKAGNSLVVVVSAMGKTTDGLVKLANEISRNPNRREMDMLLSTGEQVTIALLSMALQELGQPAISMTGAQVGIVTEAEHTRARILHIETERVEGHIKEGKVVVVAGFQGISSNGSLEITTLGRGGSDTSAVALAAALQADFCEIYTDVPGILTTDPRIVPEAQLMGEITCNEMLELASLGAKVLHPRAVEIARNYGMPLVVKSSWTDDPGTWVTTPKPQGRSLINLELARPVDDVELDTDQAKVALLRVPDKPGVAAKLFGEISRQKVDVDLIIQSIHEGNSNDIAFTVTTPILKRAEAVAAAIAPSLRSPSHPKSDEAEVMVEQNIAKVSIAGAGMIGRPGVAAQMFATLAEAGVNIQMISTSEVKVSCVIDAQDGDRAIIALRKAFEIETPLHSQLPTPSSLSTHNSPPVRGVALDLNQARLAIRQVPDRPGMAAQLFGILSQHNISVDMIIQSQRCRIVDGVPRRDIAFTVPRMDGETAQKLLCQVAPELGWGDVVLDSAIAKVSIVGAGMVGQPGVAAKMFEALAKHQINIQMIATSEIKISCVVSQEQGVQALQVIHTAFELAGTEKFVVPA

SEQ ID NO: 69671 - protein, 490 aa, Sulfolobus tokodaii str. 7
MLLEEVQKNYGKLKLYIDGQRVESKTEIWGNVYNPAKDEIIAQVPFSTKDETKEAIQSAQEAFEKWRELPITDRLQYLFRIKFKLEEYYETLSRIITQNHGKTIQEARGELRRTIESVESAISVAYTLAKGEHMDQVSQDIDEVSIREPLGVFGIITPFNFPAMVPFWFIPYAIVLGNTVVVKPSEITPVTMDYVIKIFEEVKLPKGVINIVHGAKDVVDEFLENKFIKGVTFVGSTKVGRYVYEKAGLNGKRAIVQAGAKNFIVVMPDADLNKVIPSILSAFFGNAGQRCLAAANLVIVGDVYDEVKRKFVEAARGLKLGYGLDESVDMGPVVTRDAKKRILGYIEKGVEEGAKLILDGRNFRVEDYPNGYFVGPTIFDEVTPEMVIAKEEIFGPVASIIRAKSLDEAIDMINKSNYGNAASIFTTSGYYARKFRREVSAGNIGINVGVAQPMAFFPFGGKKDSFFGVLHGQIDSIDFFTDRKVVIERW

SEQ ID NO: 69672 - protein, 590 aa, Oryza sativa Indica Group
MGSYAYKYCMCFTRKFRSPAADPPPDVRAAFLAAGGGDGGLRRFLAQAQGEAPAEVDRILALLSGGGGGGGGGGIAARLVGPRPGPAPSLDDFFGFLFNADLNPPIATQVHQDMSAPFSHYYIYTGHNSYLTGNQLNSDSSDIPIIKALQRGVRVIELDMWPNSAKNNIDILHGGTLTAPVQIIKCLKSIKEYAFCASPYPLVITLEDHLTPDLQAKVAEMLVKTFGNLLYIPSSDPINEFPSPESLMKKIIISTKPPQEYKKFLKSKDNQNINGGLANLAEEGSLRRIDSNAEESDGKDELDDQDEDSSDEDDPKFQQETACEYRELITIHAGKPKGHLKDALKVDPDKVRRLSLSETQLAKATASHGADVIRFTQKNILRVYPKGTRINSSNYDPMNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVGIAGVRADCVMKKTRTIEDQWVPMWDEEFTFPLTVPELAVLRIEVHEYDMSEKHDFGGQTCLPVSELKQGIRAVPLHDRRGTRYKSVRLLMRFDFL

SEQ ID NO: 69673 - protein, 476 aa, Zea mays
  misc_feature (51)..(51): Xaa can be any naturally occurring amino acid
GALLRWDGDAGPRARPAIQFIAMPPPLSLRVAVIGAGAAGLAAARELRREXGHVPVVFERAHAVGGTWLYDHDDRHRSSSLYASLRTNLPREVMGFLDFPFAAVPDSADARRFPRHQEVLRYIQAFARRFHLDGLIRLRTEVLAVSKDNDEGSSGGWRVRWRRNAAGDESEQEQEEVFDAVVVCNGHYTEPRTAAADIPGLDAWPPGKQMHSHSYRVPAPFADQVVVIIGASNSGADISREIAGVAREVHMADRSAPTATCHTLPGYRNLWLRSMVERADQDGTTVVFRDGSSVRADVVMHCTGYTYSFPFLPTTAAPAGDGAVVSVDDNRVHPLYKHVFVPQLAPRLAFVGLPFKVIPFPMFQIQASWVAGALSGRIQLPSEEMMEDVSALYSELETVGWPVRYTHCMKHSQFEYDEWLAEQCGGGHAGRVEEWRKDMFDAAKRKKVQCPETYRDEWDDHHLLERAYQDFNNYSS

SEQ ID NO: 69674 - protein, 266 aa, Ralstonia metallidurans CH34
MAGASGPARRSSRLRGPDRRKIPPIPPSARPNIMSSPTFRIAPSILSADFARLGEEVRRVTEAGADWIHFDVMDNHYVPNLTVGPLVCEAIRPHVTAPIDVHLMVRPVDRIIPDFARAGANIITFHPEASDHIDRSLALIRDNGCQAGLVFNPATPLHYLDHVMDRLDVILLMSVNPGFGGQSFIPETLNKLRAVRQRIDAYTARTGRRILLEVDGGVKVDNIAEIAAAGADTFVAGSAVFGKPDADGGYKGVIGALRAELATVGK

SEQ ID NO: 69675 - protein, 557 aa, Mycobacterium sp. MCS
MAEFIYTMRKVRKAHGDKVILDDVNLNFLPGAKIGVVGPNGAGKSSVLRIMAGLDTPNNGDAYLAPGASVGILQQEPHLDETKTVRENVEEGVPIKGKLNRYNEVAELMATDYSDELMEEMGRLQEELDAADAWDIDSQLEQAMDALRCPPPDEPVTHLSGGERRRVALCKLLLSKPDLLLLDEPTNHLDAESVLWLEQHLASYKGAILAVTHDRYFLDNVAEWILELDRGRAYPYEGNYSTYLEKKAERLEVQGKKDQKLQKRLKEELAWVRSGAKARQAKNKARLGRYEEMAAEAEKSRKLDFEEIQIPTPPRLGNVVVEVEHLDKGFEGRTLIKDLSFTLPRNGIVGVIGPNGVGKTTLFKTIVGLEQPDSGVVRVGDTVKLSYVDQNRAGIDPKKNVWEVVSDGLDYIEVGQNEIPSRAYVSAFGFKGPDQQKPAGVLSGGERNRLNLALTLKEGGNLILLDEPTNDLDVETLSSLEHALEQFPGCAVVISHDRWFLDRTCTHILAWEGDDDNEAKWFWFEGNFGAYEENKVQRLGAEAARPHRVTHRRLTRD

SEQ ID NO: 69676 - protein, 325 aa, Glycine max
MAVEKLSIAKDVTELIGKTPLVYLNRIVDGCVAKVAAKLEMMEPCSSVKDRIGYSMIVDAEEKGFITPGESVLIEPTSGNTGIGLAFMAAAKGYKLIITMPSSMSLERRTILRAFGAELVLTDPAKGMKGAVQKAEEIRDKTPNSYILQQFENPANPKIHYETTGPEIWKGSSGKVDALVSGIGTGGTITGAGKYLKDQNPDIKLYGIEPVESPILSGGKPGPHKIQGIGAGFIPGVLDVDLLDEVVQISSEEAIETAKLLALKEGLLVGISSGAAAAAAIKIAKRPENAGKLIIAVFPSFGERYLSSVLFESVKREAESMVFEP

SEQ ID NO: 69677 - protein, 247 aa, Triticum aestivum
MSSSSKLFQSACKAARSFLASSSAPAAAPRAASSVLADGRNAALATLANLGRNSTLPAAYAHHLHTNAASSQGYAWIAAIPAAVYMLQDQEVHAAEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 69678 - protein, 197 aa, Arabidopsis thaliana
  misc_feature (29)..(29): Xaa can be any naturally occurring amino acid
  misc_feature (57)..(57): Xaa can be any naturally occurring amino acid
  misc_feature (191)..(191): Xaa can be any naturally occurring amino acid
MAKDGPNWDGLLKWSLSHSDGTRPTCQLXSEEDRKWFAEAMQSQTVDVVKRLKEITXGLLDELQEHVESIDMANDLHSVGGLVPLLGYLKNSNANIRAKSADVVSTIVENNPRSQESVMEANGLESLLLRFTSDTDMHSRTQALGAISSLIRNNKPGITGFRIANGYSGLKDALETDSVRFQRKALNLVHXLLQEND

SEQ ID NO: 69679 - protein, 469 aa, Oryza sativa Japonica Group
MPPTMLASVPTRPRSHPFRRRRGAAAAAPPLLPDQIAAAAAAAAKRPAESSTSASSCFHSEVISATSTTCPTSLAAAQRPEKRPRYQDVDEEQPAASECSEIIGGARPRAAEVEVSESSCLASVLESYLACPEQLANDAETTAYSSAREDLTLSETEEEEEEEEVRSGPCICTDCSFSPLHESSSSSDDDNAVPSPTFSLFLALAEQFVPFTHPKTPTATDVALQAGEGKRFEDLDNEVSYERFRRRERRGVVARDYIEVYSSMLGSYGRAVVEQRVVMVNWIMEHSQAMKLQPETVFMGIGLMDRFLTRGYVKGSRNLQLLGIACTTLATRIEENQPYNCILQKAFKVGINTYSRSEVVAMEWLVQEVLDFQCFVTTTHHFLWFYLKAANADDRVEDLAKYLALLSLLDHKHLSFWPSTVAAAVVALACLATNNESSCHLVMETHMRTKNDDLPECLMSLEWLTNYAS

SEQ ID NO: 69680 - protein, 619 aa, Oryza sativa Japonica Group
MEAAALSTVLYVLALVVADADHHVVRVQGRRHQCQPFSCGHLQNVSYPFRRRGDPRSRRCGFRSYELDCSSDDGKATIRINTGKYYVSSINYTASIFWVVDANLQDDANSSCPLPRSDQLPYVGLGIPGSHDSWDLGLDDMITWVGFVNCSQELITNSSSKYLYVYHPVDCLTTALSFVYYMLPFFGSLVPSVEDIEPSCGYLAMTPIGGGWNSVNLPEYTSYAEVVKSMRGGFAVKFPTPWLNWFGLIKKCLNKSVSIHYQAGHTTYCIAKFISLFVCSAMQVCVRTVGRDDFSYSQGQGGYGSVYKGVFLPGDVHVAIKMLDGNSNCNGEDFISEVATIGRIHHINVVRLVGFCSEEMRRALVYEYMPRGSLNKYIFSSERSFSWDKLNEIALGIARGINYLHQGCEMQILHFDIKPDNILLDDNFVSKVADFGLAKLYPREKSFVSDRALRGTVGYMAPEMVSRSFGVISDKSDVYSFGMLLLEMAGGRRNADPNANSNASRAYYPAWVYDQLIADQQVDEISNVADMHELERKLCLVGLWCIQMKSHDRPTMSEAIEMLEGDVDALQVPLRPFFCDGDGIGNGMPPPQVMDSYFHSSELTAISEEDDGIAELASS

SEQ ID NO: 69681 - protein, 304 aa, Shewanella oneidensis MR-1
MPETALLEEVVDRVRPLLGQGKVANYIPALANIDPGKLGIAVTTIDGETIGAGDYLEPFSIQSISKVFSLTLALTLYEETEIWSRVGKEPSGHSFNSLVQVELERGKPRNPFINAGALVIADLLQSRLGAPKHRMLELVRALSQNDKVCFDKQVADSEYQHSARNAAIAYLMKSFGNFQGDVDTVLRTYFHYCALKMNCADLSKAMLYLANRGKTLDGTELISQVQTRQLNALLATSGLYDGAGEFAYRVGMPGKSGVGGGIIAVIPGELSVCVWSPELDTQGNSLAGTAMLEQLSQRLGRSIF

SEQ ID NO: 69682 - protein, 270 aa, Triticum aestivum
MAAADDIGASAGRWSLHGRRALVTGGTRGIGRAVVEELAALGAAVHTCSRKEAELGERLKEWEAKGFRVTGSVCDVSVRDQRELLLQDVAGRFAGKLDILINNVGTNHRKPTTEYSADEYSFIMATNLESAYHLCQLAHPLLKASGVASIVFISSVSGVVAISSGSIYGMTKGAMNQLAKNLACEWAKDNIRINSVAPWYIKTSLVEEDLAKEDFVDSIARRTPMRRVGEPEEVSSLVAFLCMPGSSYITGQTISVDGGMTINGMYPTEN

SEQ ID NO: 69683 - protein, 450 aa, Ralstonia eutropha JMP134
MAIGAHTLRTRYQSLQMQLLAIGINHTTAPVSLRERVAFPLEQIKPALGALRTHLAGRNGTEAAILSTCNRTEIYCATDILKPGAEGFEHTLRWLSQHHNVPASDLAPHLYSLPQSEAVRHAFRVASGLDSMVLGETQILGQLKDAVRTAGEAGSLGTYLNQLFQRTFAVAKEVRGQTEIGAHSVSMAAAAVRLAQRIFESVSTQRVLFIGAGEMIELCATHFAAQKPRQVVVANRTVERGEKLAEQLAEQGLTTQAIRLQELGERLHEFDIVVSCTASSLPIIGLGAVERAVKRRKHRPIMMVDLAVPRDVEPEVARLDDVFLYTVDDLGAVVREGNALRQAAVAQAEAIIESRVQNFMHWLETRSVVPVIRELQTAGESIRQAELERARRMLARGDDPEAVLEALSGALTRKFLHGPTHALNHMQGEDREALVRLVPGLFRQSSHSER

SEQ ID NO: 69684 - protein, 359 aa, Hordeum vulgare subsp. vulgare
MIEGAGSIVDAHTVEVTQPDGSKQRHTTKHILIATGSRATLVNIPGKELAITSDEALSLEELPKRAVILGGGYIAVEFASIWKGLGAQVDLFYRKELPLRGFDDEMRTVVASNLEGRGIRLHPGTNLTELSKTADGIKVVTDKGDEFIADVVLFATGRAPNSNRLNLEAVGVEVDQIGAIKVDEYSRTSVPNIWAVGDVTNRINLTPVALMEATCFAKTVFGGQTVKPDYKDVPCAVFCIPPLSVVGLSEQEALAEAKNDLLVYTSSFNPMKNSISKRQEKSIMKLVVDAETDKVLGAAMCGPDAAEIMQGIAVALKAGATKATFDSTVGIHPSAAEEFVTMRTLTRRVSPASKPKTNL

SEQ ID NO: 69685 - protein, 254 aa, Hordeum vulgare subsp. vulgare
MRTVVASNLEGRGIRLHPGTNLTELSKTADGIKVVTDKGDEFIADVVLFATGRAPNSNRLNLEAVGVEVDQIGAIKVDEYSRTSVPNIWAVGDVTNRINLTPVALMEATCFAKTVFGGQTVKPDYKDVPCAVFCIPPLSVVGLSEQEALAEAKNDLLVYTSSFNPMKNSISKRQEKSIMKLVVDAETDKVLGAAMCGPDAAEIMQGIAVALKAGATKATFDSTVGIHPSAAEEFVTMRTLTRRVSPASKPKTNL

SEQ ID NO: 69686 - protein, 245 aa, Xylella fastidiosa Dixon
MEIATVTRVNSTQPANACAPSHIPIIIDNPMSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMARTDGQPVWREGVITDNGNVILDVHHLCITDPVKLEQELNQIPGVVCVGLFARRCADLVIIGSEPPHIL

SEQ ID NO: 69687 - protein, 189 aa, Ralstonia metallidurans CH34
MLLMIDNYDSFTYNLVQYFGELGADVRTFRNDEITIEEIEALKPDHICVSPGPCSPHEAGISVPVLQHFAGKIPLLGVCLGHQAIGEAFGGKVIRAKQVMHGKVSTIETTQEGVFAGLPKHFDVTRYHSLAIERETLPDCLAVTAWTPDGEIMGVRHKTLAVEGVQFHPESILSEHGHALLANFIKAPR

SEQ ID NO: 69688 - protein, 419 aa, Candidatus Kuenenia stuttgartiensis
MPEKMEENSPWQTALTQFNNVSKRMNLPEDIHQILKHFSRILTVSVPVRMDNGSTASFEGFRVQHCSAKGPYKGGIRYHPDLTLDDLKALAMEMTWKCSLVDIPFGGAKGGVVCDPKKLSRGELERITRRYTYAIQPIIGPDIDIPAPDVNTNEQIMAWIMDTYSMNKGFCSPGIVTGKPLNIGGSLGRADATGLGVAYIAASAVRQNKKTLKGLNVVIQGYGNVGSAAGKFLEEMGCKIVAVSSSTGGIYNPGGLSHNAIIEHYRKTGGFRYFPLAENITNAELLELPCDVLIPAAMGGQITKKNAGKIKAKLIVEGANGPTTPEADEILSGRKIKIVPDILANAGGVIVSYFEWVQDAQCYFWCKNEVNAKLKILLERSFNDVYAFAQKNKYSLRTSAMMLAIKKVADVFTVRGLYP

SEQ ID NO: 69689 - protein, 277 aa, Gluconobacter oxydans 621H
MPVIAFQGRPGAYSDLACRQARPGWTTLPCPTFADAIDAVHDGRADEALLACENTLAGRVPDIHSLLPDAGLHLVGEYFQRVEHCLLGVPGAKIEDVRRIHTHPVALGQVRKLISELGVEPVTQFDTAGAAEMVAQWGRKEDAAIASSLAAELNGLTVLRSNVEDASHNTTRFYRVARKPCIPSPERTDVLTTLLMRVGNCPGALYAALGGFSRHGINMTRIESYMLDGSFAATQFLMDVEGHPEQAPLAAALAELEQVSDDLRILGVYPSSLSRRA

SEQ ID NO: 69690 - protein, 384 aa, Mycobacterium sp. MCS
MTVQEFLVPDLGEGLQDATITSWAVDVGDEVELNQTLCTVETNKAEVEIPSPYAGRVVERGGDEGQTLDVGSLLVRIATSADEPVPQRKSVLVGYGADEAMDTSRRRSARPRAKPPVRKLAAELDVDLNAVSASGPDGVVTREDVQRAAEGWAPAAEQVAVRGVQAEMARRMSLSRREIPDAHASVTVDGSALLRLRDRLLGTDPPVTPFVLTLRLLTLALRHQPALNATWIETAEGPQIHRHTAVHLGFGVAAPRGLLVPVIADAQDMTTRGLAAAVGRLVAEARAGRVRPAELSGSTFTVSNFGALGLDEGVPVINHPEAAILGMGSLKPRAVVVDGEVVARPTMTLTCAFDHRIADGATVAAFLGELRELVEAPELALLDL

SEQ ID NO: 69691 - protein, 424 aa, Atriplex prostrata
YLRAIAAKITERKDHFVKLETLDSGKPFDEALLDIDDVAGCFEYYADQAEALDAKQKAPIALPMDTFKSHVLRQPIGVVGLISPWNYPLLMATWKVAPALAAGCAAILKPSEMASVTCLELADVCKEVGLPPGVLNILSGYGPEAGGPLASHPDVDKVAFTGSTATGSKIMSSAAQLVKPVTLELGGKSPIILFEDVDLDQAAEWAAFGCFWTNGQICSATSRLLVHESIAAEYLDKLVKWCKNIKISDPFEDGCRLGPVVSKGQYEKVLKFISTAKSEGATILCGGSRPEHLKKGYFIEPTIISDVSTSMQIWKEEVFGPVLCVKTFSSDEEAIELANDTQYGLGAAVLSKNLERCEKVTKALEVGIVWVNCSQPCFCQAPWGGAKRSGFGRELGEWGIENYLNIKQVTSDISDEPWGWYKSP

SEQ ID NO: 69692 - protein, 516 aa, Mycobacterium sp. MCS
MAPRASHRDAHTALVEELRTKLAGAALGGPAKSRERHVSRGKLLPRDRVDGLLDAGSPFLEIAPLAADGMYDDECPGAGMIAGIGRISGRECMIVANDATVKGGTYYPVTVKKHLRAQEIAGQNRLPCVYLVDSGGAFLPRQDEVFPDRDHFGRIFYNQATLSAQGIAQIAAVLGSCTAGGAYVPAMSDEAVIVRNQGTIFLGGPPLVKAATGEVVSAEDLGGGDLHSKTSGVTDHLAHDDRDALRIVRRIVGTLGRPQPPPWDVAPAVDAVADQSELYDVVPVDSRVPYDVHEVITRIVDGGEFAEFKAEYGTTLVTGFARIHGHPVGIVANNGVLFGESAQKGAHFIELCDKRVIPLLFLQNIAGFMVGRDYEASGIAKHGAKMVTAVACARVPKLTVVIGGSYGAGNYSMCGRAYSPRFLWMWPNARISVMGGEQAASVLATVRGEMTPEQEQEFKAPIREQYERQGNPYYSTARLWDDGVIDPADTRTVVGLALSIVGQAPLEPVSYGVFRM

SEQ ID NO: 69693 - protein, 500 aa, Atriplex prostrata
MAFPIPVRQLFIDGEWREPLLKNRIPIINPSTEEIIGDIPAATAEDVEVAVVAARKAFKRNKGRDWAATSGAHRAKYLRAIAAKITERKDHFVKLETLDSGKPFDEAVLDIDDVASCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDIDKIAFTGSSATGSKIMASAAQLVKPVTLELGGKSPVIMFEDIDIETAVEWTLFGVFWTNGQICSATSRLLLHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 69694 - protein, 720 aa, Phytophthora cinnamomi
MSQVLQHPRVFTFVKGESKGNGSMKPLLGGKGANLCQMARNGVNVPPGLTITTEVCQEFYAVGGRLPDGLMDEVRKGVHLMEKTLGVTFADATNPLLVSVRSGAAISMPGMMDTVLNLGLNDEIVKGVAKRGGERFAFDCYRRLLQMFGDVVLEIPHDDFEAELSAMKQARHVTFDVELTASDLKELVHKYKKVYEKHGRSFPSDPWEQMRMGIEAVFRSWNIPRAVKYREINKITGLKGTAVNVQAMVYGNINDQSCTGVLFTRNPANGENKLYGEFLLNAQGEDVVAGIRTPQPISELAQKMPTVYKQLDETVHTLETHFKDVQDTEFTVQDGVLFMLQTRNGKRTGPAALKIAVDMWREKLITEEEAVMLVEPRHLDQLLHPSFANEKGYQKDVLCRGLPASPGAAVGKIVFTAADAEAWFARGENVMLVREETSPEDVGGMHAAEGILTSRGGMTSHAAVVARGWGKPCVCGCSALSIDANSKTMRVHTASGAEVVLREGDYISVNGTTGEVIKGEQELQKAAMSGDLAQFMKWVDAHRRMEVFTNADTPEDAREARAHGAQGIGLTRTEHMFFSSAQRIAAVRRMIGAVELDSPAQQEALDALCTFQQGDFEGIFRAMDGLPVTIRMLDPPLHEFLPHEGSALEELCETLAKEMKVSKATVQSRLAGLKEANPMMGLRGCRLGIVHPGITEMQAKAIAEAAVKVAGEGISVHPHI

SEQ ID NO: 69695 - protein, 900 aa, Phytophthora cinnamomi
MSQVLQHPRVFTFVKGESKGNGSMKPLLGGKGANLCQMARNGVNVPPGLTITTEVCQEFYAVGGRLPDGLMDEVRKGVHLMEKTLGVTFADATNPLLVSVRSGAAISMPGMMDTVLNLGLNDEIVKGVAKRGGERFAFDCYRRLLQMFGDVVLEIPHDDFEAELSAMKQARHVTFDVELTASDLKELVHKYKKVYEKHGRSFPSDPWEQMRMGIEAVFRSWNIPRAVKYREINKITGLKGTAVNVQAMVYGNINDQSCTGVLFTRNPANGENKLYGEFLLNAQGEDVVAGIRTPQPISELAQKMPTVYKQLDETVHTLETHFKDVQDTEFTVQDGVLFMLQTRNGKRTGPAALKIAVDMWREKLITEEEAVMLVEPRHLDQLLHPSFANEKGYQKDVLCRGLPASPGAAVGKIVFTAADAEAWFARGENVMLVREETSPEDVGGMHAAEGILTSRGGMTSHAAVVARGWGKPCVCGCSALSIDANSKTMRVHTASGAEVVLREGDYISVNGTTGEVIKGEQELQKAAMSGDLAQFMKWVDAHRRMEVFTNADTPEDAREARAHGAQGIGLTRTEHMFFSSAQRIAAVRRMIGAVELDSPAQQEALDALCTFQQGDFEGIFRAMDGLPVTIRMLDPPLHEFLPHEGSALEELCETLAKEMKVSKATVQSRLAGLKEANPMMGLRGCRLGIVHPGITEMQAKAIAEAAVKVAGEGISVHPHIMIPLVGSFEELEQQVKLVKSVVQDVIGKRGKSFDYKVGTMIEVPRGALQAGKLAEVAEFFSFGTNDLTQMTFGISRDDAQAKFLSYYVKHGVLEKDPFETLDQEGVGELVRLAVERGRATRPKIELGICGEHGGDPQSIEFFEKVGLKYVSCSPMRVMIARLAAAQAALKLKKSSPVPGA

SEQ ID NO: 69696 - protein, 503 aa, Yersinia pestis KIM
MFVPQPSNKPLSLMLAGLSVKKTAADSFMKCVVYSHQCVISATEGRMEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 69697 - protein, 450 aa, Burkholderia mallei ATCC 23344
MEPTFTETGARASEPHATTLAGRAASSGDKLQRLKSIFSASAGNLIEWYDWYVYSAFALYFAHSFFPAGNQTAQLLNTAAVFAVGFLARPVGGWLMGIYADRYGRRPALLVSVVLMCVGSLIIALCPGYDVIGTAAPVLLVVARLLQGLSVGGEYGTSATYLSEVATARDRGFYSSFQYVTLVAGQLVALALLIVLQQFVLTTQQLESWGWRIPFFIGAACALAAMRLRSSMEETGEFKRTLNARDKRGTLAELSKHPRAVLTVVGLTMGGTIAFYTYSIYMQKFLVNTVGMSKHDATLVSAASLALFAILQPIVGSISDRIGRRPVLIAFGVLGTLFTVPIMTAISRTHDVWTAFFLNMAALVIVSGYTSINAVVKAELFPAKIRALGVGFPYALTVSIFGGTAEYLALWLKQAGHESLFYWYVTAAIFCSLLVYVCMRDTGKHSLIKD

SEQ ID NO: 69698 - protein, 330 aa, Physcomitrella patens subsp. patens
MATALEKGWLVRPLSLSLFLALAWSIFLLWVLDLECSGVFTKDGVPLCQVWIALASFSVHIPPSIYLINNFTDFQLASIGSFIIHESVFFLSGLPFIVMERLGYQRQYKIQGKVNSVAAQEKCVMKLLIYHICVNLPLMIVSYPVFKYMGFTSQLPLPSWNVVCFQILSYFILEDFIFYWGHRILHTKWLYKHVHSVHHEYATPFGLTSEYAHPAEILFLGFATVFGPAITGPHLLTLWIWMSLRVIETVEAHCGYDFPWSLSRYLPIYGGADFHDYHHRLLYTKSGNYSSTFTYMDWIFGTDKGYRKLKALKAAEHQYEYVEEKVPKAD

SEQ ID NO: 69699 - protein, 200 aa, Zea mays subsp. parviglumis
VAKINPQAPLDKVCVLSCGISTGLGASINVAKPPKGSTVAIFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEIN

SEQ ID NO: 69700 - protein, 296 aa, Parvularcula bermudensis HTCC2503
MSDTLSDYLITRANLVTKSLENRLVINRTESPALGRLRAAMAHGALGGGKRLRPFLVLEAASIFGADDEAALPAATAIEMVHCYSLIHDDLPAMDDADTRRGRPSVHKAYDEAIAILAGDGLLTDAFALLTEEGTYTAPTACRLVRELALAAGSGGMVGGQMMDLYPDGGDEAAIVGIQRRKTGALIEAAAVMGAIVGAAAPSDEAALRQYAAAVGEAFQVVDDILDETASSAELGKPAGVDGAAGKATFVSLLGLAGARDRVSALTAAALAALAGLGPRADRLRAVAGQLASRST

SEQ ID NO: 69701 - protein, 260 aa, Triticum aestivum
MANLFLKQAKHYAAARPDYPAELFQFIASKTARHDLAWDVGTGSGQAAVSLAKLYKKVVGTDTSAQQLAYARALPNVRYAHTPADLPLEGIHAAVAPPGTVDVVTVAQAFHWLDLPRFYAQTRSLLRAHGVLAAWCYTEPRVGAAVDAVFWRLYDGSQPHWAPNRKMVDDEYRSAYFPFDPVDGETHTGPFEFSTERRMDLDVYFTYIKSWSAYQTAKDNGVELLDDETVREFADAWGGDRQEVKTVTYPIFLRIGKVRP

SEQ ID NO: 69702 - protein, 367 aa, Haloarcula marismortui ATCC 43049
MDPVELRASIPALERCTYFNTGASGPTPRPVVDAATAFLERHAFDAPADEGPYTVAWDAIAAAREVVASHIGTDAANVALTRSTADGVNMVAGAIDWQPGDVVVRTDLEHPAGTLPWDRLADTHDIEVRVLETDGGRLDMAEVKDAVADARLVALSSLSWTHGTRLPVADVVAVAHDAGAQVLVDAVQSVGQHPVDVTEWGADFVAAAGHKWLLGVWGGGFLYVDPDAYDRLRQTRIGYRSVENPGADGYKYHEGARRFEVGTTSPVPYVALANAIETVEAIGFDTIQPRVERLTDRLKDGLGDRLLSPRDYESGLVTFTADDPEATVERLAAEGIIIRSLPNPDALRASVHAFNTADDVDRLLDAL

SEQ ID NO: 69703 - protein, 337 aa, Anabaena variabilis ATCC 29413
MIRVAINGFGRIGRNFARCWLGRENSNIELVAVNDTSDPRTNAHLLKYDSMLGKLKNVDITADDNSITVNGKTIKCVSDRNPENLPWKEWEIDLIIESTGVFTSKEGALKHVNAGAKKVLITAPGKNEDGTFVIGVNHHDYDHNVHHIISNASCTTNCLAPIAKVLNDKFGIIKGSMTTTHSYTGDQRLLDASHRDLRRARAAAINIVPTSTGAAKAVALVIPELKGKLNGVALRVPTPNVSMVDFVVQVEKRTITEEVNQALKDASEGPLKGILDYSELQLVSSDYQGTDASSIVDASLTLVMGNDLVKVMAWYDNEWGYSQRVLDLAELVAEKWV

SEQ ID NO: 69704 - protein, 773 aa, Oryza sativa Japonica Group
MAGLEELKKKLQPLLFDDPDKGGVSSRVPLPEDTCDSYVEQKYRCYIRTLKGCHISGRNRLDSYGQLVPGGLALLARTGTEGRVREVKVSDGGTVNLLSRSLGEYNINEHGFHKRSTGPEESDSGEKAYRCASHDMHIFGPIGNGASSVVQRAVFIPVHRILALKKINIFEKEKRQQILNEMRTLCEACCYIGLVEFQGAFYMPDSGQISIALEYMDGGSLANVIKIKKSIPEPVLAHMLQKGLRYLHEVRHLVHRDIKPANLLVNLKGEAKITDFGVSAGLDNTMAMCATFVGTVTYMSPERIRNENYSYAADIWSLGLAILECATGKFPYNVNEGPANLMLQILDDPSPTPPKDSYSSEFCSFINDCLQKDADARPSCEQLLSHPFIKRYENTTVDLVAYVKSIVDPTERLKQIAEVQIFVQPTINVMGSRKRSNWIGMGGRRTWMLAVHYYLLFNGTDGIWHYMKTFYMEESTFSFSGNVYVGQSDIFDTLSNIRKKLKGDCPREKIVHVVEKLHCRAHGETGIAIRVSGSFIVGNQFLICGEGLQAEGMPSLEELSIDIPSKRLNPIYAVMVPRWDSDGSGLLKVADEDYTIHFRAICLSGLGGGGKSILFYQKSKIKPVHVVDVPGHAGLKPKLDEVLPQAAGIVFAVDAQDFLSTMQVVAEYLYDILTKATVVKKRIHVLIFCNKTDKVTAHSKEFIKKQLEKEINKLRESRKDISSADTTDEVKLGNPGETFYFSQCQNRVTVAEGAGLTGNVSAVEQFIREYVKA

SEQ ID NO: 69705 - protein, 467 aa, Glycine max
MQKMPGTKQRDTSQNPDSPEGNSEPEKPTDSDERVDFDGDNDQEETMEEEVEYEEVEEEEEEEEEEEEEEEEEETKLSDKTRVADTKDEVEKKKHAELLALPPHGSEVYIGGIPQNVSEEDLRVFCQSVGEVSEVRIMKGKESGEAKGYAFVTFMTKELASKAIEELNNSEFKGKRIKCSTSQVKHKLFIGNVPKYWTEGDMKKVVAEIGPGVICVELLKDPQNSSRNRGYAFIEYYNHACAEYSRQKMSNSNFKLGSNAPTVSWADPRNSESSAISLVKSVYVKNLPENITQDRLKELFEHHGKITKVVLPSAKSGQEKSRFGFVHFAERSSAMKALKNTEKYEIDGQLLECSLAKPQANSQKPALLPTYPPHLGYGMVGGAIGAGYGAAGFAQPLMYGPGPTPGGMAMMPMMLSDGRIAYIVQQPGFQQPAPVSRHGRSGGSSSSGGKCSNDDNRNRGHGRYHPY

SEQ ID NO: 69706 - protein, 673 aa, Vitis vinifera
  misc_feature (51)..(52): Xaa can be any naturally occurring amino acid
  misc_feature (79)..(79): Xaa can be any naturally occurring amino acid
  misc_feature (397)..(397): Xaa can be any naturally occurring amino acid
MNSSSYIGITTMKPYCRVLTSCRNSSIFKFPSSKSNHFIADNSSKFQSKLXXSRRFHCCSAQILGKKCGINSNRRAFRXSDPNWGQIRVYRSCSGAHGGRRGVLVISNVASDFRKHSTSVESHVNEKGFESIYINGGLNVKPLVIERIERGHVEEESGLEFKDPDVNFDHSEGLNKEKVEREVPEIEKEAWRLLRSAVVDYCGNPVGTVAANDPGDKQPLNYDQVFIRDFVPSALAFLLKGEGEIVKNFLLHTLQLQSWEKTVDCYSPGQGLMPASFKVRTVPLDGGNGAFEEVLDPDFGESAIGRVAPVDSGLWWIILLRAYGKITGDYALQERVDVQTGIRLILNLCLTDGFDMFPSLLVTDGSCMIDRRMGIHGHPLEIQALFYSALRCSREMXTVNDGTKNLVRAINNRLSALSFHIREYYWVDMKKINEIYRYKTEEYSTDAINKFNIYPDQIPTWLVDWIPDQGGYLIGNLQPAHMDFRFFTLGNLWSIISSLGTAKQNEGILNLIEAKWDDLVAHMPLKICYPALENEEWRIITGSDPKNTPWSYHNGGSWPTLLWQFTLACIKMGRPELARKAVALAEERLSVDHWPEYYDTRNGRFIGKQSRLYQTWTIAGFLTSKMLLENPEMASLLAWEEDYELLEICVCALSKTGRKKCSRSAARSQIPVQ

SEQ ID NO: 69707 - protein, 363 aa, Ralstonia metallidurans CH34
MSLKCGIVGLPNVGKSTLFNALTKAGIAAENYPFCTIEPNVGVVEVPDPRLAKLAEIVKPERILPATVEFVDIAGLVAGASKGEGLGNQFLANIRETDAITHVVRCFEDDNVIHVAGKVDPLSDIEVINTELALADLATVEKALARYIKPARAGDKEALRLVAVLEKAQAVLDQAKAVRTLDLAPEEWEALRPFCLITAKPTMYVANVREDGFENNPHLDAVREYAKTTGSPVVAVCAAIEAEIADLDDADKAEFLADLGMEEPGLDRVIRAGFKLLGLQTYFTAGVKEVRAWTIHVGDTAPKAAGVIHTDFERGFIRAQTIAYDDFIAFKGEHGAKEAGKMRAEGKEYVVHDGDVMNFLFNV

SEQ ID NO: 69708 - protein, 176 aa, Triticum aestivum
  misc_feature (22)..(22): Xaa can be any naturally occurring amino acid
MAPTVMALWATSVAPFQGVKSXTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 69709 - protein, 746 aa, Coccidioides immitis RS
MAATAVNPLLKGTTSSNTRGLLRVIILAFIAAAAISSRLFSVIRFESIIHEFDPWFNFRATKYLVKHGFYSFWDWFDDRTWHPLGRVTGGTLYPGLMVTSGAIYHLLRFLSLPVDIRNICVLLAPAFSGLTALAMYLLTSEMSVSPSAGLLAAAFIGIAPGYISRSVAGSYDNEAIAIFLLIFTFFLWIKALKNGSIMWGALTALFYGYMVSAWGGYVFITNLIPLHAFVLICMGRYSSRLYISYTTWYALGTLASMQIPFVGFLPIRNSDHMAALGIFGLLQLVSFVEFLRSQVPGKQFQTVLTTLVLVIFGVAFLGLVLLTVTGVIAPWSGRFYSLWDTGYAKVHIPIIASVSEHQPTAWPAFFFDLSMLIWLFPAGVYMCFNKLKDEHVFVIIYAVLASYFAGVMVRLMLTLTPVVCVASALVVSHILETYLRLSSPDPDAQGKQANEKVSQSSPRSTRKRVVGVYSTVSKALVAGSFVVYLLLFVAHCTWVTSMAYSSPSVVLASKLPDGSQYIIDDYREAYYWLRQNTPKNAKIMSWWDYGYQIGGMADRPTLVDNNTWNNTHIATVGKALSSREEVSYPILRQHDVDYVLVVYGGLIGYSGDDINKFLWMVRIAEGLWPEEVKERDFFTDRGEYRVDDQATPTMRNSLMYKLCYYNVNALFPGGQGQDRVRGARLPSQGPQLTTLEEAFTSENWIIRIYKVKDLDNVGRDHNSAVAFEKGHKKKKAASLKRRGRRVLRTE

SEQ ID NO: 69710 - protein, 900 aa, Phytophthora cinnamomi
MSQVLQHPRVFTFVKGESKGNGSMKPLLGGKGANLCQMARNGVNVPPGLTITTEVCQEFYAVGGRLPDGLMDEVRKGVHLMEKTLGVTFADATNPLLVSVRSGAAISMPGMMDTVLNLGLNDEIVKGVAKRGGERFAFDCYRRLLQMFGDVVLEIPHDDFEAELSAMKQARHVTFDVELTASDLKELVHKYKKVYEKHGRSFPSDPWEQMRMGIEAVFRSWNIPRAVKYREINKITGLKGTAVNVQAMVYGNINDQSCTGVLFTRNPANGENKLYGEFLLNAQGEDVVAGIRTPQPISELAQKMPTVYKQLDETVHTLETHFKDVQDTEFTVQDGVLFMLQTRNGKRTGPAALKIAVDMWREKLITEEEAVMLVEPRHLDQLLHPSFANEKGYQKDVLCRGLPASPGAAVGKIVFTAADAEAWFARGENVMLVREETSPEDVGGMHAAEGILTSRGGMTSHAAVVARGWGKPCVCGCSALSIDANSKTMRVHTASGAEVVLREGDYISVNGTTGEVIKGEQELQKAAMSGDLAQFMKWVDAHRRMEVFTNADTPEDAREARAHGAQGIGLTRTEHMFFSSAQRIAAVRRMIGAVELDSPAQQEALDALCTFQQGDFEGIFRAMDGLPVTIRMLDPPLHEFLPHEGSALEELCETLAKEMKVSKATVQSRLAGLKEANPMMGLRGCRLGIVHPGITEMQAKAIAEAAVKVAGEGISVHPHIMIPLVGSFEELEQQVKLVKSVVQDVIGKRGKSFDYKVGTMIEVPRGALQAGKLAEVAEFFSFGTNDLTQMTFGISRDDAQAKFLSYYVKHGVLEKDPFETLDQEGVGELVRLAVERGRATRPKIELGICGEHGGDPQSIEFFEKVGLKYVSCSPMRVMIARLAAAQAALKLKKSSPVSGS

SEQ ID NO: 69711 - protein, 448 aa, Corynebacterium glutamicum ATCC 13032
MSQRVIFSGMNLTRNDRLDRLPVTSKHKKILGGSGIGWALDAMDVGLISFVMAALATHWGLSPTETSLLGSIGFVGMAIGASLGGLLADKLGRRQVFALSLLVYGVATGASALSVSLAMLMALRFVVGLGLGAELPVASTLISEFSPRKVRGRMVVILEAFWALGWIMAAIVGTFVVAGSDNGWRWALALGCVPAIYAVYVRLGLPESVRFLEKKGRHDEAEAIVVSFEEAAAAEGKAADATTAVVHDNAAEGSVSIWSAALRKRTVALWIVWFCINLSYYGAFIWIPSLLVADGFTLVKSFQFTLIITLAQLPGYAVAAWLIEKWGRRSTLATFLVGSAISAALYGLANVEWQILVAGCLLSFFNLGAWGALYAIGPELYPTNVRGTGTGAAAGFGRIASIIAPLIVPPVIAFGGPIALFALFATAFAIAAIAAFTLPEQKGKSLAD

SEQ ID NO: 69712 - protein, 638 aa, Oryza sativa
  misc_feature (503)..(503): Xaa can be any naturally occurring amino acid
  misc_feature (617)..(617): Xaa can be any naturally occurring amino acid
MSSTPGYAADGYARARGVGACAVTFTVGGLSVLNAIAGAYSENLPVICIVGGPNSNAVIHPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAGIAESSGYPFAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGLVIPNRYEFQMQYGSIGWSVGATLGYAPGXPKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTXKELLEWGSRVSAANSRPPNPQ

SEQ ID NO: 69713 - protein, 430 aa, Cryptococcus neoformans var. neoformans B-3501A
MSTTPNAVIPQAKRMFDGATHKLDVWSIFTPANVPADCINLGQGFMNWAPPDWIRAESHESMDHDIMSNHYSHPRGRPRLLKAISKHYSPQFENIVARGKDLTNEEILVTSGANCGMFAALTAHCEPGDEVICIEPYFDQYFASIHFQGAKPVFVPLHPPTGKGIKHGGDWTLNIDEFAAAFTPKTKAVIINTPHNPVGKVFTKEELEQIAKVCIEKNVLVLADEVYDCMVYDGNKHFRIATLPGMWERTLTVGSGGKSFACTGWRVGWLIGPPQLTAATLAAHSRIVFCTNSPMQEAVAIGLEKAAEHKFFEEQVAAYEERRDILCSYFDQIGLSYTKPEGSYFLLVDISPVKVPEGYPIVETCKGRGKDFEFCWWLCQELKVVGIPPSEFYSEEHVNIGERFARFAFCKDPELLHAAGKRLLKLKEYL

SEQ ID NO: 69714 - protein, 391 aa, Parvularcula bermudensis HTCC2503
MRISQDRTERPTTGRLVLSDGTVFEGEGFGQTGAAVGEVCFNTAMTGYQEILTDPSYAQQIVTFTFPHIGNVGANDEDIENASTAASVAARGAVVRAEVTAPSNYRARADLNAWMRRRGIIGLSGIDTRALTSRIRETGMPHGTIAYSPSGQFDIEALRAAAAAFPGLEGAELTKSVTQSSPYAESEGAWSDQGFAAGREDGPHAVVVDFGAKRTILRCLVAAGARVTVVGPSSSAEEILALSPDGVVLSNGPGDPAATAQFAVPMIKGVLAARLPLLGICLGHQLLALAIGAKTMKMPQGHHGANHPVKDHRSGRVEIVSMNHGFAVDAASLPAEAEATHTSLFDGSNAGFSLRNAPVISVQHHPEAGPGPQDSAPIFARFVSMMATSAQ

SEQ ID NO: 69715 - protein, 269 aa, Glycine max
  misc_feature (81)..(81): Xaa can be any naturally occurring amino acid
  misc_feature (136)..(136): Xaa can be any naturally occurring amino acid
  misc_feature (233)..(233): Xaa can be any naturally occurring amino acid
MAEQALEGSQPVDLTKHPSGIVPTLQNIVSTVSLDCKLELKSIALQARNAEYNPKRFAAVIMRIREPKTTALIFASGKMSXHYEGSHPSPLTNTFFLRASVHSLTKTNRFIKLLHLLVMGFYFLCFFPSKFKSHGXVCTGAKSEQQSKLAARKYARIIQKLGFPAKFKDFKIQNIVGSCDVKFPIRLEGLAYSHGAFSSYEPELFPGLIYRMKQPKIVLLIFVSGKIVLTGAXRDETYTAFENIYPVLTEFRKNQQWGSGSFSAIGYTC

SEQ ID NO: 69716 - protein, 275 aa, Burkholderia mallei ATCC 23344
MRLGPPDLRQESENFYVSHALDDALHALLAQARLELRYKGRHDADAPAEAAIDAKADAAVRAFAARLPDIRALLDSDVLAAFHGDPAAGSVDEVLLCYPGVLAMIHHRLAHALYRLELPLLARIVAEHAHAQTGIDIHPGAQIGGGFFIDHGTGVVIGETAVIGERVRVYQAVTLGAKRFPRDASGHLEKGLARHPIVEDDVVVYAGATILGRVTIGKGAVIGGNVWITQDIPPGSHVTQAVTRSDPARPADAAASSPWPAGAHDATLSAAQALR

SEQ ID NO: 69717 - protein, 671 aa, Burkholderia mallei ATCC 23344
MTIPTPTVDSAMSAAPVALPDAAPPAGLPDPATLARLASEFLAALPGQPAAPNAGAGSGAVGGVPSALPAAAPMLASVSNPAPPGSPLAGPGGTGTGVPGIGVPPGKVPGANLVPAPTHVLSLGNRTPALVGHAAAQNGWPDSAVAIAPALEPRAGGVALGVPPVPEPDAVRRAGDASAAAAPSPWSYYFVEPASDDWWRDAARTPIDVPRDGVASPRAFGLPDENAWRDLLSIGRPAADRHRASRYFVDDAQPTNAHAPGAGAHPPFDVAAIRRDFPILAERVNGKPLVWFDNAATTHKPQAVIDRLAHFYAHENSNIHRAAHALAARATDAYEHARATVQRFIGAASPDEIVFVRGATEAINLIAKTWGVGNVGEGDEIVVSHLEHHANIVPWQQLAASVGAVLRVIPVDDAGQVLLGEYRKLLNDRTKIVSVTQVSNALGTVVPVKEIVELAHRAGAKVLVDGAQSISHMRVDVRALDADFFVFSGHKIYGPTGIGVVYGKRALLDGMPPWQGGGNMIADVTFERTVFQPPPNRFEAGTGNIADAVGLGAALDYVARIGIERIARYEHDLLAYAAGVLAPVPGVRLIGTARDKASVLSFVLKGYETEEVGRALNAAGIAVRSGHHCAQPILRRFGLEATVRASLAFYNTRDEVDAMVDVVRELAARRI

SEQ ID NO: 69718 - protein, 404 aa, Acinetobacter sp. ADP1
MFQHIPPYAGDPILSLMEQFNADSREAKVNLSIGLYYNEDSIVPQLDSVIEAQKRIEPRQNKVKPYLPMEGFKPYRDAIQTLLFGHNSPAVKAGRAVTIQTLGGSGALKVGADFLKNYFPDSEVWVSQPTWDNHIAIFNGAGFKTHFYPYFDAETRGLDFEGMLATLKQLPKHSIVLLHPCCHNPTGVDLVPAQWDQVIDVLKAGHLIPFLDIAYQGFGDGMEQDAYAIRALDQSGLNFIVSNSFSKIFSLYGERVGGLTFVCDDAEAAQCTFGQLKATVRRIYSSPPTTGAWLVDQVLNDAELSQQWQNEVKEMRERILKMRIILRDELTKALPDRDFNYLVDQKGMFSYTGLTADQVDTLREDYAIYLVRSGRICVAGLNMNNVYIVAKAMAEVLATEVTPA

SEQ ID NO: 69719 - protein, 460 aa, Nostoc sp. PCC 7120
MLTIETSKIKEIIQQQRNFFQAGQTKDINFRLEQLKKLRKLVTDNETAITKALKADLNKSEYEAYFAEVGVIKEIDYAIKNLKNWSKPKKADVPLDFFSYSARIYPEPLGVVLIICPWNYPFALTISPLVGAIAAGNCAIIKPSELAPHTSNLAAQLISKCFPSEYVAVVEGGAETSQELLAEKFDHIFFTGGTAIGKIVMEAAAKHLTPVTLELGGKSPCIVDSNIHLEYTAKRIAWGKFINAGQTCIAPDYLLVNQKIKKDLIAAIQKNLQEFYGDNPIDSPDYGRIISHRHFERLAKFLKNGQVIVGGETNYEDKYIAPTLLDNVSLADPVMQEEIFGPILPMIEYTDIKDAIALINSQPKPLALYIFSQNKALQQQVLQETSSGGVCINDTIMHVGVSSLPFGGVGDSGIGSYHGKASFDTFSHYKSVLKNAFWLDLDWRYAPYKNKLSLLKRMMK

SEQ ID NO: 69720 - protein, 214 aa, Xylella fastidiosa Dixon
MRILLARHGETLWNAEGRYQGQIDIPLSSVGEAQARALGERLRDVVIARAVASPLLRAQYTAQLALGESRIAQLLIEPDLKEIAHGDWEGLLDTEIHAMDPTRLHAWRKAPETVIMPNGESLHQVLERSWRGLTTAVVGLGIDDILLVVAHDAVNRVILCRVLGLPLAHLWRFHQAPTTLNLLEGKNIDQLQVVRLNDCSHHTPFFGEAKHRAL

SEQ ID NO: 69721 - protein, 450 aa, Ralstonia metallidurans CH34
MTIASGEVPDGTQTPQMQLLAIGINHTTAPVSLRERVAFPLEQIKPALGALRTHLSGRNGTEAAILSTCNRTEIYCATDVLKPGEEGFEHTLRWLAQHHNVPASELAPHLYALPQSEAVRHAFRVASGLDSMVLGETQILGQLKDAVRTAGEAGALGTYLNQLFQRTFAVAKEVRGQTEIGAHSVSMAAAAVRLAQRIFESVSTQRVLFIGAGEMIELCATHFAAQTPRQIVVANRTVERGEKLAEQLSEQGLTTQAIRLQDLGDRLHEFDIVVSCTASSLPIIGLGAVERAVKRRKHRPIMMVDLAVPRDVEPEVARLDDVFLYTVDDLGAVVREGNALRQAAVAQAEAIIDSRVLNFMHWLETRSVVPVIRELQSQGEAIRQAEVERARRMLARGDDPAAVLEALSGALTRKFLHGPTHALNHTQGEDREALLRLVPGLFRHSSHSER

SEQ ID NO: 69722 - protein, 849 aa, Azoarcus sp. CIB
MEAVQTSEIRWWKASKPVGMAEFGAPVKLSIDGVEVEAPAGASVLNAATAAGLYIPALCAHPDLPPAGQRGAGEGGCNLCMVEIEGTDGLSKACSTTVTAGMVVTTQSAAIQTVRQANLAKVLGPHPHVCLTCPQRDGCSRSQCSYGNPQETRCCTIFSSCELRKVSDYIGIPNTTPPYKPAQLPIIKDEPFFDRDYNLCIDCRRCLVACNDVRGVGCLEVKEVETPQGKRTYVGTIAPTLLESGCTFCQACVTVCPTGALMDRTLDPAKREESMVPCKSACPAGIDVPRYVQLAAEGKYGEAIAVVRERLPFPGILGRACFAMCESACRRKDLDDPLSIRNLKRIAADNDTGLWREHAKKLPATGKKAAVIGAGPAGLTVAYYLAKQGHGVTIFDAQPAAGGMARYGIPSYRVPAEVIDNEVAEVSALGVEFRYGAKVESVDTLFNDGYGAVFVGIGAQGGDNLGIPGDDLPGVVDSPTYLKAVTMGLVNTPEGIQTGRKVAVIGGGNVATDNARSSRRFGAEVDMVYRRTREEMPARLEEFEGCVEEGVNIRYLLAPKKIEPGTNGFRLQITYAKMALGEADASGRRRPVETGEEVVEGVDLVIAAIGQFPNRFGGFGVETDRKGRITVREDSMLTSRPKVYAGGDCVLGPSTLIESVAQGRTAASAMDIVLGGDGDISEVLLRSGWETNPRIGRKDGFNTTRKFHPIMLAPEQRTGWDEVELGFDDATARAEAARCFKCNLAPKIAEAILPPESSLKFDEATIASVPTESGVFQLLDGDKNVLMIKGVENLRDGLMEQLERGGDATNFVFEEAALFTSRESQMIQAYLQQYGKMPGGGSDELDDLF

SEQ ID NO: 69723 - protein, 534 aa, Candida albicans SC5314
MASRDLPHSLNDLAFGWIKHLKEEIIINKNSQQLVDEDFQPDEDVTKETKVKLNNLWPAFASGAGLFADGYVNNSIGIVMACLKILYGDEFTKSNAISNIGSIGFVGTVVGQLSFGYISDRVARKGGMMTANIMLIAFTLLCAVGSWGTTIQGFFACLTVWRFCLGVAIGAEYPTSSVIASEFANQLPAGKRNRYFIWFTGFMIDFGFVVSAFVPFVLLWIFTEKHLRALWRVSIGLGAILPTALFFIRLKMKDSTSFEKLHMKNVRYRDYPWWLIVKFYWFRLTIVSMIWFIYNFSVYSFGTFNAIILGQIIPDAPLWQQWGWSVVFNLFYIPGSFLGAFSADYLGPRLTLAIGVGLQGIIGFIMSACLNGLRKQVAAFTVVFGIFATLGEFGPGGNIGLLASKTSATPIRGQYYGIAAAMGKIGAFVGTWIFPAIQRRYASKTNPDLELQVPFYLSSGLCIFSALLTFFLCPHVGQDAINREDKEFVEYLRKNGFDVSKLGEDSSSVDVDVVKDTDSAEKISETIEVGQKLA

SEQ ID NO: 69724 - protein, 459 aa, Acinetobacter sp. ADP1
MQRKLSNRHLQLIAIGGAIGTGLFMGSGKTISLAGPSILYIYMIIGVMFFFLMRAMGELLLANLQYKSFVDMAHDLIGPGAGYYLGWTYWLGWVLVGIADLAAIINYLNFWLPDGTVFTPMGQALISAGCVLLVLGLNLLTVRLFGEIEFWFALIKILAIVGLIGVGGYMVFSHFQAPAGTVAAISNVWSEGGMFPKGVTGFLAGFQIAVFAFVGVELVGTTAAETRDPQKNLPKAINAIPVRIILFYVLALFVVMSVTPWNHISADKSPFVELFLHAGIPTSAIIMNLVVLSSVMSSMNSGVFSTSRMLFGLSRDGQAPQAFAHLSRRAVPANGLLFSCFFIMAGAALQYFVPNTMEAFTLASSLCVILFISVWGMIMVCYLRYRKLRPELHAQSTFKMPGGIWMSYIVLAFLMFTLVILALEPDTLKALYISPLWLILLALTYQFMYKPRLKRLMHN

SEQ ID NO: 69725 - protein, 209 aa, Vitis vinifera
  misc_feature (173)..(173): Xaa can be any naturally occurring amino acid
MKIMDEEREFEEEKEIRVLNGKMNGDGVDDEDDGGEEAEKNNVVEEGEEEDGDEDDDDDDDDDDDDDDDDDEDDDDDVQEVLQSSGGPPVQSVDDDEDEDEGDEEEDEDGEGDGDDDDDDDDEEDEENEEEEDMGTEYLVRPVGRAEDEEDASDFEPEENGEEEDFEDDDEDXDEGSGKVEAPAKRKRSDKDDSGDDDGGEDDERPSKR

SEQ ID NO: 69726 - protein, 184 aa, Aspergillus nidulans FGSC A4
MRGLNFLIALSSFGNIIAVQVGLSRQIRECGRQGVLPFTRFWVSTRPFGTPLGPYAVVWFMIALMTLAVPAGNAFTFVNDLSMLPKAAFNFAIAVGIYVYPPDGGQYVGDVSFWYATYAVTGVGIACAIYYALWAHFTPNWKGYNLRQELITLEDGAQSNRLRKVPNEEVEERDAVHVAGGAPY

SEQ ID NO: 69727 - protein, 523 aa, Ustilago maydis 521
MPVIQRTAVRAASRSALRARQNAAAFSSVARAAVTASSSAPRGLATEASPKGQTGAVKAVIGPVVDVQFDTEDLPSIFNALEVQNVTGGGRLVLEVAQHLGENTVRAIAMEGTEGLVRGQKVVDTGLPIQIPVGPGTLGRIMNVIGEPMDERGPIKGNKLAPIHVEPPAFVDQSTKAEVLETGIKVVDLLAPYARGGKIGLFGGAGVGKTVLIQELINNVAKAHGGYSVFTGVGERTREGNDLYHEMIETGVINLEGDSKVALVFGQMNEPPGARARVALTGLTIAEYFRDEEGQDVLLFIDNIFRFTQAGSETSALLGRIPSAVGYQPTLATDMGVMQERITTTKKGSITSVQAVYVPADDLTDPAPATTFAHLDATTVLSRGIAELGIYPAVDPLDSKSRMLDPAVVGREHYDIATGVQKLLQDYKSLQDIIAILGMDELSEEDKLTVERARKIQRFMSQPFAVAQVFTGIEGKLVSLKDTISACKEILRGDHDALPESAFYMCGGIDDVKKKAEEIARST

SEQ ID NO: 69728 - protein, 215 aa, Gluconobacter oxydans 621H
MTIRDRDPLEVFSNSLVPMVVEQTARGERSFDIFSRLLQERIIFLTGPVYDQVSSLICAQLLYLESVNPTKEISFYINSPGGVVSAGLAIYDTMQYIRCPVSTVCIGQAASMGSLLLAGGEKGHRYALPNARVMVHQPSGGAQGQASDIEIQAREILIIRQRLNEIYREHTGQTLEQIEQKLERDSYLSANEAREFGLIDKVVERNPHETTPDPS

SEQ ID NO: 69729 - protein, 124 aa, Oryza sativa
LSLLSTPTDPGADTTALNASLGDLMNQTQESCRDLYDCSCPELDRICEISRRAGAYAARLTGAGWGGCTVHLVPADKVEDVKAALEKEYYHGMDLTEEQRTEAVVVSRPATGAAVYKVQGGEAK

SEQ ID NO: 69730 - protein, 793 aa, Gluconobacter oxydans 621H
MCAVKESLESHLSAKTTSGPSKPRTTATPRRGRPSASRAAAAATSPTVADEGETSPVTETPAAKAPRTRRTKTAAPATEKTAEVKTPARRPRKAATPAAESATESEAPAPKTTGRRKKAVTEPEAVTEPAEAAAAAPAPRRRRSTKAAETVTEEVEAAPKRRGRPRKTPVVEQPAAEVVTEETVEAPAAPRRRGRPRKVDVAAAAEAPVEAPVEKKACPSRRKASAPVVETPEPAAEETPAVQAEPTKSEKPVRRRRTKAATATPAVVEETVEAPAVVETVVVAEDVSDRPRFADLGLSEPIMRAIEELGYEHPTPIQAQAIPEVLKGHDVLGVAQTGTGKTASFTLPMLQKLAGSRARARMPRSLILEPTRELALQVAENFKLYGKYLRLTHALLIGGESMAEQRDVLNRGVDVLIATPGRLLDLFGRGGLLLTQTSTLVIDEADRMLDMGFIPDIEKIVALLPAHRQTLFFSATMAPEIRRLADAFLRHPVEITVSRQSSVATTIEEALVIVPEDEKRRTLKKLLRRENVQSAIVFCNRKRDVDMIQQYLTKHDIEAGHLHGDLAQSLRFSTLERFRSGELKFLVCSDVAARGIDIGGLSHVFNYDLPFNAEDYVHRIGRTGRAGNEGHAFSLATPRDRRLLEAIETLTGKVIARPVLEGITTVDWAPEEGERRPAETATPAPQDVAEEGEQRPRKRRRGGRKRNRGDRDESETVQQVAPTAVASVAVIEAPVSHRSVELAPAFENDGPKTGFGGDTPAFMLVPRRRKVTVSGSTDPAAPVQHDGRHYGNE

SEQ ID NO: 69731 - protein, 487 aa, Arabidopsis thaliana
MAAKKVFGSAEASNLVTELRRSFDDGVTRGYEWRVTQLKKLMIICDNHEPEIVAALRDDLGKPELESSVYERVLVSLLRNSIKLALKQLKNWMAPEKAKTSLTTFPASAEIVSEPLGVVLVISAWNYPFLLSIDPVIGAISAGNAVVLKPSELAPASSALLTKLLEQYLDPSAVRVVEGAVTETSALLEQKWDKIFYTGSSKIGRVIMAAAAKHLTPVVLELGGKSPVVVDSDTDLKVTVRRIIVGKWGCNNGQACVSPDYILTTKEYAPKLIDAMKLELEKFYGKNPIESKDMSRIVNSNHFDRLSKLLDEKEVSDKIVYGGEKDRENLKIAPTILLDVPLDSLIMSEEIFGPLLPILTLNNLEESFDVIRSRPKPLAAYLFTHNKKLKERFAATVSAGGIVVNDIAVHLALHTLPFGGVGESGMGAYHGKFSFDAFSHKKAVLYRSLFGDSAVRYPPYSRGKLRLLKALVDSNIFDLFKVLLGLA

SEQ ID NO: 69732 - protein, 145 aa, Zea mays
  misc_feature (14)..(14): Xaa can be any naturally occurring amino acid
  misc_feature (16)..(17): Xaa can be any naturally occurring amino acid
  misc_feature (124)..(124): Xaa can be any naturally occurring amino acid
  misc_feature (129)..(130): Xaa can be any naturally occurring amino acid
  misc_feature (140)..(140): Xaa can be any naturally occurring amino acid
VKSAQHYTETALDXIXXLKCVRESDPSDPNKDMVVQLIDDFKISGMNGIHVCMVFEVLGHHLLKWIIKSNYQGLPVRCVKSIIRQVLQGLDYLHSKCKIIHTDIKPENILMCVDDAYVRRMAAXATECXXAGAPPPSGSXVSTAP

SEQ ID NO: 69733 - protein, 225 aa, Oryza sativa
MGRKFFVGGNWKCNGTTDQVDKIVKILNDGQIASTDVVEVVVSPPYVCLSRWIKQVTLPPVRSKLLLSNCRVKNGGAFTGEVSAEMLVNLSIPWVILGHSERRSWLGESNEFVGDKVAYALSQGLKVIACVGETLEQRESGSTMDVVAAQTKAVSERIKDWTNVVVAYEPVWAIGTGKVATPDQAQEVHDGLKKWLAANVRAQVLNHQDPHGGRNWCNAGAEQAE

SEQ ID NO: 69734 - protein, 145 aa, Vigna radiata
AALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 69735 - protein, 510 aa, Lactococcus lactis subsp. lactis
MDDKEHQRHRLIYHTNGKSLEEINGTVEVPKNVGFFKMLLTYSGPGALVAVGYMDPGNWSTSITGGQNFQYLLISVILMSSLIAMLLQYMSAKLGIVSQMDLAQAIRARTSKSLGIVLWILTELAIMATDIAEVIGAAIALYLLFNIPLILAVFITVLDVFLLLLLTRVGFRKIEALVICLILVILVIFAYQVALSNPDWKGIIEGFIPNSRTFASSPTVAGMSPLTGALGIIGATVMPHNLYLHSSISQSRKINHQDKSDVARAVRFSTWDSNIQLTVAFVVNSLLLIMGVAVFKTGVIDDPSFFGLYDALSNPTVLSNGLLADVAKTGALSTLFAVALLASGQNSTITGTLTGQVIMEGFIHMRMPMWARRLVTRLLSVVPVLICVSMTRGQTLKAQHEAINNLMNNSQVFLAFALPFSIIPLLMLTNSKKEMGDFKNNFIIKCLGWFSVIALTYLNLIGLPDQIANFIPHNLGLSHLISGFLILGVLFLLIWTIVELYRGNKKMMAC

SEQ ID NO: 69736 - protein, 533 aa, Enterococcus faecalis
MGKNSEEHEPKQRHHLIEYANGPSLEEINGTIDVPKNMSFWKTLFAYSGPGALVAVGYMDPGNWSTSITGGQNFQYLLMSIILISSLIAMLLQYMAAKLGIVSQMDLAQAIRARTSKTLGIVLWILTELAIMATDIAEVIGGAIALYLLFHIPLGLAVFITVFDVLLLLLLTKIGFRKIEAIVVALIVVIFVIFAYQVALSNPVWGDVIKGLVPSAEAFSTSHAVNGQTPLTGALGIIGATVMPHNLYLHSSVVQSRKIDRKDKTDIQRALRFSTWDSNIQLTMAFFVNSLLLIMGVAVFKSGSVKDPSFFGLFDALSNPAVMSNSILAHIAGSGILSILFAVALLASGQNSTITGTLTGQIIMEGFIHMRVPIWLRRMVTRLLSVIPVLICVLMTSGKSTVEEHIAINNLMNNSQVFLAFALPFSMLPLLMFTDSRVEMGEHFKNSWLIKLLGWVSVIGLIYLNMKGLPDQIEGFFGDNPTASQITLADNIAYVIIALVILLLVWTVVELYKGDKRYAQQLAAMEQQVEEVK

SEQ ID NO: 69737 - protein, 580 aa, Shigella flexneri 2a str. 2457T
MIKPTFLRRVAIAALLSGSCFSAAAAPPAPPVSYGVEEDVFHPVRAKQGMVASVDATATQVGVDILKEGGNAVDAAVAVGYALAVTHPQAGNLGGGGFMLIRSKNGNTTAIDFREMAPAKATRDMFLDDQGNPDSKKSLTSHLASGTPGTVAGFSLALDKYGTMPLNKVVQPAFKLARDGFIVNDALADDLKTYGSEVLPNHENSKAIFWKEGEPLKKGDTLVQANLAKSLEMIAENGPDEFYKGTIAEQIAQEMQKNGGLITKEDLAAYKAVERTPISGDYRGYQVYSMPPPSSGGIHIVQILNILENFDMKKYGFGSADAMQIMAEAEKYAYADRSEYLGDPDFVKVPWQALTNKAYAKSIADQIDIKKAKPSSEIRPGKLAPYESNQTTHYSVVDKDGNAVAVTYTLNTTFGTGIVAGESGILLNNQMDDFSAKPGVPNVYGLVGGDANAVGPNKRPLSSMSPTIVVKDGKTWLVTGSPGGSRIITTVLQMVVNSIDYGMNVAEATNAPRFHHQWLPDELRVEKGFSPDTLKLLEAKGQKVALKEAMGSTQSIMVGPDGELYGASDPRSVDDLTAGY

SEQ ID NO: 69738 - protein, 387 aa, Triticum aestivum
MAMVTAKLSSPAAARLAPVRSAQPARRASLVRVRASGGSYADELVSTAKTVASPGRGILAIDESSATCGKRLASIGLDNTEVNRQAYRQLLLTTAGLGEYISGAILFEETLYQSTTDGKTFVDVLKDQNIMPGIKVDKGLVPLPGSNNESWCQGLDGLASRCAEYYKQGARFAKWRTVVSIPCGPTALAVKEAAWGLARYAAIAQDNGLVPIVEPEILLDGDHGIERTLEVAEKVWSEVFFYLAENNVLFEGILLKPSMVTPGAEHKEKASPEAIAKNTLTMLRRRVPPAVPGIMFLSGGQSELEATMNLNAMNQSANPWHVSFSYARALQNSVLKTWQGQPENIEAAQKALLVRAKANSLAQLGSYTGEGESDEAKKGMFQKGYTY

SEQ ID NO: 69739 - protein, 471 aa, Burkholderia mallei ATCC 23344
MGKQAIGVVGLAVMGRNLALNIESRGYAVSVYNRSREKTDELIAEFPDRKLVPAHTLEAFVASLETPRRILLMVKAGEATDATIAALKPLLDKGDVLIDGGNTHFTDTIRRNQELAQAGLHFIGTGVSGGEEGALRGPSIMPGGQRDAYDLVEPILEQIAAKAPADGEPCVAYMGPDGAGHYVKMVHNGIEYGDMQLIAESYAVLKQVAGLTNDELGAVYAEWNQGELDSYLIEITAKIFGKKDDETGEHLVDVILDRAAQKGTGKWTSQNALDLGVPLPLITESVFARVLSSLKAQRVAASEVLSGPSPAPLEGDRAAFVESVRRALYLSKVISYAQGFAQLDTASKEYGWNLDLGTIAKIFRAGCIIRARFLQKITDAYAKNAALANLLLDPYFQDIAANYQSALRDVVIAAVKAGVPVPAFASAVAYFDSYRSARLPANLVQAQRDFFGAHTFERTDKPGSFHASWAE

SEQ ID NO: 69740 - protein, 127 aa, Picrophilus torridus DSM 9790
MESYVKFQTPETLEKAVLDMVENSYKTGKVRKGTNEVVKSIERGESKLVVIAEDVSPAEVVYYLPTLCEERKVPYVYVKKKSDLGLKVGIASAASVSIVDYGKNDDAYKSIVSQINDAKSGKSENKE

SEQ ID NO: 69741 - protein, 484 aa, Parvularcula bermudensis HTCC2503
MTKLLKTDLCIIGAGSGGLSVAAGAAQLGRDVVLIERHKMGGDCLNFGCVPSKALLAAGAVAQTIRTASKFGIKAADPLIDYGAVHDHVHGVIAAIEPNDSQDRFEALGCTVLREDARFTGRREVTAGDTVVRAKHFVIATGSAPFVPPIEGLKTVPYLTNETLFDLKECPDHLIVVGGGPIGIEMAQAHRRLGAKVTVLERGGDILPKDDPELVAILAEELRGEGLTLETQTEVHEVAKGAEGHIIVKGAKAGAPYEVTGSHLLIAVGRQPPLASLDLQTAGVATHPKGITVDQFMRTSNPRIYAIGDCTGGRQFTHVAGYHASLVVQNILFKTPRLTFGIKGGKNHEEEAPWVTYTDPELAHVGLTAQMAEARGESYSTALWDYEENDRAQAERATRGKIKVVIGKGGRLLGASIVGKKAGDLIGPWQLAVANGLKIGAFTKAIMPYPTLSEVSKRAAGAYYTPSLFSDRTRMLVRLLASFD

SEQ ID NO: 69742 - protein, 152 aa, Saccharomyces cerevisiae YJM789
MWFPQIIAGMAAGGAASAMTPGKVLFTNALGLGCSRSRGLFLEMFGTAVLCFTVLMTAVEKRETNFMAALPIGISLFMAHMALTGYTGTGVNPARSLGAAVAARYFPHYHWIYWISPLLGAFLAWSVWQLLQILDYTTYVNAEKAAGQKKED

SEQ ID NO: 69743 - protein, 249 aa, Xylella fastidiosa Dixon
MTRKLVLLRHGQSQWNSMNRFTGWVDIGLTEQGHQEATMAGHLMKEEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVTESLKNTLERVLPYWNDAIAPQLNDNKTVLISAHGNSLRALYKYLNQESDEKILNVNIPTGIPLLFELSDTLQVVSYRYLGDPDAAQRAAEMVANQGKAK

SEQ ID NO: 69744 - protein, 140 aa, Picrophilus torridus DSM 9790
MIMERCLILVKPDGVERNLIGEVISRFERKGLAIKALKMMRVTREQAEDHYSVHRLKPFFDDLVSYLTSGPIVAMIVEGNNAIASSRMLAGATDGSKAAPGTIRGDFSLDIERNIVHASDSLESYEHEYKIFFNENEIMD

SEQ ID NO: 69745 - protein, 773 aa, Zea mays
DKLVSGNGKFALGFLQLQPGSSYYLGIWFDKVPVLTPVWAANRDNPVSANSTWRELVISDDGNMVFQAQGATVWSTRANTTTNDTVAVLLGNGNLVLRSASNSSLTFWESFDYPTDTQLPGVKVGWNKVTGLNRRLVSRKNAVDLSSGIYSSTLGRDGVARMLWNSSSVYWSSTWNGRFFSAVPEMSAGSPLANFTFVNNDQEVYFTYNIFDESTIVRTTLHVSGQNQVRVWTGQDWMTGNNQPAHQCDVYAVCGPFAVCEPNGDTLCSCMKGFSVRSPSDWEVEDRTGGCVRDTPLLSCGAGDGNSGTGMAADKFYSMPGIRLPQNGKAMPADASSAKQCAQVCLSSCSCTAYSYGKDGCSIWHGELLNVATEGDSDDTIYLRLAAKEFRSGKGSSRSGVVIGAAVGASVAAAAALVFVLLVLIWRRNGRRWSRPVVHNDKGSVVGIVAFKYADLQDATKKFSEKLGEGGFGSVFKGCLGDSTTTVVAVKRLDGARQGEKQFRAEVNSIGIVQHINLVRLIGFCCEGDRRLLVYEHMPNGSLDSHLFRSHGGAGAGAALDWNVRYKIAVGVARGLAYLHHGCRDCIIHCDIKPQNILLDASYLPKIADFGMAKFLGRDFSRVVTTMRGTVGYLAPEWISGTPITSKIDVYSYGMVLLEIVSGKRNSITQQSSSHTEGQQGDYLPVQVAGKLLRGDVLSVVDADLRGDVNVEEVERVCRIACWCIQDREFDRPTMVEVVQFLEGICEPEIPPMPRLLHAIAGGGSNQMAGVGV

SEQ ID NO: 69746 - protein, 413 aa, Gluconobacter oxydans 621H
MTLADSRTGMDMPKIRAHFPILNETVHGRPLVFLDSAASSQKPDVVIEAMRDAAYHQYANIHRGLHWMSERTTEAYERARHDVARLLNAPDHREIVFTRNSTEAINLVAHSFGSMLKRGQAVLISELEHHANIVPWLMLRDRAGIELRVAPINDAGDIDLDAYEALLSDGKVGLVAVTHMSNVLGTITPARKLTEIAHAYGARILLDGSQSVVHRKIDVQDIGADFFTFTGHKLYGPTGIGALWGKMELLDIMPPFMGGGDMIQNVSFERATWAHVPHKFEAGTPAILETIGLGAAVRFVEEIGYDATSRHEAELTAYALEKMRGINSLRILGEPEERGGVISFVMDGAHPHDLATLLDQLGIAIRAGQHCAEPLVRRLGVHATARASFGIYTTTEEIDSLIEGLERARMMLT

SEQ ID NO: 69747 - protein, 287 aa, Anabaena variabilis ATCC 29413
MWTEIDTQISRVTGEKFQSQQRRSVSGGCINQGYAVADGTLTYFVKLNQASQVAMFEAETLGLEQMLATNSIRVPKPICWGIAGNSSYIVLEWLEMGSGNTNSWEEMGRNLAKMHKATSQQGYGWDMNNTIGSTPQINTWTEDWTEFYSKHRLGYQFQLARRRGGNFPKQDELLGALPELLADHEVEPALVHGDLWGGNAGCTVSGEPVIFDPATYFGDREVDLAMTELFGGFPAAFYKGYNQVFPLDGGYERRKTLYNLYHILNHFNLFGGGYASQANRMIEQILR

SEQ ID NO: 69748 - protein, 168 aa, Polaromonas sp. JS666
MIKVGDTLPAATLMEFSEVEGNGCSIGPNPVDVAKVTAGKTIALFALPGAFTPTCSAKHVPGYVEKAAEFKAAGVDEIWCVSVNDAFVMGAWARDQKTDGKVRMLADGSADFAKATGLTLDLTARGMGLRSNRYSMLVKDGKVMSLNVEGPGKFEVSDAATLLAQAKA

SEQ ID NO: 69749 - protein, 512 aa, Aspergillus nidulans FGSC A4
MALLGLLETYRDPLAFVAALSAVFYLLSCLHRRWRRYQFAKENGCEPVVGKIPSYDPFLSLDRLYRLTKLARNRKLLENNVQRFKEFGNTHRAKRITTPMIVTRDPQNIKAILSLKFGDYSMGDRIRIFGPLLGHGIFTSDGEDWARSRHMIRPNFVKEQVAHLEIFEELMDDLFALIPTDGSTVDLQELFFGFTIDSATEFLCGHNVHSLKKRRSGVIDDEPDFAEAFNYSLDNISKNGRFGPLMFLNRDPKAVESHRICHESMDQFVDKAIRMRERYNEEKIVDEAAERRYMFLYGLAQQTGDRRRIRDEVLNILLAGRDTTASLLSNMFFLLAKHPSTWAKLQEEVATLEGRAPTYEQLRNMKYLKYCLNETLRLFPVVPVNSRTAIRDTVLPVGGGPDGQSPAFVPKGTMVAYSVYAMHRREDYYGADAEEFRPERWADLRPGWEYLPFNGGPRICVGQQYALTEAAYVTTRLAQRYSILESRDPGPWEEKLTLTLCSYNGTQVSLRH

SEQ ID NO: 69750 - protein, 426 aa, Anabaena variabilis ATCC 29413
MTSTLRKLPRLNAPKLHTLPNGLTIIVEQMPVEAVNLSLWIDVGSSVESDAINGMAHFLEHMIFKGTERLASGEFERHIEERGAVTNAATSQDYTHYYINTAPQDFAKLAPLQIDVVLNASIPDEAFERERFVVLEEIKRSEDNPRRRTFRRAMETAFAELPYRRPVLGPESVISQLTPQQMRDFHASWYQPQSITAVAVGNLPEEQLIETIVEGFNQLKKTPPSPLPTPRPLNLEPAFTEIVRREFVDESLQQARLIMVWRVPGLNQLEQTYGLDVLAGILAHGRTSRLVQDLREERGLVTSISVSNMSNRLQGTFYISAKCAVEDLQAVEEAIAQHIRKLQTELVTEKEIARVRKRVANRFIFGNETPSDRAGLYGFYQSLVGDLEPAFNYPAHIQTQEAPDLLLAANQYLCPEAYGVVVMKPA

SEQ ID NO: 69751 - protein, 869 aa, Oryza sativa Indica Group
MAEAAATVHRRWRRRLLPKLMLLLCAVVHGQQPDSLGFISIDCGIPDGGGYSDESTRGLRYVPDAGFLDAGAGLSAGINPPYTDRDLAARYLTVRYFPGAASAAGERGGCYTLRQLSPGGRYLVRATFYYGNYDGAIAMLPVVFDLHLGANRWTAVNVTAADAIYIFEAVVSPPADFLQVCLVNIGKGTPFISGLDLRPLKPELYPEATANQSLLLLNHDRPPARFAFNRYQFWRPASYYKLFRYPFDPYDRLWQPYGDDPSWTNITVAAAVDVTNISRSDDPSPILRSAATPANATVRRLDFPWSSDDAATTTYLLLLYFAELQRLPAGAARRFDVLVDGDASAGGGRRGYTPRYLAAEVVRATVRAARPGQRHVVSLVAAPDSALPPIVNGLEIYSVQPMPELATNDRDAKAMMEIRDNYELKKNWMGDPCAPKAFAWVGLNCSYSSSDPALVTALNLSSSVLIGPVNLSFGDLKSLQYLDLSNNSLSGPIPDFLVQMPALKFLDLSSNKLSGSIPSDLLQKRENGSLVLRIGNNANLCYNGANNTCAPESKQSKRILVIAIAVPIVAATLLFVAAIVILHRRRNKQDTWITNNARLISPHERSNVFENRQFTYRELKLMTSNFKEEIGKGGFGTVFLGYLEDGTPVAVKMCSKTSSEGDKEFLAEAQHLTRVHHRNLVSLIGYCKDKKHLALVYENMQGGNLEDRLRGEASIAAPLTWHQRLKIALDSAQGLEYLHKSCQPPLIHRDVKTRNILLSGDLDAKIADFGLTKVFAGDVVTHVTTQPAGTLGYLDPEYYHTSRLSEKSDVYSFGVVLLELVTGRPPAVPLGDGDGGGGESVHLAVWARQRLAEGDIESVATRPWEAASR

SEQ ID NO: 69752 - protein, 532 aa, Haloarcula marismortui ATCC 43049
MKYNIISTNYLLSRDKYCYWPSMSTASDDSTETDSAIKQRHRDAAADAIPDNLSHYIGGEFVAGNSHKTIETRDPTTDAVLGEVPAGNAADIDDAVKAAQQAFDGGWKDASPGERQRVLSEMAHAVEENRKTLATLEVLDTGKTITEAMGDMGLVIDHLTYYAAAARNVNGETRQTNDLFDREKQVFTVKEPYGVVGAIVPWNFPLLIAIWKCGPALAAGNTVVLKPSEETPLSTLKLMELVDNTVPDGVINVVTGYGEDAGAPLSTHEDVPKISFTGSTEVGKEIIRNSAEDIKKTTLELGGKSPVIVYPDADLEEAVEAAMMAIFFNKGECCAAGSRLFVHEDIEEQFLETFTNAASGMTVGDPLLEETDMGPKVSDEQVQRTNEFVEAARESGATIRTGGSAPDDESLAGGAFYEPTVIDDIDHDHPSVQKEIFGPVMETFSWSDEDDVVELANDVDYGLAAGVISGDVTKALQTARRLEAGVVWVNHYNDVSAGQPFGGYKQSGTGRENAAEAIDEFTQTKAINVNLG

SEQ ID NO: 69753 - protein, 1496 aa, Ustilago maydis 521
MHRQNALKLETPGTSNDSELASRQFHFPYAEAYSIQLDLMRKVFSTIEDGKVGLFESPTGTGKSLSLICAAFTWLRQNAQRHTIGTSTNDGETHGSNHGPATQQEPDWVVKHKNELRRKQHEAYELDLKDRIAAARAKQAALKKSLQDGQVLLDAQARVAKRQRRSANDDDDKDSDDDLLIDEKEGAKSARTLQMATYSKTALSETSVEIDSSLSPAVRALMQQYEQASSRGREDEDEPETLPRVIYASRTHSQLSQFVAELKKTSFGQVDIIHAETLPIRTIPLGSRKQMCINEDVQRIGRNKGSEAMNERCIELIKGKTGKTKCSSLPPFDQTGRSRILEFRDAAMAEVGDIEDLVQLGKQTNTCPYFAARSSAKQAELITLPYNLLLQKDARNALGISLEGCIVLVDEAHNLIDTILSTHSVTIDSQQIAQASEQIDTYLDKFALRLKGSNEQNLRKVRKVLSSMSAFFSKKAAEGKTNAELVLSAADLVRSLTGNLDQINLVTLETWLKETQIARKISGYADKHSKMAVQQAAASVNQHNGTRTNKSRHPPKLLLENASPDSIRSASQSAISSMHAIETFILSLANRSEDGRVVLSSATNSAGENVVRAKYQLLNPSHVFRSLVDEARSVILAGGTMEPMSDFRQQLLPFVPPDRLVTFSCGHIIPASNLMVSVLSASPKGLPFEFKFDSRDNVELIDELGRTLVNVCNIVPAGLVVFVPSYAFLDKLMARWKDAASGGLLQRLGSKKKIFIEPKTTMEVDKVLGEYTAAIRAKDVKTGVSSGGAIMFAVVGAKLSEGINFSDNLARGVVMVGMPFANMHSPELAERMKYVRELAIKHESTACVTASQKPSDPQRVLTKYMSNTLLPPLQGHELYINLCMKAVNQSIGRAVRHQNDFAALILLDRSTAQYSVCGTTVNDTAVLSNAVGDPTLCTALRVATPRSTFHLHPHHHHPAISMLGRLNVPVESAYTSMLASTALRRSLKLASAAAPTVRLSQQLSKRRYVQQPSSTASIPIVIGSSSTSLRSFATTPRRLAVEVKPYLLADVGEGITECEIIKWFVQPGAVVQEFDPICEVQSDKASVEITSRYAGKIKRLMHKEGDVAKVGHPLCEIEMESDGENEASDAGEQRAEQAEVTSSSTESESRAVNMEGFMSAEQKHSNGGGHAASDRSVLATPAVRRVSREHNVDLAQVHGTGRDGRITKEDVLKHVSSAASNSSSSSASSTSGSGSAPSSLAAGTTEIVDLTPVQRAMFKAMTATLSTPHFAYSDEIDVTDLDQVRVLLSKSIPERYTQAGDASFTKLTLLPLLVKAMSLALHEHPMFRSTLNSDQKLVRRSSHDVSIALTSKVGLLTPCITDVQAKSIYDVSAFITRLQTVAGSSKGLAPADLKPTGTITLSNVGAVGGGTYTHPLLPPTGQLAIGALGRSRVLPRFASEIPSLGVSDPDKIVRRLIMSVSFTGDHRVVEGADLARLVNRWKQLVENPSLWLGLLA

SEQ ID NO: 69754 - protein, 244 aa, Nicotiana tabacum
MESITIENYVFPSTMVNPPGSTNTFFLAGAGNRGLEIEGKFVKFTAIGVYLEESALPFLAAKWKSKSSEELANSLDFFRDIVTGPFEKFTRVTMILPLTGKQYSEKVAENCVAHWKAIGTYTDAESQAIEKLLNIFQNETFPPGASILFTQSPVGALTISFIKDDSITGTGNAVIENKQLSEAVLESIIGKHGVSPAAKCSIAERVSGLFKKSYADASVFEKPGIEKSSDPVIEEKPTIPEIGV

SEQ ID NO: 69755 - protein, 506 aa, Haloarcula marismortui ATCC 43049
MTSHSEIDTLRIKARHAELAESLLPSGPLKHFVDGEWITGRGDDTFQSIDPTTGESLVGVYEGTKEEVNRAVDAAWEAYEQRWSETTPAERQQLLLTMADRLEARAEDFALIEVLDNGKPITEAREDIELAVDHFRYFAGAARNIEGKTVPHKELHIQTRREPYGVVGQVVPWNFPLLLATWKLAPALAAGNTVVLKPAEQTPISLLTYMREIADVLPDGVVNVVTGFGPETGAPLVSHERVPKVAFTGSTEVGQGVMKAAANTISDITLELGGKSPLIVAPDADPAEAADIAVDAMFFNGGECCSAGTRLFIHESIADEFVDAFLDAVGKLQMGDPLEESTDIGPQVSRAEVEKTLHYIGLARDSDASILRGGGTVEEGILAEGCFVEPTVIADVGADSTVATQEIFGPVEIMLEWDGYDEMVARANNVDYGLAAGVVTDDLSFAHRIAEDIMAGNIWVNTFNRLPAGQPFGGYKQSGIGREGAMETLREYTQTKSITMNLGDGQ

SEQ ID NO: 69756 - protein, 254 aa, Shigella boydii
IVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELEHTQPGAWGRIQLTDAIAELAKKQSVDAMLMTGDSYDCGKKMGYMQAFVKYGLRNLKEGAKFRKGIEKLLSE

SEQ ID NO: 69757 - protein, 524 aa, Myxococcus xanthus
MDQTPEKDPLRARLEKMEKQAELGGGADRIAKQHESGKLTARERIDLLLDPGSFCELDKFVTHRSSEFGMGDKKIPGHGVVTGYGTVEGRKVFVFAQDFTVFGGSLSGAYAQKICKIMDLATRVGAPVIGLNDSGGARIQEGVESLAGYADIFVRNTGCSGVVPQISLIMGPCAGGAVYSPAITDFIMMVKDTSYMFITGPDVIKTVTHEEVSKEALGGAVTHNQKSGVAHFAAENEQAAIVMTRELLSFLPSNNQEEAPVQPCEDDAFRGRRSRSRTIVPSNPNKPYDIKEVIKAIVDDKHFFEVQEHFAKNIVIGFARMNGRTVGVVANQPAVLAGVLDIDASIKAARFVRFCDCFNIPLVTLVDVPGFLPGTDQEWGGIITHGAKLLYAYAEATVPKVTVITRKAYGGAYDVMASKHIRADMNFANFAWPTAEIAVMGPEGAVNIIFRNELAKAPDAAAERARLTADYRDKFATPFKAAELGYIDEIIRPEETRAKLIRSLELLKDKRQENLPRKHGNIPL

SEQ ID NO: 69758 - protein, 454 aa, Enterococcus faecalis
MGKEKKTEKMLNYANGPSLEEINNTVEVPKNASFWRTLLAYSGPGALVAVGYMDPGNWITSIAGGAEYKYTLLSVILLSSLVAMLLQSMAARLGIVTGMDLAQATREHTSKRTGVALWVVTELAIMATDIAEVIGGAVALQLLFGFPLLIGVLITTFDVLLLLLLTKLGFRKIEAIVSCLIAVIFFVFAYEVALADPNVGEVLRGFIPDTKIATDKSMLFLALGIVGATVMPHNLYLHSSIAQARKFDRNDDVEKAKAIRFTTWDSNIQLTVAFVVNCLLLILGGALFYGTNSELGKFVDLFDALKNPDIVGNIASPVLSILFAIALLASGQNSTITGTLSGQIVMEGFIHLKMPLWARRVLTRLLAIVPVIICVIIYGGSETAVEDLLLYTQVFLSIALPVSIIPLTMYTSDKKLMGQFANPAWVKFLAWIIAIALTLLNLFLIYGTLTGLTN

SEQ ID NO: 69759 - protein, 370 aa, Brucella melitensis 16M
MKSRAAVAWEAKKPLTIETVEIGGPKAGEVLVEIMATGVCHTDAYTLSGLDSEGKFPAILGHEGAGIVREVGADVTSVKPGDHVIPLYTPECRQCKTCLSQRSNLCTAIRATQGQGLMPDKTSRFSCDGGEVFHYMGCSTFSNFTVLPEIAVAKVREDAPFDKICYIGCGVTTGIGAVIYTAKVRPGSNVVVFGLGGIGLNVIQGARMVGADKIIGVDINPAKVEMARKFGMTDFINPREIGNDKVVQAIQDLTDGGADYSFDATGNTDVMRQALECCHRGWGESIIIGVAEAGKEIATRPFQLVTGRVWKGTAFGGARGRTDVPKIVDWYMEGKINIDDLITHTMPLDEINTAFDLMHEGKSIRSVVIY

SEQ ID NO: 69760 - protein, 1221 aa, Corynebacterium glutamicum
MSSASTFGQNAWLVDEMFQQFQKDPKSVDKEWRELFEAQGGPNATPATTEAQPSAPKESAKPAPKAAPAAKAAPRVETKPAAKTAPKAKESSVPQQPKLPEPGQTPIRGIFKSIAKNMDISLEIPTATSVRDMPARLMFENRAMVNDQLKRTRGGKISFTHIIGYAMVKAVMAHPDMNNSYDVIDGKPTLIVPEHINLGLAIDLPQKDGSRALVVAAIKETEKMNFSEFLAAYEDIVTRSRKGKLTMDDYQGVTVSLTNPGGIGTRHSVPRLTKGQGTIIGVGSMDYPAEFQGASEDRLAELGVGKLVTITSTYDHRVIQGAVSGEFLRTMSRLLTDDSFWDEIFDAMNVPYTPMRWAQDVPNTGVDKNTRVMQLIEAYRSRGHLIADTNPLSWVQPGMPVPDHRDLDIETHSLTIWDLDRTFSVGGFGGKETMTLREVLSRLRAAYTLKVGSEYTHILDRDERTWLQDRLEAGMPKPTQAEQKYILQKLNAAEAFENFLQTKYVGQKRFSLEGAEALIPLMDSAIDTAAGQGLDEVVIGMPHRGRLNVLFNIVGKPLASIFNEFEGQMEQGQIGGSGDVKYHLGSEGQHLQMFGDGEIKVSLTANPSHLEAVNPVMEGIVRAKQDYLDKGVDGKTVVPLLLHGDAAFAGLGIVPETINLAKLRGYDVGGTIHIVVNNQIGFTTTPDSSRSMHYATDYAKAFGCPVFHVNGDDPEAVVWVGQLATEYRRRFGKDVFIDLVCYRLRGHNEADDPSMTQPKMYELITGRETVRAQYTEDLLGRGDLSNEDAEAVVRDFHDQMESVFNEVKEGGKKQAEAQTGITGSQKLPHGLETNISREELLELGQAFANTPEGFNYHPRVAPVAKKRVSSVTEGGIDWAWGELLAFGSLANSGRLVRLAGEDSRRGTFTQRHAVAIDPATAEEFNPLHELAQSKGNNGKFLVYNSALTEYAGMGFEYGYSVGNEDSVVAWEAQFGDFANGAQTIIDEYVSSGEAKWGQTSKLILLLPHGYEGQGPDHSSARIERFLQLCAEGSMTVAQPSTPANHFHLLRRHALSDLKRPLVIFTPKSMLRNKAAASAPEDFTEVTKFQSVIDDPNVADAAKVKKVMLVSGKLYYELAKRKEKDGRDDIAIVRIEMLHPIPFNRISEALAGYPNAEEVLFVQDEPANQGPWPFYQEHLPELIPNMPKMRRVSRRAQSSTATGVAKVHQLEEKQLIDEAFEA

SEQ ID NO: 69761 - protein, 369 aa, Oryza sativa
  misc_feature (143)..(143): Xaa can be any naturally occurring amino acid
MPPPPSATAGRRSPFSALLLYVTFALVILLLLTSYSPSIPHRGRSLHRRLKLHPRNPSLSGAGAGAPTGGNGAPQKQQNHHHAAPFDPEIAELERRLEDKEWEREHYRILHGDGGGGEADEHIWVPGGVPQGGRGLHQRRRAXTRWNLEQSRADQLHRSAREMELYDKNGDGVVSYGDFRAQHNESSGEVNSLGFPWWKEEHFNASDADGHGFLNKTEFNDFLNPSDSENPQIINLLCKQEIRQRDKDGDGKLNFEEYFHGLHDHIHGYDYENADISHIGNNTVAKERFSKLDKDSDGFISEHELEPVLDKLHLSERYYARQQAAHAISEADKDHDGRLTLDEMIENPYAFYGSVFLSDDEDYFHDEFR

SEQ ID NO: 69762 - protein, 420 aa, Nostoc sp. PCC 7120
MTYTPTKTLADKVRADFPILHQEVNGKTLVYLDNAATSQKPLFVLNALRDYYEQYNSNVHRGAHTLSAKATDAYEGARDKVAKFINAASRKEIVYTRNASEAINLVAYSWGMNNLQAGDEIILSVMEHHSNIVPWQFVAQKTGAVLKFVELTPEQTLDMEQFKQLICEKTKLVSIVHVSNTLGCINPVAEIAEITHRYGAKFLVDACQSVPHIPVDVQQIDCDWLVASGHKMCAPTGIGFLYGKLALLEAMPPFFGGGEMIAEVYLDHSTYAELPHKFEAGTPAIGEAIALGAAIDYLTNIGMEQIHAYEAELTAYLYQQLEQIPQITLYGPKPDANGEGRAALATFTTTGVHANDLSTLLDQEGVAIRSGHHCTQPLHRHLGLAATARASLSFYNTREDIDVFIKALKETIDFFAGIFG

SEQ ID NO: 69763 - protein, 422 aa, Physcomitrella patens subsp. patens
MPDVEANGGIVEIPLAQTGEGIADCELIRWFVKEGDMVDEFAPVCEVQSDKASVVITSRYKGKVSQILFSPGDIVKVGETLMELMLEGSAAEVGLSKGEPNLSTEIQSIAESKAKSVKSEDGRDHSSVLAVPAVRALAKEHGVDLASIVGTGKDGRIMKHDVLNYVASRENVHDDIQLNLAFLCVNLDRWRNIGGRGHRRAMAKAMTAAAAVPHFYYVEEIGVSKLTEMKRALSEGVPLEAGVKLTHLPFLIKSLSMALKKYPLMNSVVDEAVTEINVRASHNIGVAMATSFGLVVPNIKNVQRLSVLEIAAELSRLIHLANTNSLSTEDITGGTITVSNFGAIGGKFGMPILNVPEVAIVAIGRMHQIVRPNETGFDGNEDSERVTWGADHRVVDGATVAHFCNEWKLLIEQPERLVLTLQ

SEQ ID NO: 69764 - protein, 502 aa, Zea mays
QHQHSSLSTTSTRSLLSHDRLTPHPRGRLQEPVGQVVFTAEDAEAWHSQGKAAILVRAETSPEDVGGMHAAVGILTERGGMTSHAAVVARWWGKCCVSGCSGIRVNDAEKLVTIGSHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 69765 - protein, 245 aa, Parvularcula bermudensis HTCC2503
MIQNMGDGDVRRLIAGNWKMNGLEDDLAEVTTLAQRLETPRPDNVDVVICPPATLIAPMHALQFDTIGLGAQDCHTEESGAYTGDLSAAMLRDAGACYCIVGHSERRDYHGETDEVVKAKLAAALKADLIPILCVGENLETREAGKAVDTVVAQLKAAFPGAGKGVVVAYEPIWAIGTGKTAGPAEIEEMHAALRQATSPDTRLLYGGSVKPGNAAEILAVSNVNGALVGGASLKADDFEPIVRA

SEQ ID NO: 69766 - protein, 338 aa, Burkholderia mallei ATCC 23344
MNLQKFSRYPLTFGPTPIQPLKRLSAHLGGKVELYAKRDDCNSGLAFGGNKTRKLEYLIPDALAQGCDTLVSIGGIQSNQTRQVAAVAAHLGMKCVLVQENWVNYHDAVYDRVGNIQMSRMMGADVRLVPDGFDIGFRKSWEDALADVRARGGKPYAIPAGCSDHPLGGLGFVGFAEEVRAQEAELGFQFDYVVVCSVTGSTQAGMVVGFAADGRADRVIGVDASAKPAQTREQILRIAKHTADRVELGRDITSADVVLDERFGGPEYGLPNEGTLEAIRLCAKLEGVLTDPVYEGKSMHGMIEKVRLGEFPAGSKVLYAHLGGVPALNAYSFLFRDG

SEQ ID NO: 69767 - protein, 200 aa, Zea mays subsp. parviglumis
VAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTSGGVDRSVECTGNINAMIQAFECVHDGWGVAVLVGVPHKDAEFKTHPMNFLNERTLKGTFFGNYKPRTDLPNVVELYMKKELEVEKFITHSVPFAEIN

SEQ ID NO: 69768 - protein, 143 aa, Mesorhizobium sp. BNC1
MQIQEIMTRSVDLIDPNATIREAARKMREDNVGALPVGENDRLIGMVTDRDITVRAVAEERSAGNTSVREVMSERVAYCYEDDDAERAAAVMARHQVRRLPVINRDKRLVGIVALADLVRGDGLAAGHALEGISEPSDQPRLM

SEQ ID NO: 69769 - protein, 363 aa, Anaplasma phagocytophilum HZ
MFGPIGNFFGLGNNLLSRAVNEIRRCAPVILHEDDKYLLVFASELLEEPSLAVFKSFSDNVYILLTAQRASYVTTNDKLSRVGANTLSLADIRTLMSGLPEETRSVPVEESLSPLDSLAIDLVKMAKLLPSALVIDMGFGNIEEMYDWCKCNGILHLAGKALTDYTQEYVLQEVCRSDLYLQDSLKSKIIVYRSKIGEPEHYAIVIGEPAIENIVVRLHSSCYTGDLLGSLSCDCRSQLLTAVKLLAEQAGGIILYISQEGRGIGLANKIRAYSLQMQNSLDTVDANRFLGFDDDERIFLPAAMILRNLGVSSLQLLTNNPHKVQEIGKYGFDVTKTIPFHMEINEYNGNYIKTKQTRLGHTN

SEQ ID NO: 69770 - protein, 122 aa, Physcomitrella patens subsp. patens
MASLMRQLQSKAAVATEIATKRGSAYYKQVMEENKQHVVHPATVEKCQELSKQLFYTRLASLPGRYEAFWKEVDFVKQKLVQRNDLKLEEVGIAALFAGECYAWFCVGEIVGRGGSITGYKV

SEQ ID NO: 69771 - protein, 425 aa, Polaromonas sp. JS666
MSIHIIKMPDLGEGITEVELVAWRVKPGDRVTEDQVLADVMTDKATVEIPSPVVGQVLALGGEVGQVLAVGAELIRIEVEGAGAASEAAPSVLTVPQDATASMPVVPAPAPASTLTSIPTSIPDAIAPPSPSADKPIASPAVRRRAWELGIDLQQVAASGAGGRIMQADLDAHVAAHGTAPPAVAGSTGLAQRNDEEKVPVIGLRRRIAQKMQESKRRIPHFTYVEEVDVTELEALRARLNAKWGAQRGHLTLLPLLVRAVVLAVREFPQVNARFDDEAGVVTRHGAVHIGIATQTGAGLMVPVLRHAEARDLWSSAAEVVRLAEAARAGKATRDELTGATLTLTSLGALGGIVSTPVINHPEVAIVGVNRIVERPVMRDGAVVARQMMNLSSSFDHRVVDGVDAAGFVQAVRGYLESPVTLFVE

SEQ ID NO: 69772 - protein, 93 aa, Oryza sativa
MDMSSGPKGSLNPNDRAALMSNIKQQLDLAHAQEILQNVSEKCFKMCVQKPSSSLSSSEQKCLSNCMERFFDATNIVSKAYGQRLQRELANAR

SEQ ID NO: 69773 - protein, 423 aa, Anaplasma phagocytophilum HZ
MVTLPVVTKLKNNLSVITEHIGGVNSVGINLWVKVGSRHEVHEKIGLAHFLEHMAFKGTTTRSALDIAKTFDAIGGNFNAYTDKEHTVYHLKVMKKDARLALEVLTDIVLRSSFPEEEMEREKDVVLQEIYQTNDSPSSIIFDKYLEAAYEGQIFGKSILGSVHTVQNFSKEDLVSHMDKHYYGSNMVLSLAGDIVHDEVLEMAQGLEQLKDRQHCSPVQVPQYTGGEYLEERNHLEQVNIIIGFPGVPYGDERFHAMQVLDTILGSGLSSRLFQEVREKLGLVYSICSFNYSYSDSGLFSVHAATDSTKLPILLQTVTTELKKLPDTIEDEELQRAKSKLEAEILMSRESPVAKSEALGYYYSHYGRYIQKQELIEKIRSIDARNVQDVANFLLQSSSNITLAAIGKLDSSISRVEVASMLA

SEQ ID NO: 69774 - protein, 379 aa, Oryza sativa Indica Group
MRVVLVENMKNPYESNLGGINRRFKLTLNKLYAWTLVDYERVVMIDSDNIFLQKTDELFQCGQFCAVFINPCYFHTGLFVLQPSMDVFKGMLHDLEIGRANSDGADQGFLVGCYPDLLDRPMFHPPENGSKLNGTYRLPLGYQMDASYYYLKLHWHVPCGPNSVITFPSAPWFKPWYWWSWPILPLGLSWHKERWDDLGYAAEMPVILMEILMYAVIITITRLAKPGMTKLCYNRRPEKQNAMVQGLIKMSAIVAMLIAYAIPFFIIPRTVHPFMGWSMYLFGALALGVLVSNAFLLPLLAVLTPWLAIIGMFFVMAFPWYHGGIVRVLAIFGYAFCSAPFLWASLVRVMDSLQTMLEREPFFPRLGEPAQETEFSKLF

SEQ ID NO: 69775 - protein, 265 aa, Haloarcula marismortui ATCC 43049
MRDATYPQLWAAVRAARKAGRTLESVKPAADQFQVKHNGDIVTEADRTVEETILAELSGQFPVHTVVSEESAPEFTTKPRWIIDPIDGTTNFLNGIPHYSISIAFEGAGEPDVGIVYHVPSETMYTAIEGGGAYANGQPLSLSATTELSEALIVTGFDTASMQAQEYDHFRTILNVTQGVRRFGSAAGELAMVAAGQFDAFFERQLSVWDTAAGVKIVEEAGGEVTRIKALDGKNSEMVLASNEAIHQDLVALVSAGTVPKMDGQ

SEQ ID NO: 69776 - protein, 177 aa, Lemna gibba
MASSMMASTAAAVARAGPAQSSMVPFNACRSSVPFPATRKANNNLSTLPGNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 69777 - protein, 180 aa, Solanum lycopersicum
MASSVMSSAAVATRGNGAQASMVAPFTGLKSTASFPVSRKQNLDITSIASNGGRVSCMQVWPPINMKKYETLSYLPDLSDEQLLSEIEYLLKNGWVPCLEFETEHGFVYRENHKSPGYYDGRYWTMWKLPMFGCTDATQVLAEVQEAKKAYPQAWVRIIGFDNVRQVQCISFIAYKPEGY

SEQ ID NO: 69778 - protein, 1032 aa, Escherichia coli O157:H7 EDL933
MGDIMRPIPFEELLTRIFDEYQQQRSIFGIPEQQFYSPVKGKTVSVFGETCATPVGPAAGPHTQLAQNIVTSWLTGGRFIELKTVQILDRLELEKPCIDAEDECFNTEWSTEFTLLKAWDEYLKAWFALHLLEAMFQPSDSGKSFIFNMSVGYNLEGIKQPPMQQFIDNMMDASDHPKFAQYRDTLNKLLQDDAFLARHGLQEKRESLQALPARIPTSMVHGVTLSTMHGCPPHEIEAICRYMLEEKGLNTFVKLNPTLLGYARVREILDVCGFGYIGLKEESFDHDLKLTQALEMLERLMALAKEKSLGFGVKLTNTLGTINNKGALPGEEMYMSGRALFPLSINVAAVLSRAFDGKLPISYSGGASQLTIRDIFDTGIRPITMATDLLKPGGYLRLSACMRELEGSDAWGLDHVDVERLNRLAADALTMEYTQKHWKPEERIEVAEDLPLTDCYVAPCVTACAIKQDIPEYIRLLGEHRYADALELIYQRNALPAITGHICDHQCQYNCTRLDYDSALNIRELKKVALEKGWDEYKQRWHKPAGSGSRHPVAVIGAGPAGLAAGYFLARAGHPVTLFEREANAGGVVKNIIPQFRIPAELIQHDIDFVAAHGVKFEYGCSPDLTVEQLKNQDFHYVLIATGTDKNSGVKLAGDNQNVLKSLPFLREYNKGTALKLGKHVVVVGAGNTAMDCARAALRVPGVEKATVVYRRSLQEMPAWREEYEEALHDGVEFRFLNNPERFDADGTLTLRVMSLGEPDEKGRRRPVETNETVTLHVDSLITAIGEQQDTEALNAMGVPLDKNGWPDVDHNGETRLTDVFMIGDVQRGPSSIVAAVGTARRATDAILSRENIRSHQNDKYWNNVNPAEIYQRKGDISITLVNSDDRDAFVAQEAARCLECNYVCSKCVDVCPNRANVSIAVPGFQNRFQTLHLDAYCNECGNCAQFCPWNGKPYKDKITVFSLAQDFDNSSNPGFLVEDCRVRVRLNNQSWVLNIDSEGQFNNVPPELNDMCRIISHVHQHHHYLLGRVEV

SEQ ID NO: 69779 - protein, 180 aa, Pisum sativum
MASMISSSAVTTVSRASTVQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 69780 - protein, 102 aa, Zea mays
MLHVSFIIYIVSIQIAISASNTGGAWDNAKKYIEAGASEHARTLGPKGSDPHKAAVIGDTIGDPLKDTSGPSLNILIKLMAVESLVFAPFFATHGGILFKWL

SEQ ID NO: 69781 - protein, 191 aa, Triticum aestivum
  misc_feature (108)..(108): Xaa can be any naturally occurring amino acid
  misc_feature (121)..(121): Xaa can be any naturally occurring amino acid
  misc_feature (164)..(164): Xaa can be any naturally occurring amino acid
QIHCDRWGLPNAPIAPLVSGGTPDGRSRKALFVDREFQSTSFLTRSTVDALPGHNVDVRSVYLLASANLIFTAGHDSAVLMWNMAEGLLIAESPPFGCTIRALAAVTXLLVNGRSLALIQXWRSLDGASHLLHIPGNGPSQNCEFPLCAHERAVACLSFDSQRXYFASWDMTDHDGDRHDMDSSQDIVHAV

SEQ ID NO: 69782 - protein, 406 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRD

SEQ ID NO: 69783 - protein, 254 aa, Shigella boydii
IVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARLNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 69784 - protein, 584 aa, Mycobacterium sp. MCS
MFGFTPVRVDLSTLFSNLVHMTASSAPTSHATAGTVLRGVPVVPGVQYAPVVRPGRLPVVEDTAAEIADADRPAEAARFSAAATAVATRLRDRAAHSTGAASEVLAATATLAQDRAWLGAAEKRIAGGTPAVRAVREAVAQFVDLFTKMGGLMAERVTDLQDIRDRVLAELSGLPEPGVPLPMVPSVLCAEDLAPADTAGLDPTLIVALATTLGGPTSHTAIIARQLGIPCVVAVDGLDAVPAGAFVLVDGTAGTVTVGPDEVAAAEAVAAARHEAERAAHWAGPGATADGHAVAILANVQDGAAARAARETPAEGVGLFRTELCFLNRDTEPTVDEQAEIYGEVLDAFAGHKVVVRTLDAGSDKPLKFAGHRDEANPALGVRGIRIAHGNPGILERQLAGIAAAAARTGTRPWVMAPMIATAGEAKDFAAAARRHGLTPGVMIEVPAAALLADRILEHVDFLSIGTNDLAQYTMAADRMSADLALLTDPWQPAVLALVAMTVRAGAAAGKPVGVCGEAAADPTLACVLAGLGVTSLSAASAAVPGVGARLAQVTLQQCRDAAEAVLATATAAEARAAALAALG

SEQ ID NO: 69785 - protein, 389 aa, Brassica napus
  misc_feature (182)..(182): Xaa can be any naturally occurring amino acid
MALQATTTTFSFSAPTFRSTPPHALTSKRRLSIKASSSSGLSSPPLLSLSRSNLKGRAFASDGSTQESPSVVCFGEMLIDFVPTTSGLSLAQAPAFKKAPGGAPANVAVGIARLGGSSAFIGKVGEDEFGYMLANILKDNNVNNEGMRFDPGARTALAFVTLTNEGEREFMFYRNPSADMLXEESELDLDLIKKAKIFHYGSISLITEPCKSAHIAAAKAAKEAGVILSYDPNLRLPLWPSADNARDEILSVWDTADIIKISEEEIEFLTKGEDPYDDSVVRKLFHPKLKLLLVTEGPEGCRYYTKDFSGRVHGLKVEVVDTTGAGDAFVAGILSQLACDLSLLQDEERLREALMFANACGALTVKERGAIPALPTKEAVLEALLKAVV

SEQ ID NO: 69786 - protein, 308 aa, Brucella melitensis 16M
MILCCGEALIDMLPRETTGGETAFQPFAGGSVFNTAIALGRLGVPTGFFSGISSDFFGDVLRDTLARSNVDYSFAAISNRPTTLAFVRLVDGQARYAFYDENTAGRMLSRNDMPYVDETISAMLFGCISLISEPCGSVYETLLAREAPNRVMFLDPNIRANLITVRETHLTRVKRMIALADIVKLSDEDLDWFGEKGSHDEIAAEWLKLGPKLVVITKGAHGAVAYTNHATVPVPGVKVDVVDTVGAGDTVNAGILASLHSQGLLTKDALANLSEDQIHSAVALGVRAATVTVSRAGANPPWAHEMRD

SEQ ID NO: 69787 - protein, 492 aa, Shigella flexneri 2a str. 2457T
MAASMVLVSRADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYSWQARGLVNATGPWVKQFFDEGMHLPSPYGIRLIKGSHIVVPRVHTQKQAYILQNEDKRIVFVIPWMDEFSIIGTTDVEYKGDPKAVKIEESEINYLLKVYNAHFKKQLSRDDIVWTYSGVRPLCDDESDSPQAITRDYTLDIHDENGKAPLLSVFGGKLTTYRKLAEHALEKLTPYYQGIGPAWTKESVLPGGAIEGDRDDYAARLRRRYPFLTESLARHYTRTYGSNSELLLGNAGTVSDLGEDFGHEFYEAELKYLVDHEWVRRTDDALWRRTKQGMWLNADQQSRVSQWLVEYTQQKLSLAS

SEQ ID NO: 69788 - protein, 200 aa, Triticum aestivum
MGDTYVTDVAFGEEVITTTVTSSGAAVEGWVEEVYSMYAGCPNQILVGLDVEWRPSYSRVQNPAALLQLCIDQRCLIFQLLHADYIPDALSGFLMDNQFWFVGVGVAADANRLAQDYDLQVLNLQDLRGVAAEEMGIPELRQAGLKDLAREVLGVTIEKPRRITMGPWDACCLSDEQIHYACTDAYVSSQIGLELFTGNY

SEQ ID NO: 69789 - protein, 371 aa, Methanocaldococcus jannaschii
  misc_feature (45)..(45): Xaa can be any naturally occurring amino acid
MFISYWLLQNVFERHYIKKFLVLSMMKVCVIEGDGIGKEVIPEAXKILNELGEFEIIKGEAGLECLKKYGNALPEDTIEKAKEADIILFGAITSPKPGEVQNYKSPIITLRKMFHLYANVRPINNFGIGQLIGKIADYEFLNAKNIDIVIIRENTEDLYVGRERLENDTAIAERVITRKGSERIIRFAFEYAIKNNRKKVSCIHKANVLRITDGLFLEVFNEIKKHYNIEADDYLVDSTAMNLIKHPEKFDVIVTTNMFGDILSDEASALIGGLGLAPSANIGDDKALFEPVHGSAPDIAGKGIANPMASILSIAMLFDYIGEKEKGDLIREAVKYCLINKKVTPDLGGDLKTKDVGDEILNYIRKKLKGY

SEQ ID NO: 69790 - protein, 337 aa, Methanocaldococcus jannaschii
MVISMHKICVIEGDGIGKEVVPATIQVLEATGLPFEFVYAEAGDEVYKRTGKALPEETIETALDCDAVLFGAAGETAADVIVKLRHILDTYANIRPVKAYKGVKCLRPDIDYVIVRENTEGLYKGIEAEIDEGITIATRVITEKACERIFRFAFNLARERKKMGKEGKVTCAHKANVLKLTDGLFKKIFYKVAEEYDDIKAEDYYIDAMNMYIITKPQVFDVVVTSNLFGDILSDGAAGTVGGLGLAPSANIGDEHGLFEPVHGSAPDIAGKKIANPTATILSAVLMLRYLGEYEAADKVEKALEEVLALGLTTPDLGGNLNTFEMAEEVAKRVREE

SEQ ID NO: 69791 - protein, 468 aa, Anaplasma phagocytophilum HZ
MGSSNYDVAVIGAGPGGYKCAIKAAKLGLSVVCIDKNSQWGGTCLRVGCIPSKAMLEYSYKFHSAKDLFPKLGVMAKDVAFDLKKMFEVRDNEIAVLSSGIDGLFSAAGVHKLRAEAKIAGKKGDFFEVVLSNQDGSLGQVLARNVVLATGSTPTSLPGIDVDGDSVIFSDGALSMDVPKRLLVIGGGAIGLEMSSIWSRLGSEVTVVEYADKIASGFDADISKALQGFLEKQGIKFNLAQKVVSVAKGNTGLLVNCESVVNGAMASMEVDKVLVAVGRSPSITGVVAMDGLLLDNRGFVCVNNRYETSIKGIYAIGDVIGGAMLAHKAEIEGHAVAELIAGNVTQVDYGVIPAVIYTHPAAASVGRGEESLKSVNYKYKVGKSSFAANGRARVACDSDGFVKVIACKETDVILGVHIVGAHADTMINEAAVALGYRATAKDICHICHSHPDVNEVFRDACEVVSHKR

SEQ ID NO: 69792 - protein, 141 aa, Zea mays
  misc_feature (51)..(51): Xaa can be any naturally occurring amino acid
MQRHVASGRPSGTDGSDFSYRMVVESRNHPPPTPPKPRFQRLFHNLAILQXALHLVAGGLLLLLSLSKGAAVNKFAVLSMAAGFLAIVVGELGRLRTMAVLLRLYTSLSSIAVAFSVTCIIRSELFLKVWIMKFRMSLFCK

SEQ ID NO: 69793 - protein, 508 aa, Burkholderia cepacia
MSAVRESLSDQVPTVKLLIDGKFVDSNTTEWLDDVNPATQAVLSRVPMATAEEVNAAVAAAKRAFASWRHAPIGTRARIFLKYQQLIRENMGELAALLTAEQGKTRLDAEGDIFRGLEVVEHAAAIGNLQLGELANNVAKMVDTYTRLQPIGVCAGITPFNFPAMIPLWMFPMAIACGNTFVLKPSEQDPMVTMRLVELALEAGVPSGVLNVVHGGAQVVDAICDHPDIKAISFVGSTRVGTHVYNRATLAGKRVQCMMGAKNHAILMPDANREQSLNAIAGAAFGAAGQRCMALPVLVMVGEAQRWLPDLVAKAKALTVNAGDAAGADVGPLISPSACGRVRELIGEGVEAGAKLELDGRAVSVSGYEKGNFVGPTIFSGVKPGMSIYDIEIFGPVLCVIAADNLDEAIEIINANPSGNGTAIFTQSGAAARRFEEDIDVGQVGINVPIPVPVPMFSFTGSRASKLGDLGPYGKQVIMFYTQTKTITARWFDDASVRKNVNTTIALD

SEQ ID NO: 69794 - protein, 1030 aa, Gibberella zeae PH-1
MTPSPATSQALEPRHSKPSQTVSVNISEGSQSQRSRRFQLEVSECVETKTVTTTTRLTRKFPHVFVRDPVPLENLDTKEYPLAMKPTPPELIEFSYKLPGALETDDEGEDEPTETQMTYSNGHSTPGRIKAESPQESNTLVRVPKHRSQSPSEGYPRRSRASRASPTDSPESSHTSNPRRLPRSNPLNAVSDKLRRSIAHGSSRREGERLSRAPSGFLATPDTSEVVGSSDRPARRRSSHHERQHSPEASSSAVSPHYEATSPVESDSHTVFSSNVATPPITDADAEPFADIDGSLQQPLRPFNPRPSIDVVAAQDASLPSPRLSPTLAAAQLHTADAEDEGQSSFQTSNSDPSRWVDESQLTEDDTSTALVPAGHSQDDYALARPDGSPQVVDTQTLLEAFDSMKTEMKTFMMYQFLRRCPRPTLRVVANAVNPALKCDFLRQLPLELGYSVLSHLDHQDLCRAAQVSKHWRNLVDRNETGWKELFDRDGYRLPPGELKKAIHQGWGWQDPVGANGYEKDLSMRSRLTSTEHELTRNLRQETASKSRASKRKRALNTYSAAERSKRRASAQEVVTREESKSQPEVRQHPSEGPLSAASAALNAVPDPQLGLPSLREMHLFKSLYRRHHMIRKSWTSGEVKPGHVAFAAHPRHVITCLQFDEDKIITGSDDTLIHIYDTKTGKLRKKLEGHEGGVWALQYEGNMLVSGSTDRSVRVWDIERGLCQQVFYGHTSTVRCLQILMPTETGRDSGGQAIMQPEKPLIITGSRDSQLRVWRLPEVGSRRYIQTGPPAHESDCPYFIRVLAGHTHSVRAISAHGDTLVSGSYDSTVRVWRISTGEALHVLHGHLQKVYSVVLDHERNRCISGSMDSLVKIWDLATGACLYTLEGHSLLVGLLDLRDERLVSAAADSTLRIWDPENGKCRNTLMAHTGAITCFQHDGRKVISGSEKTVKMWDVRTGECVQDLLSDLSGVWQVKFDERRCVAAVQRDQLTYVEILDFGAVRDGKPPEELGKRILLNEPEVRAMIEEEA

SEQ ID NO: 69795 - protein, 200 aa, Zea mays subsp. parviglumis
VAKINPQAPLDKVCVLSCGISTGLGASINVAKPPKGSTVAIFGLGAVGLAAAEGARIAGASRIIGVDLNPSRFEEARKFGCTEFVNPKDHSKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEIN

SEQ ID NO: 69796 - protein, 441 aa, Mesorhizobium sp. BNC1
MLERPKRPNDLSAFWMPFTANRQFKQAPRMLVSAKDMHYTTDDGRKLLDGTAGLWCVNAGHCRPKITEAIRHQAGELDYAPAFQMGHPIVFEFASRLVDIAPEGMDHVFFTNSGSESVETALKIALAYHRAKGDGSRTRLIGRERGYHGVNFGGISVGGIVNNRKMFGTLLAGVDHLPHTYLPGKNAFSRGVPEHGVELADELERIVALHDASTIAAVIVEPVAGSAGVILPPKGYLKRLREICDKHGILLIFDEVITGFGRLGTPFAADYFGVVPDIMTTAKGITNGVIPMGAVFVKKEIHDAFMNGPEHMIEFFHGYTYSGNPIACAAGLATLETYREEGLLTRGEELGQHWEDALHSLKGEPHVIDIRNIGLVGAIEMEPIQGQPTKRAFSAFLKGFEKGLLIRTTGDIIALSPPLIITKGQIDEIVDHVREILRSID

SEQ ID NO: 69797 - protein, 385 aa, Gossypium hirsutum
MGDQTSSASALSDVLNKAKPYLAIISLQFGYAGMYILSTICMKHGMSNFILATYRHVVATIVIAPFAFVLERKIRPKMTLPIFLRIVVLGFLEPVLDQNLYYLGMKFTTATYSSAFVNMLPAVTFIMAMIFRLEKINLKKIHSIAKVVGTAITVGGAMVMTLYKGPIIDFVKSGGATHHSTNTESADQHWVSGTIMLLGSIAGWSSFFILQSFTLKKYPAELSLTAWICFMGTVQDAGLSFIMVRDLSAWKIGFDSRLLAASYSGIVCSGIAYYVQGIVIWQRGPVFVTAFSPLCMIITAALGTVILAEKIHLGSILGAIIIVSGLYTVVWGKSKDVKTPELEEKSNGLQELPITDNGRSMNVVDGAANAVNIPDSKNTYSTRGT

SEQ ID NO: 69798 - protein, 132 aa, Helicobacter pylori
SNIKYELDKESGALMVDRVLYGAQNYPANYGFVPNTLGSDGDPVDVLVLSDVAFQAGSVVKARLVGVLNMEDESGVDEKLLALPIDKIDPTHSYVKDIDDLSKHTLDKIKHFFETYKDLEPNKWVKVKGFEN

SEQ ID NO: 69799 - protein, 550 aa, Acinetobacter sp. ADP1
MLIERTCAILGKMLEYCASLVALHSCVIMTTNTHITDDRILILDFGSQYSQLIARRVREAGVYSEMYAFDMSEEDIRAFNPNGIILSGGPESVHEEGSPRAPQVVFELGVPVLGICYGFQTMSEQLGGKVEPGTVHEFGYAEVDIQQRDQLVGNLQDRENQLHVWMSHGDKVSRLPEGFSTTASTPSCPFAAASDEARRFYGVQFHPEVTHTAKGAELLANFVHKICGCGGLWTPEHIIDLRVEQLRAQIGDEKVLLGLSGGVDSSVVAALLHKAIGDQLTCVFVDNGLLRLNEGDQVMQMFADNMGIRVIRADAEERFLTALAGEVDPEKKRKIIGREFIEVFAEEARKLDGVKFLAQGTIYPDVIESAASKQGKAHVIKSHHNVGGLPDDLEFELVEPLRDLFKDEVRKLGTTLGLPHSMIYRHPFPGPGLGVRILGEVKKEYADILRLADDIFMQELRASGWYDKTAQAFAVFQPVKSVGVVGDGRRYAWVIALRAVETVDFMTARFAHLPYELVDKISTRIMNEIKDVSRVVYDVSSKPPATIEWE

SEQ ID NO: 69800 - protein, 166 aa, Brassica napus
  misc_feature (100)..(100): Xaa can be any naturally occurring amino acid
  misc_feature (110)..(110): Xaa can be any naturally occurring amino acid
  misc_feature (125)..(125): Xaa can be any naturally occurring amino acid
  misc_feature (140)..(140): Xaa can be any naturally occurring amino acid
MSAFTSKFADELIANAAYIGTPGKGILAADESTGTIGKRLASINVENVETNRRALRELLFTAPGALPCLSGVILFEETLYQKSSDGKLFVDILKEGGVLXPGIKVDKGTXVELAGTNGETTTQGXLDGLGERCKKYYEAXGARFAKGGFFKNRKNRAHPKFSIPKR

SEQ ID NO: 69801 - protein, 177 aa, Lemna gibba
MASSMMASTAAAVARAGPAQTNMVPFNACRSSVPFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 69802 - protein, 180 aa, Solanum lycopersicum
MASSIVSSAAVATRGNGAQASMVAPFTGLKSTASFPVSRKQNLDITSIASNGGRVSCMQVWPPINMKKYETLSYLPDLSDEQLLSEIEYLLKNGWVPCLEFETEHGFVYRENHKSPGYYDGRYWTMWKLPMFGCTDATQVLAEVQEAKKAYPQAWVRIIGFDNVRQVQCISFIAYKPEGY

SEQ ID NO: 69803 - protein, 178 aa, Glycine max
MASSMISSPAVTTVNRAGAGMVAPFTGLKSMAGLPTRKTNNDITSIASNGGRVQCMQVWPPVGKKKFETLSYLPDLDDAQLAKEVEYLLRKGWIPCLEFELEHGFVYREHNRSLGYYDGRYWTMWKLPMFGCTDASQVLKELQEAKTAYPNGFIRIIGFDNVRQVQCISFIAYKPPSF

SEQ ID NO: 69804 - protein, 644 aa, Escherichia coli O157:H7 EDL933
MKGMQMNKFIAAEAAECIGCHACEIACAVAHNQENWPLSHSDFRPRIHVVGKGLAANPVACHHCNNAPCVTACPVNALTFQSDSVQLDEQKCIGCKRCAIACPFGVVEMVDTIAQKCDLCNQRSSGTQACIEVCPTQALRLMDDKGLQQIKVARQRKTAAGKASSDAQPSRSAALLPVNSRKGADKISASERKNHFGEIYCGLDPQQATYESDRCVYCAEKANCNWHCPLHNAIPDYIRLVQEGKIIEAAELCHQTSSLPEICGRVCPQDRLCEGACTLKDHSGAVSIGNLERYITDTALAMGWRPDVSKVVPRIEKVAVIGAGPAGLGCADILARAGVQVDVFDRHPEIGGMLTFGIPPFKLDKTVLSQRREIFTAMGIDFHLNCEIGRDITFSDLTSEYDAVFIGVGTYGMMRADLPHEDAPGVIQALPFLTAHTRQLMGLPESEEYPLTDVEGKRVVVLGGGDTTMDCLRTSIRLNAASVTCAYRRDEVSMPGSRKEVVNAREEGVEFQFNVQPQYIACDEDGRLTAVGLIRTAMGEPGPDGRRRPRPVAGSEFELPADVLIMAFGFQAHAMPWLQGSGIKLDKWGLIQTGDVGYLPTQTHLKKVFAGGDAVHGADLVVTAMAAGRQAARDMLTLFDTKAS

SEQ ID NO: 69805 - protein, 177 aa, Lemna gibba
MASSMMASTAAVARAGPAQSSMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 69806 - protein, 337 aa, Penicillium marneffei
MVTKVGINGFGRIGRIVFRNVIEHDDAEVVAVNDPFIETHYAAYMLKYDTQHGQFKGTIEVEGSDLIVNGKRVKFYQERDPANIKWSETGAAYIVESTGVFTTTEKASAHLKGGAKKVVISAPSADAPMFVMGVNHTTYKSSDTIISNASCTTNCLAPLAKIVNDNWGLVEGLMTTIHSYTATQKTVDGPSAKDWRGGRTAAQNIIPSSTGAAKAVGKVIPALNGKLTGMSMRVPTSNVSVVDLTCRTEKPVSYDEIKATVKKYAEGELKGIMGYTEDDVVSTDMNGNSNSSVFDAKAGIALNSNFIKLVSWYDNEWGYSRRVVDLIVYISKVDGNA

SEQ ID NO: 69807 - protein, 177 aa, Lemna gibba
MASSMMASTAAVARVGPAQTNMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 69808 - protein, 180 aa, Nicotiana plumbaginifolia
MASSVLSSAAVATRSNVAQANMVAPFTGLKSAASFPVSRKQNLDITSIASNGGRVQCMQVWPPINKKKYETLSYLPDLSQEQLLSEIEYLLKSGWVPCLEFETERGFVYREHHHSPGYYDGRYWTMWKLPMFGCTDATQVLAEVEEAKKAYPQAWVRIIGFDNVRQVQCISFIAYKPEGY

SEQ ID NO: 69809 - protein, 470 aa, Mycobacterium sp. MCS
MTTDSAAQATQAAQADTDIPATVARLRRTFATGRTRDIEWRKRQLRALERLMVENETAIAAALEQDLGRKPFEAWLADIASVAGEAKDAAKNVRKWTRRRYRMLELSQLPGLGWVEYEPFGTVLIIGAWNFPFALTLGPAVGAIAAGNTVVLKPSEVAPACSALMAELVPRYLDNEAIVVVEGDGSVSQELIAQGFDYLLYTGGTEIGRKVYEGAAPHLTPVTLELGGKSPVIVTADADIDVAAKRIAWTKLINSGQICIAPDYVLADAKIRDQLVDKIKAAVQTFESENPDGKRIVNERHFDRLTAALAATKGDVVIGGGSDASKISIQPTVVVDPDPAEPLMTDEIFGPILPIVTVQSLDQAIDFVNARPKPLAAYLFTKTKAIRERVVKDVSSGGMVVNHLLFHFATSKLPFGGVGPSGMGAYHGRFGFETFSHHKTVMTKPTRPDVGAFIYPPYTEKAWKLARRLF

SEQ ID NO: 69810 - protein, 475 aa, Shigella boydii
MLYFVNRYNMIKPIILAGGNGTRLWPLSRSQFPKQFLPLLDNKYSLFQQTLQRINCLQKLSPLIICNETHRFLVSQQLKDIDCNDANVLLEPIGKNTAPAIALAAFQYLKDSEDPLLLVLAADHYISDTGIFLESIKKAKKVAEQGNLITFGIVPDYPHTGYGYIERAKEVYDTVYEIRSFKEKPPYDRACEYIETGDYYWNSGMFMFRASVFLNELKKYEPSIYENCKHAIDSATVDSTFIRPEFHSFNKSPNISIDYAVMERTSIGMVISLDAGWSDVGSWSALCDINSKYHSSDNNNNNNVISIDSSNNFILSEDNLVATVGIKDLIIINTKDALLVADKNNDQNVKLVVEQIKKLGRNEHVEHPVNYRKWGRFEQIDEGVGFQVNRITIDVGKYISKQYHKYRAEHWIIVSGIAEITLDKVTKIYKENESVYVPTNCIHSIKNLGNTILEIIEVQSGTYFGEDDIIRLSTE

SEQ ID NO: 69811 - protein, 436 aa, Vibrio sp. Ex25
MSTETKKMSVVQLTILTFINMAGSGIIMLPSKLAQVGTISVLSWLITAAGSLALAYVFAKCGRFSKRDGGMNGYASYAFGKSGAFMAGWTYGLSLLIANIAIAITCVGYGSAFFEVTLSPVETCLYTIAILWICTFANFGGAKITGQIGTFTVWGVILPVCSLGIVGWFWFNPTMYIEAWNPHHLPFGEAVSASIAMTLWAFLGLESACANSEAVENPEKNVPIAVLGGTLIAAVVYIVSTNICSGIVANSELAASTAPFSTVWSVMLGSAAGKAVAGMAVLACAGSLLGWQFTIASVFKSSSDAGFFPKLFSQVDKRGTPIKGMVAITVIQSVLSLMTISPTLNEQFEALVNLAVVTNVIPYILCMGAIFIMQQVAHVPEREMKTTNIIALIGSLYSFYALYGSGYEAMMWGSIVTFLGWSAYGLIAAKHEPLAN

SEQ ID NO: 69812 - protein, 99 aa, Vitis vinifera
MESNLSPKFAQKVFEGEGGSYYSWSSTEFELLKEAKVGGGRLVLQPRGFGPPHYADCNKIGYVLQGTCGIVGMVFPKASEEVVLKLKKGDTIPVPSGVV

SEQ ID NO: 69813 - protein, 567 aa, Candida albicans SC5314
MSEITLGRFFFERLHQLKVDTVFGLPGDFNLALLDKIYEVEGMRWAGNANELNAGYAADGYARVNPNGLSALVSTFGVGELSLTNAIAGSYSEHVGVINLVGVPSSSAQAKQLLLHHTLGNGDFTVFHRMFKNISQTSAFIADINSAPAEIDRCIRDAYVYQRPVYIGLPSNLVDMKVPKSLLDKKIDLSLHPNDPESQTEVIETVEKLISEASNPVILVDACAIRHNCKPEVAKLIEETQFPVFTTPMGKSSVDESNPRFGGVYVGSLSKPEVKESVESADLILSIGALLSDFNTGSFSYGYKTRNIVEFHSDYTKIRQATFPGVQMKEALQKLLTTVKKSINPNYTPVPVPETKLINTPAAPSTPLTQEYLWTKVSSWFREGDIIITETGTSAFGIVQSRFPKNSIGISQVLWGSIGYTVGATCGAAMAAQELDPKRRVILFVGDGSLQLTVQEISTMCKWECNNTYLFVLNNDGYTIERLIHGEKAQYNDIQPWNNLQLLPLFNAKDYETKRISTVGELNDLFADKAFAVPDKIRMVEVMLPTMDAPANLVAQAKLSEKTNAEQ

SEQ ID NO: 69814 - protein, 737 aa, Saccharomyces cerevisiae YJM789
MSQNIQIGTRKRSRANMNNSTTTGPANNTSSNKTFLDNFEETRTNKLLDEMFARQNSFLTDNLRNSLDLNQADNPLRPRQHQHQLFLDNENAIELDEEPRIINTTINNSNNHSSSRVDEDADDDIIFIKEQPIQFSSPLILPSSSSINNNNNIVTSNNPGCGTAVTSNSTYITTPKKFKKQRTISLPQLPLSKLSYQSNYFNVPDQTNAIVPRVTQTENELLHLTGSCAKTLEGNKAVNLTIAHSTSPFSNPPAQIASLPQSNLKKQIGSSLRKFTSNGSSESASSNKSNFKTDKDGHYVYQENDIFGSGGRFVVKDLLGQGTFGKVLKCIDNKYEPNYVAVKVIRAVDRYREAAKTELRILQTILNNDPQGQFQCLLLRECFDYKNHICLVTDLYGRSIYDFMCSNGIARFPGSHIQAIARQLIRSVCFLHDLGIIHTDLKPENILICDETHIAQKLPLKTVQSLSKRRREASKGKRKILKNPEIKIIDFGSAIFHYEYHPPVISTRHYRAPEIVLGLGWSFPCDIWSIACVLVELVIGESLYPIHENLEHMAMMQRINGTPFPTDIIDKMFYKSKHKLGNSPSDLNSTVIKHFDRKTLSLQWPEKNKRGDTITTEKSMKRVLQSCDRLDIYISKVLKQDYGDSLSINWNLPPEKNWSLINSKLAWKRQTHSSSSSTTDELDKETFLFWYWFIDLLRKMFEFDPTKRITAKDALDHEWFNLGILDDGIATYNNTQG

SEQ ID NO: 69815 - protein, 180 aa, Bacillus clausii KSM-K16
MILPYKGVVPTIDPSVYVAEGAIVTGDVTIGAQSSVWFHTVIRGDVAPTIIGERVNIQDQSMLHQSPHSPLMIEDDVTIGHQAMLHSAIIRKQALIGMGSTILDGAEIGEGAFIGAGSLVPPGKVIPPGTLAFGRPAKVVRPLNETDKKEMARIRREYVEKGQYYKSLQQQTATRNKDQQ

SEQ ID NO: 69816 - protein, 354 aa, Aspergillus oryzae
MMLSVLGIVPVLLSLSTNDHEFEAIPDDQLVKFQLFAQYSAAAYCDHNNDDGILGSIRCIEGVCPLVEAANAQTIAEFNEEDIRGFVAVDDTHRLLIVSFRGSNSVRNWIKNFQFWKIDEPGPRGFWDKLFGSDKPQSGNDICSCGIHSGFYRSWQLLKPDVMDALTRAREAHNDYHVVVTGHSLGAAIATIAGAYLRTMQIPCDIYSYGSPRVGDARFAEFVSAQQGLTARITHGYDPVPSLPPMSLFGIYDLGYRHIWPEYWISGVSLNGTDTIKVCRGLENLSCNGTRQTGFSFEIEDHRNYLGHITACGPKFTYRDMDESWSAEDLDRLRMLAGNDTFFATHYISNGTGV

SEQ ID NO: 69817 - protein, 89 aa, Triticum aestivum
MAGGGGRRDAEAAVRIGSGNVFAALEALKKKKKKKPPSASSSAPGRKVNGTKKPAAPGKGEENAPRPPPEVFWAPAPLKSKSWADVEDE

SEQ ID NO: 69818 - protein, 415 aa, Picrophilus torridus DSM 9790
MEDLDPFTISRQQLQKAAKVMNLDKQALEILSYPREILQVSIPVKMDSGEVKVFTGFRVHYNNARGPTKGGIRYYEKENLSEVMALSAWMTWKTALLDLPLGGAKGGIICNPKELSQGELERLSRGYIDAIADFIGPDKDIPAPDVYTNPQIMAWMMDEYEKVMRRSSPGVITGKPLAVGGSEGRGDATAKGGMYVLREAARSIGLDLSKAKVAVQGFGNAGQYAVKFATEMFGAKVVAVSDSTGGIYAKDGVNYEKLLEHKRKDGTVMNYDGSENISEEEVLEQDVDVLIPAAIEDQIRGDNASKIKAKIILELANGPTTPEADEILYKNNVLVLPDFLSNAGGVTVSYFEWVQNVTGDYWDEETVYSKLDKKMTAATRSVLETSKRYEVDPRTAAYIIAVKKVADAMKARGWY

SEQ ID NO: 69819 - protein, 255 aa, Yarrowia lipolytica CLIB122
MAATTDNVTEAVANLNIKEEAPVASEPAEVTETVEEEVTPAEPFSTVFDSKTEFATVHKLTTPWTLWYIKPPSPAVAWHDLIKEVVSFDTVEGFWAVYNNIPKLVELPIRSDYAFFRKGIRPEWECDSNKAGGKWFYQFKPKSANEFDEIWLHTVLSVIGESLETDEEIAKHEGKYNNVDGSASNVNGIFVNIRKAGVRFNVWTKTSEVTDELRQMGVKIKQVLRLPEKEEVQFQSHEESASKNVKSQGKTRLAV

SEQ ID NO: 69820 - protein, 180 aa, Solanum tuberosum
MASSVMSSAAVATRGNGAQASMVAPFTGLKSAASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 69821 - protein, 116 aa, Zea mays
  misc_feature (46)..(46): Xaa can be any naturally occurring amino acid
  misc_feature (75)..(75): Xaa can be any naturally occurring amino acid
  misc_feature (96)..(96): Xaa can be any naturally occurring amino acid
  misc_feature (108)..(108): Xaa can be any naturally occurring amino acid
METKRSVRTLGEADLKGKNAFVRADLNGPLDDAQKITDDTRIRASXPTSSFLLQKGAKVILARHLGRPKGATPKXSLKPLVPRLSELLAVEVLMAXDCIAEEVDKTGXALPQGGVL

SEQ ID NO: 69822 - protein, 180 aa, Solanum tuberosum
MASSIVSSAAVATRANGAQASMVGPFTGLKSTASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 69823 - protein, 322 aa, Oryza sativa
MSIPGNGHLPASTDLPDHSSSASDPEADYRPISAAATDSDTDTDPDPAPHHRLGSIGNGVSELDLDSGGDDDHCEGADGEDTVAEEEEGLGLGEEAARAFSEDERRRRAPLPAGAAARIVDAMRGVEFPGAPPPEEEGGGGGRRGEMVYYALYWWADLDNLTNLQPRYGCDDPTYPYYFKLRCENCGEVSAKATCVSLGEVVDLPNGRSTANLVQKCKLCGRDASIVMIPGQGTPLTMEQSQKGDRTCLMVFDCRGCEPIDFAFGNGWKAESLEGTSFDIDCSEGEFADYDEKGECPVGVGKLRSEFRVVKKQESRGKTKYV

SEQ ID NO: 69824 - protein, 171 aa, Picea sitchensis
MSEPFKVQISSDLIRRLLGEGDQKPIRKPTPKVVRPEHPSNQGPRIEPKVTEEAGGWQPGLPSLLPLGVFPPVADKELDPIRKVLDESEGVMDKLQKEEARVLEKVKHNAEELREKEYKMPEQRTIPCLSAKDACIQCYKDHPEDPLQCAEAVKFFQDCARRVQQQFVTSG

SEQ ID NO: 69825 - protein, 180 aa, Solanum tuberosum
MASSVMSSAAVATRGNGAQASMVAPFTGLKSTASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 69826 - protein, 446 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRD

SEQ ID NO: 69827 - protein, 904 aa, Oryza sativa Japonica Group
AFFSSLKRSVWWWKDWILIPPIRFPSGKIQPCQLSIPQRGSTRSYQSAMAEAVDGGSWEDMLRRILPPGSPIPEAPPNLDYSIALEYDGPPVAYDLPRVDPVEIPTAEPVSGPQRLGNGGGLPVVEPIPLPVSRIARCAEPVSAQVGGGSSDSVNSVLQNEEFDDDDDDSRSLSHDSAQSSPGPQDRSRRTQEGRRGATVTFGFTPDSKCESKEFEEMSEQYVVVTKKEKRRRACYRCGKRKWESKEACIVCDARYCGYCVLRMMGSMPEGRKCVTCIGQPIDESKRSKLGKNSRTLSRLLSPLEVRQILKAEKECQANQLRPEQLIVNGCPLGPDELTDLLSCSRPPQKLKPGKYWYDKESGLWGKEGEKPERIISSNLSFTGKLQANASNGNTQVYINGREITKIELKILKVANVQCPRDTHFWVYDDGRYEEEGQNNIKGKIWESALTRFACALFSLPVPPGNSNETRDEVHYSARTVPDYLDQKRIQKLLLLGPDGAGTSTIFKQAKYLYGTRFTQEELENIKLIIQSNMFKYLGILLEGRERFEEEALSRSNCTISEDEETQQDENKANGSNSCIYSINPRLKKFSDWLLDIIAMGDLDAFFPAATREYAPFVDEMWKDPAIQATYKRKDELHFLPDVAEYFLSRAIEVSSNEYEPSEKDVIFAEGVTQGNGLAFIEFALDDRSPMSEPYIENPEAHSQPLTKYQLIRVSAKGMNDGCKWVEMFEDVRMVIFSVALSDYDQVGPPVYGSSRPLLNKMMQSKELFEATIRQPCFCDTPFVLVLNKYDLFEEKINRAPLTTCEWFNDFSPVRTHHNNQSLAQQAYYYVAVKFKDLYYEHTGRKLFVWQARARDRQTVDEAFKYVREILRWEDEKEENLYGGGEDSFYSTTEMSSSPFIRAE

SEQ ID NO: 69828 - protein, 678 aa, Moritella sp. PE36
MLIPVGAGVGVTSVSLGMVRAFERNGLNVNFFKPIAQPRQGEKGPELSTEIIRQGTNASPATPFTLSHAEKLIGAGKTDVLLEDIVERFESHMVDAEIVVVEGLVPTAKQPFANHVNYNIAKALDAEMIFVTNPGTDSSEQLKDRLEIACSNFGGSKNKRIIGCVINKVGAPLDEAGRNRPDLAEMFEANAGNASHNLEVLQVFGKSPMPILGCIPWNAELIAPRAKDLAKHLNAEILNEGDIEERRLVGITFCARSIPNMLEHFRPGGLLVTSGDRADVIVAACLSAMNGVKIGALLLTGDVRPDASVLKLCSQAMATGLPIMLTPTNTWQTALTLQNFNLDIPADDKPRIEAVQEYIASHIDKQWIETLTVGTKRTRRLSPPAFRYQLTELARKAKKRVVLPEGEEPRTIEAANICAERGIATPVLLGNPAEIKRVAESQGITLSAGVEIVDPITCREKYVAPMVELRKAKGLTEVVAREQLEDNVVLATMMLEQSEVDGLVSGAVHTTANTIRPALQLIKTAPGSNLVSSIFFMLLPDQVLVYGDCAINPDPNASQLADIAIQSADSAKAFGIDPRVAMISYSTGSSGQGSDVEKVREATKIAQERRPDLIIDGPLQYDAAIMENVAKSKAPNSPVAGKATVFVFPDLNTGNTTYKSGTALCKPNLYWSNAARHA

SEQ ID NO: 69829 - protein, 151 aa, Glycine max
MKPIDDKQETVTIRAVSHDEEGRKRVEKIELNTHNIHTIKYVEKKLINKGVQRKDRHPADGIRIGRPPPKSGHGGKFTWEGPASVEDNELMTEPAAMDEGDPNYLDWEERGEETSELVVGEVEVAKVAEEHDGVARVEVDPRLRVIMSDLC

SEQ ID NO: 69830 - protein, 254 aa, Shigella boydii
IVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDCEGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 69831 - protein, 474 aa, Zea mays
  misc_feature (234)..(234): Xaa can be any naturally occurring amino acid
RVYSSLVSEFPCLFPADDDDDDACFIWTVQGSFNYENMTDLLGDGIFAVDGDKWRQQRKIASYDFSTRALRDFSGSVFKRNAARLAGIVSGKAASGQPMEFQGLALRATMDSIFTIAFGLDLDTLGGSAEGSRFAAAFDDASEFTLLRYVNAFWKAQRFLGVGSEAALKKRVKVVDEFVYKRIRERAQELSDSKMATEDTVPVSVKPTRLSPAVSVYYLNELTRPLDDCARDMXDSRQDMLSRFIHTATNESGTVDYKYLRDIILNIVIAGKDTTAGALAWFLYMACKHPEIQEKICQEAAKATSASETAGVDEFAQSLTDEALNKMHYLHAALTETLRLYPSVPLVNKQCFGDDVLPDGSSVSKGDIVFYVPYAMGRMEYLWGKDAEVFRPERWLDQDGEFQQESPFKFTAFQAGPRICLGKEFAYRQMKIFAVVLLRFFVFRLRDGDKASVNYRTMITLHIDEGLHLTVTAR

SEQ ID NO: 69832 - protein, 387 aa, Solibacter usitatus Ellin6076
MNEVRVNRKAAGRVAGGHPWIFASDIDDRDGAQGGHAVKVADQRGHPLGTAHYSSASQITLRMLSRQIEEIGRDFYLHRLRAAEQHRRTVVHDSDAYRVVHGEADLLPALVVDRYGDYLVMQTLDQGMDAAKAEIASCLEEIFRPKGIVARNDVSVRTKEELPLESGIVAGDVPESVTVRMNGLTLRADLLHGQKTGIFLDQRQNYRAAAQYARGGRALDCFTSTGGFALHLAPKCEHVEAVDSSGPALEAARANSTANGIDNIDWNEADVFDLLSGYANARRQFSMVVLDPPAFAKNKRSLDPAISAYKEINLRAMRLLQPGGILVTCSCSHHLSEASLLELVAGAGLDTHRTLRVLERRSQSQDHPILLTVPETLYLKCLILEVV

SEQ ID NO: 69833 - protein, 180 aa, Vitis vinifera
MPHPCKNSTDKLVFNIDAALPDIHVQNAGLLTALTAKKFPFLGEVGLSATLVKLDANAMSSPMYAADSSVQVIYVAKGSGRIQVVGINGERALDTKVKAGHLLVVPRFFVASAIADGEGLEYFSLITATEPVFGEFTGKTSVWGALSPHVLQASLNVAPEFEQLFRAKIKKSTILVPPQN

SEQ ID NO: 69834 - protein, 160 aa, Vitis vinifera
MALNLAPKFAQKIFEGEGGTYYRWSSAEYELLKEAKVGGGRLVLQPRGFALPHYADSNKIGYVLQGSCGVVGIVSPKASQEVVLRLKKGDIIPVPSGAVSWWYNDGDSELIIVFLGETSKAYVPGEFTYFLLTGTQGILGEPMISTTKKPKSLQEANLAS

SEQ ID NO: 69835 - protein, 478 aa, Shigella boydii
MSNNIICPVIMAGGSGSRLWPLSRLFYPKQFLKLVDDSSMLQETISRLGDLPCSLPVVICNEQHRFIVAEQLRMINKLTNNIILEPVGRNTAPAIALAAMISESFSSLEDPLLLVLAADHDIKNHKSFRDAVRKAIPFAEQGKLVTFGIVPSMAETGYGYIKRGHEISLENDEVAYTVSKFYEKPNISDAQKFLASGKFYWNSGMFLFRASRYLSELNKFRPDIYLACASSTKNINTDLDFIRVDENSFSNCPDESIDYAVMEQTSDAVVVPMNAGWSDVGSWSSLWEISKKNEQGNVNHGDVINHNTENSYVYAESGLVTTIGVKDLVVVQTKDAVLVADRNSVQDVKKVVEQIKAHGRSEHQMHREVYRPWGKYDSIDAGERYQVKRITVKPGEGLSVQMHYHRSEHWVVVAGTAKVTIDGVIKLLGENESLYIPQGAKHCLENPGKIPLELIEVRSGSYLEEDDVVRFADRYGRV

SEQ ID NO: 69836 - protein, 358 aa, Vitis vinifera
MELNLAPKFAQKIFEGEGGTYYRWSSAEYELLKEAKVGGGRLVLQPRGFALPHYADSNRIGYVLQGSCGVVGMVSPNASQEVVLRLKKGDIIPVPSGAVSWWYNDGDSELIIVFLGETSKAYVPGEFTYFLLTGTQGILGGFSTEFNSRAYDINNEEAKKLAKSQSGLLLIKLPEGHKMPHPCKNSPDKLVFNIDAALPDIHVQNAGLLTALTAKKFPFLGEVGLSATLVKLDANAMSSPVYAADSSVQVIYVAKGSGRIQVVGINGERALDTKVKAGHLFVVPRFFVAAAIADGEGMEYFSMITTTQPVFGEFTGKTSVWGALSPQVLQASLNVGPEFEQLFRAKIKKSTILVPPQN

SEQ ID NO: 69837 - protein, 419 aa, Rhodococcus ruber
AAERERMIWRVGDLLTQRAEEFGQLEALDNGKSAVIAAAVDTAWSADIFRYYAGWATKIEGSTVNVTMPFVPGGEFHAYTLREPVGVCGLIVPWNFPLLMAAFKLAPALAAGNTVILKPAEQTPLTALLLAEIFEEAGFPPGVVNIVPGFGDAGAALAAHDDVDKIAFTGSTEVGKKVVDAAKGNLKKVSLELGGKSPNIVFADADFDAAVQGSLDAWLFNHGQCCVAGTRLFVERPIFERFTEAVAEAASKVKIGPGLDPATQLGPLVSQEQLDRVTGYLREGLIDGARALTGGKRWGDKGFFVEPTVLVDVQPDFSVVREEIFGPVVNAMPFDADDGISAAANDSIYGLAAGIWTRDLSKAHRTARRLKAGSVWINQYNGFDTAMPFGGFKQSGWGRELGAGALDLYTQTKAVNIAL

SEQ ID NO: 69838 - protein, 230 aa, Vitis vinifera
MVFPEASEEVVLKLKEGDIIPVPSGAVSWWYNDGDSELVIVFLGETSKAHVPGEFTYFLLTGTQGILGGFSTEFNSRAYNISNEEAKKLAKSQTGVLLIKLPEGQKMPHPCKNSTDKLVYNIDAALPDIHVQNAGLLTALTAKKFPFLGEVGLSATLVKMDAKYAADSSVQVIYVAKGSGRIQVVGINGERALDTKVKAGHLYVVPRFFVASTIADGEGLEYFSLLTATQ

SEQ ID NO: 69839 - protein, 230 aa, Vitis vinifera
MVFPEASEEVVLKLKEGDIIPVPSGAVSWWYNDGDSELVIVFLGETSKAYVPGEFTYFLLTGTQGILGGFSTEFNSRAYNISNEEAKKLAKSQTGVLLIKLPEGQKMPHPCKNSTDKLVYNIDAALPDIHVQNAGLLTALTAKKFPFLGEVGLSATLVKMDAKYAADSSVQVIYVAKGSGRIQVVGINGERALDTKVKAGHLYVVPRFFVASTIADGEGLEYFSLLTATQ

SEQ ID NO: 69840 - protein, 180 aa, Vitis vinifera
MPHPCKNSTDKLVFNIDAALPDIHVQNAGLLTALTAKKFPFLGEVGLSATLVKLDANAMSSPMYAGDSSVQVIYVAKGSGRIQVVGINGERALDAKVKAGHLLLVPRFFVASAIADGEGLEYFSLITATEPIFGEFTGKTSVWGALSPHVLQASLNVAPEFEQLFRAKIKKSTILVPPQN

SEQ ID NO: 69841 - protein, 430 aa, Candida albicans SC5314
MLSATKRYLATAAAAAATNTTTTSKAFTNTTSQLGRATLTIKDGPVFNGYSFGANRNVSGEAVFTTSLVGYPESMTDPSYRGQILCFTQPLIGNYGVPSSTAKDQFNLLKYMESPKVQCIGIVVADAALEYSHWTAVESLQQWCKRSGVAAITGVDTRQLVSYLRDKGSSLGRITIGEEYDADEDAAFEDPGAINLVHKVTTKAPFHIACPPQYSKGIHIAVLDCGAKENILRCLVERGASLTVFPYDYPIDKIANKFDGIFISNGPGDPTHCSTTVNNLKKIITNHQDLPIFGICLGHQLLALASGAKTIKLKYGNRAHNIPAIDLITGNCHITSQNHGYAVDANTLSENWQPYFTNLNDLSNEGMIHKYQPIFSTQFHPEAKGGPLDTSFLFDKFFDNINVYKKSNGLNLPPVENSLLVDILPKERVE

SEQ ID NO: 69842 - protein, 272 aa, Zea mays
MAAGRETDEQLTEYEKQRLSRIRENEARLEALGLRSLAASPLLRNSSPGTAKGKQKKRSVDEDEEYVPSDSGGEEKDESSSESAQDEEVDGEGKSASMSRAKKKKLSKSGKSTKNTPTKGSASFAEVVDDDTALQQAIALSLAEYSEKPVTSLGAETSSTVTRASESTPQKNSKASIQDSAKNKKIKKLGKSRIQLTEDDVVQFFFSFDEVGKGYITPWDLERMATINDFIWTDSEISKMIRCFDSDSDGKINLEDFRSIISQCNMLQEHEK

SEQ ID NO: 69843 - protein, 305 aa, Synechococcus elongatus PCC 6301
MGLAGRDLLTLADLSSAEVLEILELAATLKSGQTTVHCPKTLGLIFSKSSTRTRVSFSAAIMQMGGQVLDLNPNVTQVGRGEPIADTARVLSRYLDALAIRTFAQQDLEEYAHYADIPVINALTDDYHPCQILADLQTIQENFGQWQDLTLTYLGDGNNVAHSLLLGCAQVGMNVRIACPPDYQPQERIVAKAQQIAGDRAKVEILHDPIAASQGAHVLYTDVWASMGQEEEAQARVKAFTPYQLNQALLEKADPAAIVLHCLPAHREEEITAEVLEGSQSRVWDQAENRLHAQKAVLALLLGAI

SEQ ID NO: 69844 - protein, 321 aa, Candida albicans SC5314
MEVLHQLTTNHTSSLSNLINNHPTSFSSILKEVDITNHSLTYIEKLWASYYIYMNNDILATGLLFFITHELMYFGRCLPWFIIDKTPWFNRYKIQPTKIPTNQEQWECFKTVLKQHFLVEALPIWLFHPVCAKLGITYDVPFPNWKIQAIQIAIFFICEDFWHFVFHSLFHQGWFYKNIHKVHHKYAAPFGLAAEYAHPVEVMALGVGTVGFPILYAYLATVYTNMPPLHLFTLTTWIVLRLFQAVDSHSGYDFPWSLNKFFPLWAGAAHHDEHHHYFIGNYASSFTLWDWLFQTECGTYARKRRERNSRASAESKHKKTL

SEQ ID NO: 69845 - protein, 358 aa, Vitis vinifera
MELNLAPKFAQKIFEGEGGTYYSWSSAEYELLKEAKVGGGRLVLGPRGFALPHYADSNKIGYVLQGSCGVVGMVFPEASEEVVLKLKEGDIIPVPSGAVSWWYNDGDSELVIVFLGETSKAYVPGEFTYFLLTGTQGILGGFSTEFNSRAYNISNEEAEKLAKSQTGVLLIKLPEGQKMPHPCKNSTDKLVYNIDAALPDIHVQNAGLLTALTAKKFPFLGEVGLSATLVKLDANAMSSPVYAADSSVQVIYVAKGSGRIQVVGINGERALDTKVKAGHLYVVPRFFVASTIADGEGMEYFSLITATQPVFGEFTGKTSVWGALSPQVLQASLNVAPEFEQLFRAKIKKSTILVPPQN

SEQ ID NO: 69846 - protein, 217 aa, Synechococcus elongatus PCC 6301
MALPQVIFFDAVGTLFGVKGSVGLAYRQLALEFGVDANARRLNDAFYAAFQEAPPLAFPEAPPEQVPALEYQWWQAIARRTFERSGDLVQFSDQSFADFFDNLYRHFQGPEPWFVYDDVWPLLDYWRDRGVALGIISNFDSRIYPVLDSLGLTNYFSSITISPEVGAAKPDRLIFAMALAQQQCQPHEAWHIGDSFREDVRGSQAAGLQPIWLKREA

SEQ ID NO: 69847 - protein, 175 aa, Escherichia coli
SLLNVPAGKDLPEDIYVVIEIPANADPIKYEIDKESGALFVDRFMSTAMFYPCNYGYINHTLSLDGDPVDVLVPTPYPLQPGSVIRCRPVGVLKMTNEAGEDAKLVAVPHSKLSKEYDHIKDVNDLPELLKAQIAHFFEHYKDLEKGKWVKVEGWENAEAAKAEIVASFERAKNK

SEQ ID NO: 69848 - protein, 116 aa, Anabaena variabilis ATCC 29413
MANWQCVKQCGACCNLDPAERPEIEDYLTPDELELYFSMVGEGGWCINFDHTTRECRIYSTRPRFCRVEPDIFQDMYGIESEELNDFAIECCRQQIEGVYGDRSLEMLRFDKAVGI

SEQ ID NO: 69849 - protein, 349 aa, Triticum aestivum
  misc_feature (345)..(346): Xaa can be any naturally occurring amino acid
AYLGDTIEQVCTKKQAGTGPEFPGYRRIVVDDESRENEGDLILAASLVTPEAMAFIVRHSTGIVCVSMKENDLERLNLPLMVSTKENEEKLCTAFTITVDAKEGTTTGVSAKDRAKTVMTLASPYSKPEDFNRPGHIFPLKYRDGGVLKRAGHTEASVDLAVLAGLPPVGVLCEIVDEDGSMARLPKLRLFAEKNNLKIVSIADLIRYRRKRDRLIERASVARIPLRWGNVRAYCYRSVIDGIEHIAMVKGEIGDGQDILVRVHSECLTGDIFGSARCDCGDQLAMSMERIEKAGRGVLVYLRGHEGRGIGLGHKLRAYNLQDDGRDTVEANEELGLPVDSREYXXGCD

SEQ ID NO: 69850 - protein, 231 aa, Bacillus licheniformis ATCC 14580
MDVKSNLRHINDRINEACIKAGRTPDEISVIAVTKYVSPERAQAALDAGIRHLGENRDTGLLHKLDVLKDSEPVWHFIGTLQTRKVKAIIDHVSYIHSLDRLSLADEIQKRAKKPIDCFVQVNTSLEPSKHGMAKEEVLPFVKKLSGYENIRIAGLMTMAPFTDDEKAIRSCFRLLRELRDEVRGLDQWNAPCSELSMGMSNDYAIAVEEGATFVRIGSSLVGNETGGGQS

SEQ ID NO: 69851 - protein, 548 aa, Gibberella zeae PH-1
MARLKTFFEGRKATALVGALFFVVAVSAAAPGAAVKRQATKTDMDFKSLTGCHMHGPTQFCMAGSDEYQIVADSGATTTQDPPSSYTDCHNHGSDTYCMNPSGGEVQVLGENASPAQTTAKETASAKAEKITAVSDCHMHETSLYCMGPSSSEYYVQTTITNTEEYPAQLTSCHSHGEETYCMSDDGEAPILAAEDVESGQADPDEEHCHFHAGVEHCVGGSNGSEGGSRSCTRTDRDYNIGIRIGMLFAVLVASSLGVYGPILLSRFTSVQSNIVLTILKQFGTGVIISTAFVHLFTHAQMMFGNECLGTLLYEATTAAIVMAGLFISFLIEFIVYRAMRWQASKKSETDSISLSPKAVEKAEMANISIMEAGIIFHSLLIGITLVVAGDSFFITLSIVIIFHQLFEGIALGTRIASLGYGQMPLALGHSHSHSPAPSVERTGISTVPLWKKLVLASGFAVITPIGMAIGIGVLNVFNGNDPSTLIAIGTLDAFSAGILVWVGLVEMWAQDWMMGGELSDAGPWTTALAMLGLVCGMVLMSVLGKWA

SEQ ID NO: 69852 - protein, 566 aa, Acinetobacter sp. ADP1
MTAETNTNKHPLYIPYAGYTLLELPLLNKGSAFTQEERSHFNLHGLIPHVIETIEEQSQRSYQQYGAFNDDINKHIYLRNIQDTNETLFYRLINDHLEEMMPIIYTPTVGEACQRFSDIYRRHRGIFISYPDREHIDDILQNVSKRNVKVIVITDGERILGLGDQGIGGMGIPIGKLSLYTACGGISPAYTLPITIDVGTNNQQLLNDPIYMGWRQPRISGDEYYEFIDQVLTGIRRRWPHALIQFEDFAQKNAMPLLTKYRDKFCCFNDDIQGTAAVSVGSLIAASRAAGKQLKDQTITFLGAGSAGCGIAEQIVAQMVAEGLTDAQARARVYMVDRFGLITENQPNLLDFQRKLAQKAEVVSDWGNVEEVISLLDVVKNAKPTVLIGVSGQPGLFTEEVIRTLAENCERPIVMPLSNPTSRVEALPSDVIQWTNGRALIATGSPFAPVNYQGKLYNISQCNNSYIFPGIGLGVIASGAKRVTDNMLMASSNALADCSPLLQNPNADLLPAIADIQDVSKRIAFKVAKAAIEDGVALNMSDEVLLQNIEKEFWKPKYRGYKRVPF

SEQ ID NO: 69853 - protein, 495 aa, Escherichia coli K12
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 69854 - protein, 717 aa, Anabaena variabilis ATCC 29413
MVFMKRRTFVQRIGSILAVLGVAETEWLTMNNHYYQALAQPTPRKLALLIGINQYRKSSSLSGCLTDVELQKELLVHRFGFQATDILTLTEEQASREFIEAAFLDHLVKQAKPGDVVVFHFSGYGTQLPVESDTLQNALVTTDENQEAQDSQIANYLLEDTLLLLLRSLPTDRVIAVLDTSYTVPAINQPAGLKIRARQESPGTRLTAAELDFRRQIKPQNPEFSPAVILSATSDPQQSAREILMSGFNAGLFTYALTRQLWQSTPATTIRVSLSHAASSIHQLGSKQQPKLLTKKKNQLGVVTVENLLLDSHAGAEGVILSIEEDGKTVQVWLGGLPAQVLENYGANSKFTLTTGEQLTLRSLMGLTAKAQVSKFAETLPLQVGQLIQETVRVLPRNLNLILALDTKLERIERVDATSAFASVGHISTVVAGEQPADYLFGKLPQTPSRYGLFTLDGELIPNTDGGVGEAVKVAAQRLSSKLSTLLAAKLWRLTENQGSSRLPVKVNLEVVNSISSQAVLQRETTRTITTETATKKSLPTPNPPLPIPIIPIGSRIQYRIQNLSDRPIYFMLLGLKNNRTAIAFYPWQTPQEPNNPENQPQLKQVVIAPNETVTLPQTTPTSGWVTSGPAYECEHQLIFSTAPFNATLEILDNAKYSTADQQPIATLINPLEVGQALLKDLHNSSAVKTETTTTATDSYVLDINNWASLNFSFQIA

SEQ ID NO: 69855 - protein, 479 aa, Prochlorococcus marinus str. MIT 9303
MALHRSNPRSNDLEEHAIWETVDALVSPLPRATFPQECRPALTTFNLLKEELLLDGNSKQNLATFCQTYESHQVADLMALAVDKNLIDKDEYPQTAEIERRCVSMMADLWHAPGEAVGCSTIGSSEAAMLGGLAAKWRWREHRKAAGQSIDRPNMVCGSVQICWTKFARYWDVELREVEMTSGELCMSPERMLEQVDENTIVVVPTLGVTYHGLYEDVQAISQALDELQQRKGLDIPIHVDAASGGFLAPFCAPDLAPWDFRLPRVKSINSSGHKFGLAPLGVGWVLWRESSDLPEGLVFHVSYLGGDMPTFQINFSRPAGQVISQYYDFVRLGRDGYQAIHGASYANAQYVAQELKKLGPFELIHDGNPARGIPTVVWTLRAGQELGFNLYDLSDRLRLRGWQVPAYPFTGELAHQAFQRILVKRDFSREMADLLLTDIRNAITHFESHPVKISLNATEAASTNHLGRSMVESLDAHG

SEQ ID NO: 69856 - protein, 421 aa, Escherichia coli K12
MSNNEFHQRRLSATPRGVGVMCNFFAQSAENATLKDVEGNEYIDFAAGIAVLNTGHRHPDLVAAVEQQLQQFTHTAYQIVPYESYVTLAEKINALAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGEGGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAVEFNDPQTGEPSAAIAQKIQQRALAQGLLLLTCGAYGNVIRFLYPLTIPDAQFDAAMKILQDALSD

SEQ ID NO: 69857 - protein, 339 aa, Moritella sp. PE36
MLTAKFTKAKLAHLPTPLELMPNMTKKFKGPNLYIKRDDATGLAFGGNKVRQLEYYVGRAMDLNADALLTTGAVQSNHVRQTVAAARKMGWHVEVQLEHRVNTHAKEYQESGNPYLNRLMGAKIHTYDVGEDESGADNAMYERAEELKAEGYNPFVIPLGATDKTPWGSLGYVECVEEMYLQSKATDTPIDAIILGSGSANTHAGVMAGLIALDLDIPVYGFCVRRDQEAQTERVEVKTRKVLKMLDIDENKLKPGMVKCSDWVLAPGYGIPSPKVAEAIYTTAFEEGILLDPTYTGKAMCGLIGMLESGHFKDTDNVVFIHTGGAPSLFGYPELVEGK

SEQ ID NO: 69858 - protein, 453 aa, Prochlorococcus marinus str. MIT 9303
MEHPFDLIVLGAGSGGLAAAKRAASHGAKVAIVEGDRVGGTCVIRGCVPKKLLVYGSLYREQLEVAPSFGVELSDARINAGVLLANVRQEVDRLNALHIDLLAKNGVELVTGWGSFTSPNSVAVSRNGAIDASQELHGDHILIAVGGRPHRPDIPGAELGWVSDDMFMQSSFPDRVVVVGAGFIACEFACILHGLGVEVIQLVRGDHLLRGFDRELSTAVQDGMQGKGIDLRFGENPAALKGQPGDLVLSTQSGERFSCGGVLLATGRRPFLQGLNLDAAGVVLEGRRISVDANQSTNIPHIFAVGDVTDRINLTPVAIDEGRAFADSVFGQKPRQVNHDLVASAVFSQPELATVGLTEEQSIDRYGKDQVKVYRARFRSMAQALPKRGPRCLLKLIVDRNTDRILGCHMVGEHAAEIIQMASIALAMGATKADFDRTMALHPTVSEEFVTMT

SEQ ID NO: 69859 - protein, 370 aa, Rhodococcus ruber
MKTKAAVLLETGKPFEIMELDLDGPGPGEVLIKYTAAGLCHSDLHLTDGDLPPRFPIVGGHEGSGIIEEVGPGVTKVKPGDHVVCSFIPNCGTCRYCSTGRQNLCDMGATILEGCMPDGSFRFHSGSTDFGAMCMLGTFAERATISQHSVVKVDDWLPLETAVLVGCGVPSGWGTAVYAGDVRAGDIVVIYGIGGLGINAVQGAVHAGAKYVVVVDPVEFKRDTALKFGATHAFATAAEAAEKVNELSWGQGADAALILVGTVDEEVVSAATSIVGKGGTVVITGLANPEKLTVHVSGTELTLFQKTIKGSLFGSANPQYDIVRLLRLYDAGQLKLDELVTHRYSLEEVNQGYQDLRDGKNIRGVILHDA

SEQ ID NO: 69860 - protein, 189 aa, Cucumis sativus
MASSILSSAAVASVNSASPAQASMVAPFTGLKSSAGFPITRKNNVDITTLASNAGKVQCMKVWPPLGLRKFETLSYLPDMSNEQLSKECDYLLRNGWVPCVEFDIGSGFVYRENHRSPGFYDGRYWTMWKLPMFGCTDSSQVIQEIEEAKKEYPDAFIRVIGFDNVRQVQCISFIAYKPQVLLFLSSIC

SEQ ID NO: 69861 - protein, 442 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQ

SEQ ID NO: 69862 - protein, 219 aa, Escherichia coli O157:H7 EDL933
MTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 69863 - protein, 370 aa, Mycobacterium sp. MCS
MTMTIRGAVLEEIGRPRPFTESAPLSVSELQLDPPGPDELLIRIEAAGLCHSDLSVVDGNRVRPVPMLLGHEAAGIVEQIGPGGSDLEVGQRVVMTFLPRCGHCTACATGGLTPCEPGTAANSAGTLMHGDIRLHRDGQPVHHHLGVSGFATYAVVDRHSVVAVDADVPPVVASLLGCAVLTGGGAVLNVGKPQPGQTVVVVGLGGVGMAAMITAMAHDGVDVVGIDQLEDKLDRARAMGINAAYTPEEAAERGLKAAVVIEAVGHPSALETAIAHTAPGGRTITVGLPRPDARISVSPLGFVAEGRSLIGSYLGSAVPARDIPRFVELWRSGRLPVETLVSSTISLDEINAGMDRLAEGKAVRQVIEFD

SEQ ID NO: 69864 - protein, 254 aa, Shigella boydii
IVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 69865 - protein, 415 aa, Lactobacillus johnsonii
MNSYKIAVAGTGYVGLSLATLLSQHNEVTAVDIVPEKVDLINNHKSPIVDKEIEDFLANKDLNLKATTDAESAYKDADFVIIATPTNYDSEKNFFDTSAVEAVIKLVKQYNPQAIMIIKSTIPVGYTNHVRKEFETENIIFSPEFLREGHALYDNLHPSRIVVGTDKENTKLVEAAHTFASLLQEGAEDKDIATLFMGFTEAEAVKLFANTYLALRVSYFNELDTYAESKGLNTQEIIDGVGLDPRIGSHYNNPSFGYGGYCLPKDTKQLLANYKDVPENLIEAIVKSNDTRKDFIADQVLSKAGYYDYDDNNTYDPSEEKQVTIGVYRLTMKSNSDNFRQSSVQGVMKRVKAKGAKIIIFEPTLENGSTFFGSEVVNDLDEFKNKSDAIIANRYNTILDDVKDKVYTRDIFRKD

SEQ ID NO: 69866 - protein, 321 aa, Synechococcus elongatus PCC 6301
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFGSLYPGCVADTPLFRNTPKLFQKIFPWFQKNITGGYFTQELAGERVAQVVADPEFKTSGVHWSWGNRQQKDRQSFVQELSDKASDDRTAQRLWDLSAKLVGL

SEQ ID NO: 69867 - protein, 148 aa, Zea mays
  misc_feature (67)..(67): Xaa can be any naturally occurring amino acid
  misc_feature (129)..(129): Xaa can be any naturally occurring amino acid
MADVINAGAATASYARDERRSHHPVLRLRVRRSTIRTTKMTTAAAAGRARLVAFSAERDVAAEGNTXYLIDVAELVALLGRAFPILFSRKDTWPQCDRAVFIRKAAWSLHPNAQRMDDTQMVWPNCNGXGKLRQINKYLNNPIHHACY

SEQ ID NO: 69868 - protein, 842 aa, Nostoc punctiforme PCC 73102
MRAVLMAGGSGTRLRPLTCDLPKPMVPILNRPIAEHIINLLKRHQITEVIATLHYLPDVLRDYFQDGSDFGVQMTYAVEEDQPLGTAGCVKNIAELLDETFLVISGDSITDFDLTAAIAFHKQNKSKATLILTRVPNPIEFGVVITDEERRIRRFLEKPSSSEIFSDTVNTGTYILEPEVLEYLPANIECDFSKDLFPLLLAKDEPMYGYIAQGYWCDVGHLDAYREAQYDALDRKVNLDFAYKEVSHELWVGQNTYIDHTAVIETPAVIGDNCRIGARVQIEAGTVIGDNVTIGADANLKRPIVWNGAFIGDEAHLSACVISRGARVDRRAHVLEAAVVGSLSTVGEEAQISPGVRVWPSKKIESGAVLNINLIWGNTAQRNLFGQRGVQGLANIDITPEFAVKLGSAYGSTLKPGSKVTVSRDQRNVSRMVTRSLIAGLMSVGIDIQNLDATAIPIARTVIPTMSVAGGIHVRVHPDRPDYILIEFMDAKGINISKALEKKIEGAYFKEDMRRALIHEIGDVSYPSQVMDRYCTAFEKLLHVHTLRNSRAKVVIDYVYAVSGAVLPQMLDKFGADAVVLNASVNKSAMSITDREGLLTQLGHVVEALKANFGVQVSANGEQLILVDESGYPIRGETLTALMVDMILTANPRGTVVVPVHASSAIEQVARRHDGRVIRTKANPTALMEACQKNPNVVLGGSGETGFIFPQLHPGFDSMFCIAKIIEMLTIQERSLAAARSELPRVIHKTYTVRCPWTAKGALMRYLVETHPAQNLELIDGVKICQPYDDSWLLVLPDASEPLVHLYANSNDREWVDETVRNYRTRVQSFVERQQEYQPAEM

SEQ ID NO: 69869 - protein, 536 aa, Zea mays
MDRVLLSSHLPSHALANTRLQQGPGGLNSIGFAVIKKGCLKLRCYAIGDELGGPGRFSKHFIENSNGPVFQGLDASAGSFRTVGAEITQDTGDFFVSDAEGDPDKPTDGFSSIDQAIGALREGKFVIAVDDENGDNEGDLVMAATLVDQKSVAFMIRNGSGIISVGMEEEDLTRLMIPMMSPITEIEDITAAASTVTVDARVGISTGVSAADRAKTILTLASSDSKPSDLRRPGHIFPLKYRNGGVLKRAGHTEASVDLVALAGLRPVSVLSTVMDPRDGSMAGVTVLQQMAMEHDIPIVSIADLIRYRRKREKLVELIAVSRLPTKWGLFRAYCYQSRLDGTEHIAVVKGDIGDGEEVLVRVHSECLTGDILGSARCDCGNQLELAMQLIEKAGRGVLVYLRGHEGRGIGLGQKLRAYNLQDEGHDTVEANVELGLAVDAREYGIGAQILRDIGVRTMRLMTNNPAKFIGLKGYGLAVVGRVPVISPITKENQKYLETKRTKMGHVYGSDLPGSLPEFANPQEAPTEQDDDDNQN

SEQ ID NO: 69870 - protein, 423 aa, Candida albicans SC5314
MMNIDQHHQLQQQHQQQMLQQQAQAQAQAQAQAQQQQQQQQQAAAAAAAANAAATTSSSSPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPSNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 69871 - protein, 586 aa, Gibberella zeae PH-1
MASAETAPLLGAPGPSTFPDIDSDATPSRPANPKRLSAGVARMEIVSRNITTAHRVWLFIGIFLVGYAYGLESQTRLAYQSYATSSFDLHSYLSTINVLRNVIAVAVQPSAAKIADVFGRFEVIAISTVLYTLGIAIESTAQTVEVFCTGSIIYQTGYTCIVLLLEVLIADFSSMRARVFFSYLPAIPFLINTWISGNITSAVLGSTSWRWGLGMWAIIYPIASLPLLSCLYFLERRTWESDGKESEAVALLSLKTKKGRADLFHQLDVIGLVLLVTAFSLILAPLTVAGGTASHWRSWYIILPLVLGICLMVCFITWEQRGAKHPLVPFHLLRDRGVWSALAVRSLLNLAWCTQGNYLYTILIVAFDFSIENATRILSFFSFFGVITGVLAGLVIFKIRRLKFIIVGGTLLFMAAFGVLIMYPGGASISSKDGIIAAQILLGVAGGFFAYPTQASIQASASREHVAILTGLYLSFYNIGSAFGTCISGAIWTQTLYKSLKHNLAFQPDKGLAKAIYNNPFSIIPDYPVGTEIRDAIISSYSSVQRLLCIAGICFCIPMITFALALRNPRLSEQQVQTEDENNHEA

SEQ ID NO: 69872 - protein, 181 aa, Prochlorococcus marinus subsp. pastoris str. CCMP1986
MQSGNKESFLNSSQKSILILFFALIICSALVLKNFIFQPTFLLKKFGQSSIDPEIAFTNNKPTFLEFYADWCEVCKEMAPKVEDIKNKYEKDINFVFLNVDNPKWEKYIRNFNVNGIPQINIFDNDSNLELTFIGKQEEDSIKESLDNLYDKFRGDSQILNSEFSIIKDNKNYQSSPRSHG

SEQ ID NO: 69873 - protein, 151 aa, Synechococcus elongatus PCC 6301
MSVERTFIAIKPDGVQRGLVGTIIGRFEQKGFKLVGLKQLKPSRELAEQHYAVHRERPFFNGLVEFITSGPIVAIVLEGEGVVAAARKLIGATNPLTAEPGTIRGDFGVNIGRNIIHGSDAIETAQQEIALWFSPAELSDWTPTIQPWLYE

SEQ ID NO: 69874 - protein, 487 aa, Ralstonia metallidurans CH34
MGKATGFLEFARQNEGYEPVVKRVKHYKEFVFALSDSEAKIQGARCMDCGIPFCNNGCPVNNIIPDFNDLVYRQDWKSAIEVLHQTNNFPEFTGRICPAPCEAACTLGINELPVGIKSIEHAIIDKAWEEGWVQPQVPAHKTGKTVAVVGSGPAGMAAAQQLARAGHAVTVFEKNDRIGGLLRYGIPDFKMEKTLIDRRIEQMQAEGVTFRAGVMVTDGALPAGIKNYARETISAQALMEQFDAVVLAGGAEVPRDLPVPGRDLAGVHYALEFLIPQNKEVAGDGVNEIRAEGKHVIVIGGGDTGSDCVGTSNRHGATSVTQFELLPQPPEEENKPLVWPYWPIKLRTSSSHDEGCSRDWSVATKELVGENGKVKALKACRVEWKDGKMQEVPGSEFVLQADLVLLAMGFTNPVGSMLEAFGVDTDARKNAKASTEGDRAYYTNVPKVFAAGDVRRGQSLVVWAIREGRQAARSVDAFLMGHSTLPR

SEQ ID NO: 69875 - protein, 337 aa, Ustilago maydis 521
MLRPSLLSASSSLRSIRRLETPFIVAPALAHAQLSFRRSQVRSRHTVRNASTVFDLSKIPRYDPTNPSANMQSYTRQFPSEAAPLVKLEFDGASRIWVLTMLGNETPDNRLTHKLIGDGLLPALRHVEERWNDMLSSGESSEGAALISTGGVDASAKIFSNGLDLERAMADPTFFDTHLNALYEKLLTLPIPTIAAVNGHAFAAGFGLACAHDYRVMNAKRGYLCMNEIDFGAPLPHGLQMALGSKITDQRVMRKIVLEGHRFSAKEAFDEGFVDILSDSPQDTLDKALELANKLKGKAKMNAWGSNKQVIYAQAIKIMRTSHDDATTALYAPRAKY

SEQ ID NO: 69876 - protein, 464 aa, Acinetobacter sp. ADP1
MSSGRIIQIIGAVIDVEFERNSVPKIYDALQVDGTETTLEVQQQLGDGVVRTIAMGSTEGLKRGLNVTSTNAPISVPVGPATLGRIMDVLGRPIDEAGPVATEERLPIHRQAPSYAEQAASTDLLETGIKVIDLLCPFAKGGKVGLFGGAGVGKTVNMMELINNIAKAHSGLSVFAGVGERTREGNDFYHEMKDSNVLDKVAMVYGQMNEPPGNRLRVALTGLTMAEYFRDQKDENGKGRDVLLFVDNIYRYTLAGTEVSALLGRMPSAVGYQPTLAEEMGVLQERITSTKSGSITSIQAVYVPADDLTDPSPATTFAHLDATVVLSRDIASSGIYPAIDPLDSTSRQLDPLVVGQEHYEIARSVQNVLQRYKELKDIIAILGMDELAEEDKLVVYRARKIQRFFSQPFHVAEVFTGAPGKLVPLKETIRGFKGLLAGEYDHIPEQAFYMVGGIDEVIAKAEKL

SEQ ID NO: 69877 - protein, 173 aa, Flaveria trinervia
MASIPATVAAVPQTNMVAPFTGLKANAAFPVTKKVNGFSTLPSNGGRVQCMKVWPPVGKKKYETLSYLPELTEAQLAKEVDYLLRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 69878 - protein, 132 aa, Helicobacter pylori
SNIKYELDKESGALMVDRVLYGAQNYPANYGFVPNTLGSDGDPVDALVLSDVAFQAGSVVKARLVGVLNMEDESGIDEKLLALPIDKIDPTHSYVKDIDDLSKHTLDKIKHFFETYKDLEPNKWVKVKGFEN

SEQ ID NO: 69879 - protein, 178 aa, Helianthus annuus
MASISSSVATVSRTAPAQANMVAPFTGLKSNAAFPTTKKANDFSTLPSNGGRVQCMKVWPPLGLKKYETLSYLPPLTETQLAKEVDYLLRKKWVPCLEFELEHGFVYRENARSPGYYDGRYWTMWKLPMFGCTDSAQVMKELAECKKEYPQAWIRIIGFDNVRQVQCIMFIASRPDGY

SEQ ID NO: 69880 - protein, 132 aa, Brassica napus
  misc_feature (21)..(21): Xaa can be any naturally occurring amino acid
PRVGRLALACKAKERGVHAKXLVFTIKKLVAVEKFRVGIKGFLGMGMKGLEALNFFFGGFHPYRFFPGYLQGFGLNGPSLAHLTWGFGNAPYKMGLILTNPPYFITNGCIYVAFGAKGKGLKPWFEEVFGGL

SEQ ID NO: 69881 - protein, 189 aa, Larix laricina
MASSIMALSSTAAVAAVAAPSKTGNSNVVSAFTGLKSMAQFPSSKTMSNAGAEWEQKTTSNGSRVRCMQVWPPYANKKFETLSYLPRLTPEQLVKEVEYLLKNKWVPCLEFEEDGEIKRVYGNSPGYYDGRYWVMWKLPMFGCTEASQVLNEVNECAKAYPNAFIRVIGFDNVRQVQCISFIVHKPEYN

SEQ ID NO: 69882 - protein, 470 aa, Moritella sp. PE36
MSEATANLAAEAVLADRQHRSEGDVNTTPARQQWHASIDDNDTKAMLAQDAKVFLHQAMSTPCLDALVAAEGIYLEDAAGQRYMDFHGNNVHQLGYGHPHVLTKISQQLATLSFSPRRFTNQTAIDCATKLTEICGGELNRVLFAPGGTSVIGMALKLARHITGNFKVVSLWDSFHGASLDAISVGGEACFRAGMGPLMAGVERIPPAVSYRGCFPSPDGSDVHYADYLEYVVEKEGGIGVFIAEAIRNTDVQVPSKAYWQRIRAICDKHNILLIIDDIPNGMGRTGHWFSHHAFAIEPDILCIGKGLGGGVVPIAAMITKDKYNTAAQVSLGHYTHEKSPIGCAAALATMEVIEQQNLLSKVQDDEVFVASQLAALKAQYSLIGDVRGMGLLWGVELVTCRDSQERAFDEAEAVLYHCLNAGLSFKVSQGNVIQLSPPLIITREELKRALTIFSGAIDKVSRDFGYVCH

SEQ ID NO: 69883 - protein, 439 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKEQRVAASKVLSGPQAQPVGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFSAAVAYYDSYRAAVLPAN

SEQ ID NO: 69884 - protein, 172 aa, Cucumis melo
MDTKIGSLDTCKPQNNVVCCPSNGSVCTIQNSVVPSTVVNSSDATLGRHLARRLVQIGVTDVFTVPGDFNLTLLDHLIAEPALNNIGCCNELNAGYAADGYARSRGVGACVVTFTVGGLSVLNAIAGAYSENLPLICIVGGPNSTIMELTESFIYNGLPDLSQNSKVLKRYL

SEQ ID NO: 69885 - protein, 294 aa, Lactobacillus johnsonii
MKGIILAGGLGTRLYPLTLVTSKQLLPVYDKPMIYYPLSTLMLAGIKDILVISTPADTPRFKELLGDGSQFGVNLSYKVQPSPDGLAQAFTLGEDFINGEACAMVLGDNIFYGNGFTDLLKNAAEDAQKGKATVFGYYVNDPERFGVVDFDENGNAVSIEEKPEQPKSNYAVTGLYFYPAGVSEKAAQVKPSARGEVEITSLNDMYLQDDNLGVQLLGRGYAWLDTGTMQSLVDASNYVKMIEERQGVSVSAPEEIAYIHGWINKDQLLEAAKHYGKSPYGKHLKSVAEGKVRY

SEQ ID NO: 69886 - protein, 281 aa, Desulfitobacterium hafniense Y51
MSDACGSCPSASSCTTGSCPSTQPEKTKAQQASNIKNVIAVMSGKGGVGKSSVTSMLAVSLMRQGFKVGILDADITGPSIPRIFGLRDKANMNEVGVIPGETSHRIKVMSLNLMIPNEDDPVIWRGSIITQLVQQFWTDVVWGELDYLLIDLPPGTGDVPITVMQSLPVSGVVIVTSPQQLAGMIVRKAINMVKKYDATIYGLVENMAYVACPQCEERIEIFGKPHGEAEAAQNEIPYLGQLPIDPVLATMSDLGKIEDYESAGFTQIAKNLAEVIQEKQK

SEQ ID NO: 69887 - protein, 557 aa, Gluconobacter oxydans 621H
MICLRSDIAVLLTSDSPQETPSASRPSFLEWRQNRTKAGLQQSGSPCGRKTSHSEKTSHPVPKRKTGSGKKLPIPFPIPYSEPPEVHPAASNGATMDIDRIIEKAGGADEIAALAGVGLEAVRKWRQSRMVPTKHWPALLRVPGIALQDLTADLTTTETQQEQERETDVSNPCPPGANAALVLADGTVLWGRGFGAHTEGAVGELCFSTGMTGYQETLTDPSFAGQIVTFTFPHIGNVGTNADDNEAPKMAALGAVVKEDITAPASWRSHEPFAAWLRDHGRAGISGIDTRAITRTLRDNGPQTAILAFPENGRIDTDSLLNRARQWPGLEGMDLAKEVTRPKRVWTEGVWHSTKPVRENRRRVVAMDYGAKDNILRCLVTAGCDVTVLPATATAEEILELRPEGVFLSNGPGDPAATGTYAVPAIRKVLDANVPVFGICLGHQLLAQALGGKTYKLERGHRGANQPVKDVETGRVEITSQNHGFAVDEKSLPADVKVTHVSLFDGSNEGIASTTKDAFSVQYHPEASPGPSDSFYLFERFVAVMDRRAANSTNAGA

SEQ ID NO: 69888 - protein, 286 aa, Desulfitobacterium hafniense Y51
MMNIGYLGPKGSFSEEALQLFLTTQSDLLEPPLNLIPFTTIPKLLIACQNLEIEGAFVPLENSTEGQVGVTMDMLGQTESLYIMREFIFPVDQCLITAQPLHLAQIKQVYSHEQALGQCRDFLETHLAQAEQHSSPSTAEAVTKIAQNPDQPWAAIGPRRAAEIYNLHCKSEKIQDSMLNATRFIFVGHHLAEMNEEDKTSLLIITGDTPGALAHALQEFALRNINLSRIESRPSKKKLGEYVFFVDIDGYVFSPSIQEALWALKDKGVSTKLLGSYPKAKLSAKE

SEQ ID NO: 69889 - protein, 387 aa, Aspergillus oryzae
MAPKKIIIDTDPGIDDILGLLLALSATPEEVEVLLISLTFGNIEVRSCLRNVVSMFHILEREMQWRREQGRPEGFGALRAAPPVVAVGAEDPLEDQKMLADYFLEPVPTGNPSRPSFIPSKRRAHEEILRVLRENDPDTVTLVAVGPLTNLALASAADPETFLRVKEVVVMGGAVNEPGNVTPAAEFNAYADAFAAARVYALTSPSPKTTIPTNSSLPDYPTNLSKQLTLRIFPLDITLRHGVSRGQFRKAVTPHLEKGSPLAEWVSAFMAHTFHTVEKLHTGRVGDDVELSLHDPVCVWYAITAEDEKWKPSATSPEDIRIETTGQWTRGLCVVDRRNRHRIEGDEEHSSDHGLWLSSRAGNRVWRMDASPVEDNFGAVLLERLFT

SEQ ID NO: 69890 - protein, 316 aa, Clostridium acetobutylicum ATCC 824
MNNVLCIGELLIDFICSDIDTTLSKGENFKKKAGGAPANVTAAISKLGGSASFLGKVGNDPFGHFLKETLDEVKVDTSMLIMDNNSSTTLAFVSLQANGERDFVFNRGADGLLRYDEINLDKVYSNKIIHFGSATALLGGEMTDTYLKIMEEAKKRGIIISFDPNYRDNLWENRTEEFIAISRKCIELADFVKLSDEELKIISGEKNIKNGVKLLASNNKVIAVTLGKEGTMISNGEEVEIIESIKIKSIDSTGAGDAFVGAFLYKLSEALEARDILSDFNKIKENVRFANKVGAIVCTKLGAISSLPSLSEVEGD

SEQ ID NO: 69891 - protein, 282 aa, Triticum aestivum
  misc_feature (245)..(245): Xaa can be any naturally occurring amino acid
MPLWAFFGDPYKTSFCQKNRVGTGPGFPGNFLTQRSRIWSNRHLPGCKGLKISPIGGGEMASPSSLFLASPISTAPRTRAPASPCPARPSLRPRRPSLAVAAALQAEHQPAVAVAAAPKPPALPFRVGHGFDLHRLEPGLPLIIGGISIPHDRGCDAHSDGDVLLHCVVDAILGALGLPDIGQIFPDTDPRWKGAESCVFMREAVKLMHQAGYELGNLDATLILQKPKISPFKETIRSNLCELLXGADPSVVNLKAKTHEKVDSLGENRSIAAHTVVLLMRK

SEQ ID NO: 69892 - protein, 286 aa, Arabidopsis thaliana
MEGKEEDVRVGANKFPERQPIGTSAQSDKDYKEPPPAPLFEPGELASWSFWRAGIAEFIATFLFLYITVLTVMGVKRSPNMCASVGIQGIAWAFGGMIFALVYCTAGISGGHINPAVTFGLFLARKLSLTRAVYYIVMQCLGAICGAGVVKGFQPKQYQALGGGANTIAHGYTKGSGLGAEIIGTFVLVYTVFSATDAKRNARDSHVPILAPLPIGFAVFLVHLATIPITGTGINPARSLGAAIIFNKDNAWDDHWVFWVGPFIGAALAALYHVIVIRAIPFKSRS

SEQ ID NO: 69893 - protein, 352 aa, Chlamydomonas reinhardtii
MFGAQAQAKPAHNPNGDLEVPAPGDMDSISSLTFSPTSDFFAVTSWNNSAYVWQYNQQGQTFAKAQNAGTQPVLASAWKNDGSGIFLAGCDKAVRLWDLASNQAVQVAMHDAPVKAVAWCPQMNLLITGSWDKTFRYWDTRSPTPAHTGQLPERVYAMDLREDLLVIGTADRSLHALFVNQPQQIKTLASQLKWQTRCVAVFPDKKGFLVGSIEGRVAVSHLSEQDQKDKNFTFKCHRLETDIYSVNTMSFHNQYGTFVTAGSDGTYNFWDKDSKQRLKAQAKAMYPNGQPAPITCGAFDRTGLIYGYALSYDWSKGYAEYNPTTMKPYIMLHSCKEDEVKPKPKQPTAGRK

SEQ ID NO: 69894 - protein, 463 aa, Aspergillus oryzae
MPPPPPPPPPPGGMGGPPPPPPPGALPSRPSGAEAKGRGALLSDIHKGARLKKTVTNDRSAPQIAGGGAKSSGPPIADAPPVPSMPKPPGSAPPVPGQAANRLRSDSGAGSGGDSSAALPAAPQLGGLFAGGMPKLRSRGGVDTGANRDSPYRSESQGSSAPKPPVSPAPKPPGARPPPLPSSESPPAPPVNPLVAGLKKPPPRPASRPSSTVSNASARSASDAPPPRAPPPLPGSAKPPPPPPVSSRKPSTPAPPPPPAPPSTIPAAPPPPPPPPTARPPPPAPARSTPPPPPPPPPPAASAPQPPNGTAAASIAVQAARNAFGHSQQTPSAPPPPPPASSAPSAPPPPPPSAPPSAPPSAPPSAPPSQPPSRPLSHEPLASQLPDRSTLDPSAYTLSNGGPSSGSSPLSSAVQGLIRVEDVRFKFQSEGLLPKPRPFVGGPRRYRAGRGSSVPLDLSALSG

SEQ ID NO: 69895 - protein, 347 aa, Escherichia coli CFT073
MELVRSKVMKSILIEKPNQLSIIEREIPTPSAGEVRVKVKLAGICGSDSHIYRGHNPFAKYPRVIGHEFFGVIDAVGEGVESARVGERVAVDPVVSCGHCYPCSIGKPNVCTTLAVLGVHADGGFSEYAVVPAKNAWKIPEAVADQYAVMIEPFTIAANVTGHGQPTENDTVLVYGAGPIGLTIVQVLKGVYNVKNVIVADRIDERLEKAKESGADWAINNSQTPLGESFAEKGIKPTLIIDAACHPSILKEAVTLASPAARIVLMGFSSEPSEVIQQGITGKELSIFSSRLNANKFPVVIDWLSKGLIKPEKLITHTFDFQHVADAISLFELDQKHCCKVLLTFSE

SEQ ID NO: 69896 - protein, 629 aa, Zea mays
MMRGQAWLALLVVVALALADAAAGRFVVEKNSLEVTSPDELKGKYECAIGNFGVPQYGGTLHGWVEYPKSNRKACQSFDQFDISFKPKQAGGRPIFVLVDRGECFFTTKAWNAQNAGAAAVLVVDDKSEPLITMDNPEEGKEHLENITIPSVLITKKLGENLKKSAENGDMLSVLLDWRESLPHPDERVEYEFWTNSNDECGPKCDMQMDFVRSFRGTAQILEKKGYTQFTPHYITWYCPEAFVDSKQCKSQCINHGRYCAPDPDQDFSQGYDGRNVVVQNLHQICVFKIANETGKPWLWWDYVHDFALRCPMKDKKYNNDCAHDVIKSLGLDIENINKCVGDPEADVENEILKAEQDAQIGHGKRGDVTILPTLVINNKQYRGKLDKVAVLKAICSGFEETTEPAICLSEEIQTNECLENNGGCWLDKANNVTACKDTFRGRVCECPIVRGVKFVGDGYTHCEASGIGRCEINNGGCWQETKDGKTISACSNEISEGCKCPMGFKGDGEKSCEDIDECQEKLYCQCKGCSCKNTWGSYECSCGDDNMLYMREHDTCISKEGTATTVGWSFLWVIFFGLVFAGVGAYAVYKYRLRSYMDSEIRAIMAQYMPLDNQEGANQHQVVHANDI

SEQ ID NO: 69897 - protein, 265 aa, Blastopirellula marina DSM 3645
MPQTLYQIDAFTARPLAGNPAAVCWLEQSCEDRWLQAVAAEMNLSETAFLWQEESRFRLRWFTPAVEVDLCGHATLAAAHFLWETGKAATDATIEFNTRSGVLTAVRINDRIELDFPIDEIEAGDPPTGLIAALGCKPIATGRNRRDVLVEVASEAELRSVAPDFRRLAEIRARGVIVTCRGDGENYEFLSRFFAPACGIDEDPVTGSAHCALVTYWAPKWKKQTLRAFQCSQRGGELEVTLDGDRAKLRGAAVTVLRGELDASW

SEQ ID NO: 69898 - protein, 447 aa, Bacillus thuringiensis serovar konkukian str. 97-27
MTCHDVENETKEKKDLKWWQLSLIGIGCTIGTGFFLGSSIGIKIGGSSIILILILTGFTTYIVFEALAKMAVEDPQKGSFRIYSKKAFGNWAGFSHGWTYWCSELLIMGSQLSALGIFSRYWFPKIPLWIFAAIYGVAAILIIFIGVKIFERLEKWMAIIKIAAIIGFIVIAILVILGFIKGGLYKAQIPRDFKDWFPNGLKGTWSSLIYAFYAFGGIEIMGLMTIRLKDPKDAQKSGRVMLMILTIIYVVSLGLAIMMVPLNQFNTKESPFVIALQDYNLPYVPFILNVVLILAGFSTLVGSLFAVTSVLMNLAEEGDAPAMFAKKNKKNISFPALILIIIGLGASILSALLLPKNIYEYVTTAAGLMLLYTWSLILLSFWRLMNPKGWMQIKSIIGLIMIALAVSGTLLQKTTRFGFLVSLLFLGIVIIVTIIVHFVSKKRNTAI

SEQ ID NO: 69899 - protein, 356 aa, Ustilago maydis 521
MTGQRFEFQFLLSSSISNTVFCLISTCSRTTSARIKAYGSTATTAHLTSARPTVACTDFHPPRHPFIIMSLFGTFPGSSRGPAAASALKDHMVGHQFSPYDSNGGSIAAVCGTDFCVIASDTRQSTGYNIQTRYKPKVFRLNDKATLATNGFAADAEALVSHVRQRLEMYRHAHGRSMPLHSIARMISTILYGKRFFPYYVYNILGGLDEEGKGAVYSFDPVGSYEREFCRAAGAAQSLIQPFFDNQIMFRNQTSTPERTVPTPGQMTLGEVLKIVVDSFTSATERHIEVGDGLEVFVVRTPASASGQGEGAKGAAAVDLSTLPSDVPFSVAEAVGGEDEQQQGAVMVIRRELKKD

SEQ ID NO: 69900 - protein, 390 aa, Bacillus clausii KSM-K16
MTSYSRLSDRVSEIKPSGIRRFFDLASQMENVISLGVGEPDFVTPWNIREESIFSLERGYTAYSANAGLIELREAISHYMETRFAVSYNPDTEILVTVGASEAIDLGMRAILNEGDEVIIVEPTFVSYAPLVTMAGGVPVPVGTSAETNFEVRPADIEAAVTDKTKAIMICYPNNPTGSSISKKCLEDIAAIVRKHNLFVFSDEIYAELAYDKEHVCFATLPGMKEQTIVINGFSKAFAMTGWRVGFALAPPDLLGAMLKIHQYSLMCAPTMAQYGALEALQHGMDDVERMKLSYQQRRNFFVKTAKEIGLPCHHPDGALYAFPSIAHTGFTSEEFAEALLKEERVAVVPGSVFGEGGEGHIRCSYATSLTHLEEALERIGRFLRRLELR

SEQ ID NO: 69901 - protein, 171 aa, Pinus thunbergii
MATGAGAGAATVVSAFTGLKSTAQFPSSFKMSNAAAEWEQKTTSNGGRVRCMQVWPPFGNPKFETLSYLPTLTEEQLVKEVEYLLRNKWVPCLEFDLEGSISRKYNRSPGYYDGRYWVMWKLPMFGCTEASQVINEVRECAKAYPKAFIRVIGFDNVRQVQCISFIVHKPE

SEQ ID NO: 69902 - protein, 387 aa, Escherichia coli O157:H7 EDL933
MSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDEILSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 69903 - protein, 146 aa, Brassica napus
  misc_feature (133)..(134): Xaa can be any naturally occurring amino acid
MSPASSLRRLAVGAAVIAAASGGGAVYLSPSVASSDRGGGPVLDSLRRRIGDPNASVPSRSAQESVLIGASASDPLDVLVIGGGATGAGVALDAVTRGLRVGLVEREDFSSGTSSRSTKLIHGGVRYLEKAVXXLDYGQLKLVIHA

SEQ ID NO: 69904 - protein, 339 aa, Escherichia coli O157:H7 EDL933
MTVRVAINGFGRIGRNVVRALYESGRRAEITVVAINELADAAGMAHLLKYDTSHGRFAWEVRQERDQLFVGDDAIRVLHERSLQSLPWRELGVDVVLDCTGVYGSREHGEAHIAAGAKKVLFSHPGSNDLDATVVYGVNQDQLRAEHRIVSNASCTTNCIIPVIKLLDDAYGIESGTVTTIHSAMHDQQVIDAYHPDLRRTRAASQSIIPVDTKLAAGITRFFPQFNDRFEAIAVRVPTINVTAIDLSVTVKKPVKANEVNLLLQKAAQGAFHGIVDYTELPLVSVDFNHDPHSAIVDGTQTRVSGAHLIKTLVWCDNEWGFANRMLDTTLAMATVAFR

SEQ ID NO: 69905 - protein, 266 aa, Gossypium robinsonii
LSVEEIEVAPPQKNEVRVKIHFTSLCHTDVYFWEAKGQNPLFPRILGHEAGGVVESVGEGVMDVQPGDHVLPIFTGECKECPHCLSEASNMCDLLRINTERGGMLHDGQTRFSKDGKPIYHFLGTSTFSEYTVVHVGQIAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 69906 - protein, 273 aa, Ustilago maydis 521
MSRVELLNAGGFRIDGRKQFELRSIGIQLGGSQDTAADGCAQITQGLTIVSATVFGPREARSGANVMHDRASVNVEVSVAPWGSMERRRRNRGDRRLVEFANSIKSTFEPVIHTHLYPRSQIDIFVQVHQQDGGVLPAAINASTLALLDAGIAMQDFVASVSCGIHSTSAMLDLSNTEEQDLPHVTVAVLPRTKQITLASLETRLHVERFEQIFTLAIQAVAVLHNEMELAVRDRTKTLVHAMTGRTIESETAVHHDQDAEHDSPDHDDIMLA

SEQ ID NO: 69907 - protein, 183 aa, Pyrus pyrifolia
MASSMISSGTVATVSADRPAPAQARMVAPFNGLKSSSAFPVTRKSNDITSIASNGGRVQCMQVWPPLGLKKFETLSYLPPLSSESLAKEVDYLLRKNWVPCLEFELETGFVYRENHRSPGYYDGRYWTMWKLPMFGCTDSSQVLKELEEAKKAYPQSFIRIIGFDNVRQVQCISFIAYKPAGF

SEQ ID NO: 69908 - protein, 196 aa, Selaginella lepidophylla
MADTEFFTEYGEASRYKIQEVIGKGSYGVVCSAIDTHTGEKVAIKKINDIFEHVSDATRILREIKLLRLLRHPDIVEIKHIMLPPSRREFKDIYVVFELMESDLHQVIKANDDLTPEHYQFFLYQLLRALKYIHTGNVFHRDLKPKNILANAYCKLKICDFGLARVAFNDAPTAIFWTDYVATRWYRAPELCGSFF

SEQ ID NO: 69909 - protein, 181 aa, Raphanus sativus
MASSMLSSAAVVTSQLQATMVAPFTGLKSSAAFPVTRKTNTDITSIASNGGRVSCMKVWPPIGKKKFETLSYLPDLSDVELAKEVDYLLRNKWIPCVEFELEHGFVYREHGSTPGYYDGRYWTMWKLPLFGCTDSAQVLKEVQECKKEYPNALIRIIGFDNNRQVQCISFIAYKPPSFTDA

SEQ ID NO: 69910 - protein, 266 aa, Gossypium raimondii
LSVEEIEVAPPQKNEVRVKIHFTSLCHTDVYFWEAKGQNPLFPRILGHEAGGVVESVGEGVMDVQPGDHVLPIFTGECKECPHCLSEASNMCDILRINTEWGGMLHDGHTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 69911 - protein, 177 aa, Silene latifolia subsp. alba
MASLMSNAAVVTASTAAQANMVAPFSGLKSTSAFPVSRKSNVDITSLATNGGRVNCMQVWPPRNLKKFETLSYLPTLSEESLLKEINYLLIKGWVPCLEFEVGPAHVYRENNKSPGYYDGRYWTMWKLPMFGCTDASQVAAEVVECKNAYPDAHVRIIGFDNKRQVQCISFIAYKPE

SEQ ID NO: 69912 - protein, 570 aa, Frankia sp. EAN1pec
MGARTARHTTALLRGRASNAMANTESTALAAGTVVDRTPEWAALAAHHAEISGVTLRKLFADDPGRADSFTVEADGLRLDYSKNIVTARTVELLLALARRAGLGARIEAMFGGERINVTENRPVLHVALRTPLGTSIHVDGVDVVPEVHAVLDRMSAFCDRVRSGVWTGATGEHITTVVNIGIGGSDLGPAMAYQALRDYSDRSIAVRFVSNVDPTDIWEATHDLDPARTLFIVASKTFTTLETLANARAARAWLTAALGQDAVAHHFVAVSTNAEKVAEFGIDTANMFEFWDWVGGRYSMDSAIGLALMVAIGPHHFREMLAGFHAMDVHFRNTPFERNLPVLLGVLGLWYRDFFGAQSHAVLPYSQYLDRFPAYLQQLDMESNGKSVDLAGRPVPVPTGPVVWGTPGTNGQHAYFQLLHQGTTVVPADFIGFLAPNHPGVGDVDQHVLLMANFFAQTEALAFGRTAEEVAAEGVDAALVPHRTFAGNRPTNTLLAPKLTPFALGQLVALYEHKVFTQGVVWGVNSYDQWGVELGKVLAGRIIPELADPSAPPRHDSSTNALINLFRSV

SEQ ID NO: 69913 - protein, 320 aa, Magnaporthe grisea 70-15
MENYQKLEKIGEGTYGVVYKARDLLNGGRIVAMKKIRLEAEDEGVPSTAIREISLLKEMRDPNIVRLFNIVHTDGTKLYLVFEFLDLDLKKYMEALPVADGGRGKALPEGTGPQLSRLGLGDTMIKKFMSQLCDGVRYCHSHRILHRDLKPQNLLIDREGNLKLADFGLARAFGVPLRTYTHEVVTLWYRAPEILIGGRQYSTGVDMWSVGCIFAEMCTRKPLFPGDSEIDEIFKIFRLLGTPTEETWPSVTDEHIYPDFKPSFPKWQRDPNMKLCPGLNDAGLDLLEMMLVYDPAGRISAKQACNHPYFEDNTPAPPRR

SEQ ID NO: 69914 - protein, 265 aa, Gossypium hirsutum
LSVKEIEVAPPQKNEVRVKIHFTSLCHTDVYFWEAKGQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQELIAEMTGGVDCSIECTGSTQAMVSAFECVHD

SEQ ID NO: 69915 - protein, 347 aa, Arabidopsis thaliana
MEEEKAAAYYDELTRKGEGAARFKQGLGFSTGANAVPERGSAIASSSSFLNQFVKASNHTKSTDNKDSEIRSIRDKLKKKPEDPRVPERSYRESSERRRYRSRERDERDKSHRRRSRSSERRSSYVDRERRRSRSRSAERRNRYGDRESRRRSNRSRSLSPRRERRSREDVKEKKPDYSRLIKGYDEMSAAEKVKAKMKLQLDETAEKDTSKGAGWERFEFDKEAPVDDEELEEGADDDAALVKRMGQSYRASDSLYGLIKTCKAKREEQLKAAHDEAMFGVPTGQTPTENTGDDVTEITNVKDDEGESNSGAISLLSEKVKICELSSFLLLSNQSRFLELHFRVCT

SEQ ID NO: 69916 - protein, 251 aa, Oryza sativa
LQVITLTEELLATANQSGNTQNDVGLSPPNYSSGLQSEALDDPSQSHEKFAVGTKVQAVWSEDGEWYNATIEELTENGYYVSFEGWGNKEEVDPANVRSLEEEAADALRQAEKEAEATKMAIKRKIEQAATSDFQMRSLPTKLRIDPNDPEDVKATKRKKIHAFKSKARFEQLEFAQNKRQNAWQQFQTTKGKAKKVGFFSGRKKESIFKSPDDHRGKVGVTGSGKGLTEFQRREKHLHLKDGSSDALDEE

SEQ ID NO: 69917 - protein, 194 aa, Oryza sativa
  misc_feature (164)..(164): Xaa can be any naturally occurring amino acid
MSAKIGKPAPEFKATAVVDGNFKDVSLKDFKGKYVVLFFYPLDFTFVCPTEIISFSDRIEEFRQINCEVLACSTDSHFSHLAWVNTNRKQGGLGKMNIPLIADKNLEISTKYGVLKDDEGIAFRGLFIIDPNGTLRQITINDLPVGRSVDETLRLVQAFQFTDXHGEVCPANWKPGKKTINPDVSKSKEYFEHA

SEQ ID NO: 69918 - protein, 155 aa, Clostridium acetobutylicum ATCC 824
MRVGIGYDVHKLVENRKLILGGVEIQYSKGLLGHSDADVLVHAIIDSILGAAGLGDIGKLFPDSDNKYKGISSLKLLKEVNALIKDKGYKIGNIDSTIIAQKPKISPYIEDIKKSLCNVLDIDLGSINIKATTEEGLGFTGRGEGISSQSICLLI

SEQ ID NO: 69919 - protein, 79 aa, Triticum aestivum
PDILENFSKEYMYLACVAYVKKVKKGPFVEHSPMLDDISGVANWKKVNSGLLKMYKAEVLEKVPIMQHFLFGSLIKWED

SEQ ID NO: 69920 - protein, 183 aa, Aspergillus oryzae
MGLTFSKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDALLLVFANKQDLPNAMSPAEITQQLGLQSLTRRAWYIQSTCATTGDGLYEGLEWLADALRKAGRD

SEQ ID NO: 69921 - protein, 303 aa, Candida albicans SC5314
MLRRTPCVIRQVTRTSIRNSSSNSGSTSALAYKTLHRNQKRPPLPTLETPNWSADTAVSSILYETPVPSKAPPKQHVLNCLVQNEPGVLSGVSGTLAARGFNIDSLVVWNTEVKDLSRMTIVLKGQDGVVEQARRQIEDLVPVYAVLDYTNAEIIKRELLLARVSLLGPEYFQELIATHQLHIDDGSSIPDIDACESAYHPNNLAPSEALRQKHIHLDHISTLTKQFGGKIVDISDRNVVVELSAKPSRVSSFITLLHPFGILELARSGMMALPRTPLNSFTEVEEESIDAADIVDASQLPPG

SEQ ID NO: 69922 - protein, 333 aa, Aspergillus oryzae
MTVMQFDQEQLDEIYAFAVDLGRKAGQLLLESIEKRIAGEGSQSVEEKENAVDIVTQTDEDVEVFIKTAINEKYPTHKFLGEETYAKGQSRDYLIDEQPTWCIDPLDGTVNFTHIFPMFCVSIGFIVNHKPVIGVIYAPFQDQLFSSCINRGAWLNEKRRLPLIHKPSIPPMPPNAPSKCVFSCEWGKDRRDIPDGNMHRKIESFVNMAAEIGGRNGKGGMVHGVRSLGSATLDLAYTAMGSFDIWWEGGCWEWDVAAGIAILLEAGGLVTTANPPADPETAPIEDVRLGSRLYLAIRPAGPSATETGRQTQERTVREVWKRVRQLEYTRPGA

SEQ ID NO: 69923 - protein, 127 aa, Moritella sp. PE36
MAYSEKVIDHYENPRNVGSFDKNDPSIATGMVGAPACGDVMKLQLKINDDGIIEDAKFKTYGCGSAIASSSLVTEWVKGKSIEQAGEITNMTIAEELELPPVKIHCSILAEDAIKAAIDDYKKKKAS

SEQ ID NO: 69924 - protein, 266 aa, Gossypium barbadense
LSVEEIEVAPPQKNEVRVKIHFTSLCHTDVYFWEAKGQNPLFPRILGHEAEGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 69925 - protein, 418 aa, Saccharomyces cerevisiae YJM789
MSATLFNNIELLPPDALFGIKQRYGQDQRATKVDLGIGAYRDDNGKPWVLPSVKAAEKLIHNDSSYNHEYLGITGLPSLTSNAAKIIFGTQSDAFQEDRVISVQSLSGTGALHISAKFFSKFFPDKLVYLSKPTWANHMAIFENQGLKTATYPYWANETKSLDLNGFLNAIQKAPEGSIFVLHSCAHNPTGLDPTSEQWVQIVDAIASKNHIALFDTAYQGFATGDLDKDAYAVRLGVEKLSTVSPVFVCQSFAKNAGMYGERVGCFHLALTKQAQNKTIKPAVTSQLAKIIRSEVSNPPAYGAKIVAKLLETPELTEQWHKDMVTMSSRITKMRHALRDHLVKLGTPGNWDHIVNQCGMFSFTGLTPQMVKRLEETHAVYLVASGRASIAGLNQGNVEYVAKAIDEVVRFYATEAKL

SEQ ID NO: 69926 - protein, 273 aa, Gibberella zeae PH-1
MKITYGTRLKDKVCIVTGSSSGFGRAIALGYSLEGALVVCADLQQGARADVNGEQAISTHELIKQKGGKAIFVQTDVSKNDAVENLVYRAVAEFSRVDVVVNNAGISIESGKPSRRIHDTPEEWWNTTMAVNLKSIFLLSKHAITQMLKQEKNEAGDRGWIINIASIFGLVGGYALPSYVASKGGAQNLTRSIALDYAKDGIHCNAICPGFAETALLADAVKIHDKEAIRSKHPLHGLGTAEDIVGAAIFLASAEARWITGVRLPVDGGYTAQ

SEQ ID NO: 69927 - protein, 326 aa, Chlamydomonas reinhardtii
MDKYEKLERAGEGTYGVVFKARDRYTNEIVALKKIRLEQEDEGVPSTAIREISFLKELRHDNVVRLYDVLYSDRRLYLVFEFLDLDLKKQMDQTPNFSRNQRVIKMYMWQMLSGIAFCHSRRILHRDLKPQNLLIDRSRNTLKLADFGLARAFGIPVRAYTHEVVTLWYRAPEILLGSKTYSTPVDIWSIGCIFAEMVNHRPLFPGDSEIDQLHKIFQLLGTPDEAMWAGCSALPDFKDTFPKWRPQNLGAAVPTLSPEGVDLLARMLVYTPQHRITASAAMEHAYFNEIRDTMRAAVAPGGGGMGGGMGGMGAMGGMGGGMGVMR

SEQ ID NO: 69928 - protein, 266 aa, Gossypium tomentosum
LSVEEIEVAPPQKNEVRVKIHFTSLCHTDVYFWEAKGQNPLFPRILGHEAGGVVESVGKGVIDVQPGDHVLPIFIGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPVQEVIAEMTGGGVDCSIECTGSTQAMVSAFECVHD

SEQ ID NO: 69929 - protein, 457 aa, Thermococcus thioreducens
MARKVLVALLVLLVVLSLSAVPAKAETLENGGVIMQAFYWDVPMGGIWWDTIAQKIPDWASAGISAIWIPPASKGMSGGYSMGYDPYDYFDLGEYYQKGTVETRFGSKQELVNMINTAHAYGMKVIADIVINHRAGGDLEWNPFVNDYTWTDFSKVASGKYTANYLDFHPNELHAGDSGTFGGYPDICHDKSWDQYWLWASNESYAAYLRSIGIDAWRFDYVKGYAPWVVKDWLNWWGGWAVGEYWDTNVDALLNWAYASGAKVFDFPLYYKMDEAFDNNNIPALVDALRYGQTVVSRDPFKAVTFVANHDTDIIWNKYPAYAFILTYEGQPMIFYRDYEEWLNKDRLKNLIWIHDHLAGGSTDIVYYDSDELIFVRNGYGSKPGLITYINLGSSKAGRWVYVPKFAGSCIHEYTGNLGGWVDKWVDSSGWVYLEAPAHDPANGQYGYSVWSYCGVG

SEQ ID NO: 69930 - protein, 178 aa, Trifolium repens
MALISSAAVTTINRAPVQANLATPFTGLKSSAGFPVTKKNNDITSITSNGSRVNCMQVWPPVGKKKFETLSYLPPLTDEQLLKEVEYLLRKGWVPCVEFELEKGFVHRQYNSSPGYYDGRYWTMWRLPLFGTTDAAQVLKEVAECKAEYPEAFIRIIGFDNVRQVQCISFIASTPKVY

SEQ ID NO: 69931 - protein, 323 aa, Oryza sativa Japonica Group
MAGRSELVVSFGEMLIDFVPTVAGVSLAEAPAFVKAPGGAPANVAIAVARLGGGAAFVGKLGDDEFGRMLAAILRDNGVDDGGVVFDAGARTALAFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 69932 - protein, 267 aa, Moritella sp. PE36
MHPMLTIAIRAARDAGNVIVKAYGDPSKTKVEQKGTNDFVTNVEKEAEAAIIATIKKAYPEHTIIAKDSGATTGADTDYQWIIDPLNGHINFIKGIPHFAVSIALHVKGKAEVAVIFDAIGDEIFSACRGKGAQLNGFRLRAGSAKDLSGTVLATGFPHSMKHQQDTYMNIFGALFSECADIRAAGCPALNLAYLAAGRIDGLWSMGQKPWETAAGNLIATESGAIVTDFAGGHDFFKSGNSVAASPRVLKDMLAKIRPNLTESLAK

SEQ ID NO: 69933 - protein, 549 aa, Oryza sativa Japonica Group
MAAAAARRGSSLLSRCLLSRPAAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAANIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQVKAVVTPIKNAAWL

SEQ ID NO: 69934 - protein, 266 aa, Zea mays
MNGLLVLFFAYPLQAVEVSSNEYEPSEKDVIFAEGVTQGNGLAFIEFTLDDRSPMSEPYIDNSEAHSQPLTKYQLIRVSAKGMNDGCKWVEMFEDVRMVIFCVALSDYDQLGPPVSGSSRPLVNKMMQSKELFEATIRQPCFCDTPFVLVLNKYDLFEEKINRAPLSSCEWFNDFCPVRTHHNNQSLAHQAYYYVAMKFKDLYSAQTNRKLFVWQARARERQTVDEAFKYIREVLKWEEEKDDNCYQEESFYSTTEMSSSPFIRAE

SEQ ID NO: 69935 - protein, 266 aa, Gossypium mustelinum
LSVEEIEVAPPQKNEVRVKIHFTSLCHTDVYFWEAKGQNPLFPRILGHEAGGVVESVGEGVMDVQPGDHVLPIFTGECKERPHCLSEASNMCDLLRINTERGGMLHDGHTRFSKDGKPIYHFLGTSTFSEYTVVHVGQVAKINPEAPLDKVCVLSCEMSTGIGATVNVAKPKKGGSVAVFGLGAVGLAAAEGARVCEASRIIGIDLNPNRFEEAKKFGCTEFVNPKDHNKHVQEVIAEMTGGGVDCSIKCTGSTQAMVSAFECVHD

SEQ ID NO: 69936 - protein, 266 aa, Gossypium darwinii
LSVEEIEVAPPQKNEVRVKIHFTSLCHTDVYFWEAKGQNPLFPRILGHEAGGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVYVLSCGMSTGFGATVNVAKPKKGGSVAIFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 69937 - protein, 266 aa, Gossypium hirsutum
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 69938 - protein, 467 aa, Nostoc punctiforme PCC 73102
MTSAIDKNSQLEAQAWELLEESVIFYQGKPIGTVAAHDPESDALNYDQCFLRDFVPSALVFLMYGKAEIVRNFLVETLKLQSHEKQIDCFEPGAGLMPASFKVHFNGNEEFLVADFGEQAIARVPPIDSCMWWILLLRAYEKATGDLSLARQPDFQAGIKLILDLCLVHRFSMYPTMLVPDGAFMIDRRMGVYEHPLEIQVLFYASLRAASELLLPDGDGDSYLGKVNRRLGSLKYHIRNYYWLDLKRLGEIYRYKDNEFGKEIVNKFNINSESIPSWLTEWLPETGGYLAGNLGPGRIDFRFFALGNLMAILTSLASEKESQSIMNLFVQRWQDLIGYMPVKICFPALEGLEWRIVTGCDSKNRAWSYHNGGNWPVLLWLFASAAQKAGRTELAQAAIAIAERRLLKDKFPEYYDGNNGRLIGKEARINQTWSIAGLLTAKKFVENPDYLELISFAEGLEVPGCSL

SEQ ID NO: 69939 - protein, 85 aa, Escherichia coli
MSKQQIGVVGMAVMGRNLALNIESRGYTVSIFNRSREKTEEVIAENPGKKLVPYYTVKEFVESLETPRRILLMVKAGAGTDAAID

SEQ ID NO: 69940 - protein, 253 aa, Desulfitobacterium hafniense Y51
MKDCCGGYESEELLMDFSGKDKAAYVQDTFNSIAKRYDVMNTLMSFGLDKGWRKKAVQTVEAKPGMTMVDICCGTAQLSLELAMTVGEQGQITGLDFSENMLKKAQENLAGSPYRSIIELRQGDAMNLPFADNSFDGATVGWGLRNLPDLEKGVQEMIRVVKPGGMVVSLDMAKPTMPGFKQGYWLYFNKLVPLMGKIWAGKAKAYQYLHDSAVEFPSQQELANIFARCGLTETRYQNLAGGVVAIVSGRKPR

SEQ ID NO: 69941 - protein, 325 aa, Arabidopsis thaliana
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYHNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFVGALLNQIVDDRSVLEDEERLRKVLRFANACGAITTTKKGAIPALPSDAEVRSFLEKK

SEQ ID NO: 69942 - protein, 375 aa, Rhodococcus ruber
MKTKGAILWGLNEPWSVEEIEIGDPVAGEVQIRMEAAGMCHSDHHIVTGATPMPSFPVMGGHEGSGVITKVGDGVVGLEVGDHVVLSFIPACGRCPSCATGHSNLCDLGAGLLSGMAISDGTYRIQARGQHVIPMCLLGTFSPYMTVNQTQVVKIDKDVPFELAALVGCGVPTGWGSATHVADVKPGEAVAVIGVGGVGISALQGAVASGARQIFAIDPVPWKREQALKFGATHALPRRWRALMPIMETTWGRMADKTIITVGEMRGEYVEEALQLTAKNGRCVVTAMGHMTDMDVKLNAFLFAMLQKDLQGNIFGGCNARVDIPNLLAMYKAGQLNLADMVTRTYTLEQVNDGYQDMLDGKNIRGVIRYTDADR

SEQ ID NO: 69943 - protein, 327 aa, Desulfitobacterium hafniense Y51
MQKIKLIATGGTIAMRKDSFGKTVPAVTGHDLLESIPELQESAFWDVEEFSNLASCNFNPERMLQLARRVKEAFADPDCMGIIITHGTDTLEETAYFLELTVKDSRPVILTASQRDASERDSDGPRNLHNSMRIAMDPHAKERGVLIALNEEIHAARDVRKLHTSHVDAFSSGEVGSLGSIDHDEVLWHRKPEPSVKFDLPEKLAKVMICKGYTGMDGRMLECMVDAQVEGIVIEAFGRGNLPPEVVPSIGKITAENIPVVITSRCLFGRTAPVYGYPGGGAELQRRGALFAGDLSTEKVRLLLSIALGQNVSHTRLKEILSRGGVK

SEQ ID NO: 69944 - protein, 324 aa, Pseudomonas putida KT2440
MATRIILNSTGAADVMQLEHVAAQSPGPGQVWLEQTAMGVNPLDVLQRKGGAALALPSGLGLEGAGRVSAIGDGVHNVQVGDRVAYAMGPVGAYASGRLFPAERLVPLPPQLEDEAAAAVLFKGITAQYLLKTTYAVGPGTQVLLYGAAGALGQLMVPWARHLGATVIGVVSRLQSVERARAAGCQHVLVFDAKTLASQVRELTQGQGVAVVYDCVGKVSLEASLGSLRVRGLLVSFGGTSGAPPAIEVATLNANGSLYLTRPSLAAHTRTVEEYQQRAADVLAAVAEGIVQPRVWRCFPLAEAAKAHECLEQGRSEGALVLTA

SEQ ID NO: 69945 - protein, 393 aa, Clostridium acetobutylicum ATCC 824
MDKILFDIALILIFTKIGSLISIHFKMPGVLGELIAGVILGPFILNLIQANADIKLLSDLGVVFLMFLAGIETNLDELKKAGKSSFLIALGGIIIPLIVGTLSAYMFFSNFYENLFVGVILTATSVSISVQTLTELGKLNTRSGINILGAAIIDDVLGLILITVVLAISGGTKSHGSSIFMTFIYIGIFCLVSLLAIAFLPKPIDKLTQKFKPQKGLAIFSIAAALICAFTAEKLGIAAITGAYICGLVLSPITHKEYIEKRVKIISTSFLSPIFFASVGISASVKGLNFEVLLITLIMFIIAVIGKILGCSASALTLKFKKSEALQIGVGMVSRGEVAIITANIGLQAKIISEEIFLPTLIVVILTTVITPILLKIVFSHKTQKLIDKETLT

SEQ ID NO: 69946 - protein, 309 aa, Chlamydomonas reinhardtii
MQSLTKHGAFQRRASIQRAGGAPVRGLRASRPCTVSVAAAATVTKLETGAWVVAPQYRSKGVVHFLGGAFAGAAPQVVYSLLLDSIADAGYTAIATPYAVTFRHDDCARAVRQQFLDSVAELRGPAGLPDAAPDGVPVIGLGHSNGALLHLLIGAFFPGAAATNIVISFNNKQVKDAIPVPGLMENLPGAVGGGATDFYPTPAESRAIIGGSYGVSPTLVVRFADDSIDESLEMSALLKSRLGAGVTQITLPGSHITPCGGDVPWPTGPIFTPVDTIAQVVKEQQQADILRLSKQLVGWMDMVSVQQAA

SEQ ID NO: 69947 - protein, 1013 aa, Bacillus cereus G9241
MGEHKNTTNIVPTLTMNRFITPLHFPHSIPQFPPTICKKYLFDIIRKNFPRNFKFIEDWYELCRKYSLSNIQLCNSRSICKVTFRNISAFLSGGVSMKKTTSTLLSMALVFSSFGALSAHAESLQKEKQFSPQLKMNIEQWGENKIAQNVETKTSKEISVIVELQHAPLASQSNIQHAPDLQNNHAQSYHAELKKAQEDTTKKIKEKAPSAKIKEVYNTLFSGFSISVPGDQITALASLPEVKAVYPNLTYKLHETSKSTTNEEAPNIGGPTIGAPEAWNLKDPSGKPLDGKGMKVAIIDSGVDYTHPDLKANYIGGYDTVDEDNDPMDGNVHGTHVAGIIAGNGKIKGVAPNASILAYRVMNDGGTGTTEDIIQGIERAIQDGADVLNLSLGQDLNVPDQPVTMTLERAVKLGVTAVVSNGNDGPHPWSVDAPGNANNVISVGASTVSIPFPTFQVAGSSKTYQGLPLSKSDFPIGNDSPLVYVGYGNPSDYAKQDVKGKFPLVLQGTSSTLVKAEQAKQAGAVGVLFISTEKEINIMPEYFMRENLALPVMQLSNVNGEELKNLITKRKKNIKIGQPNPTELIANFSSRGPSQGSWLIKPDIIAPGVQITSTVPRGGYESHNGTSMAAPQVAGAVALLRQMHPDWTTEQLKASLANTAKTLKDVNENTYPIMTQGSGLINIPKAAQTDVLVKPNNVSFGLIKPNSGKVKLTQNITLQNLSSKKKSFSTRVELLDTNTKTKVKTSVPSSISIQPNSSAEKPFTITVDSSLPQGVYTGNVYIKEQGKKEETRIPFTFNIDPKDYKRIDGLEIINSTFSPNGDQILDDNLINYYLVAPVDDVTLHANLVTKERVTYQGIIHQAKNETAGYKPFKWNGTKTDGTPLADGLYQIEAVASNSGGETKQTAAVFLDRTAPKLTYEIDQENLVITGKVDDILLDWMTESGWVAPGIPVRLQYEINGNGVWESAFLNPWEKNYGIYLDPTQLQEGKNTIHIVATDAAGNTSNLNVDLDVK

SEQ ID NO: 69948 - protein, 293 aa, Chlamydomonas reinhardtii
MDKFEPVADLGSGNFGVAKLMRDRASGQLVAIKFIERGERVDRNVEREICNHRMLNHPNIVAFMEVFLTPSHLGIVMEYAAGGELFERIVRAGRFSEDEARYFFQQLISGVDYCHASGVCHRDLKLENTLLDGNPAPRLKICDFGYSKSAFDSQPKSTVGTPAYIAPEVLQRKEYNGQPADVWSCGVTLYVMLVGAYPFEDPADPRNFRKTIQRIMNVKYSFPPQLAISAECADLIGRIFVANPAQRIAIADIRRHPWFLKNLPAELADPNNFSRSPEPHQSLDEIRALIRAA

SEQ ID NO: 69949 - protein, 266 aa, Gossypium tomentosum
LSVEEIEVAPPQKNEVRVKIHFTSLCHTDVYFWEAKGQNPLFPRILGHEAGGVVESVGEGVMDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 69950 - protein, 132 aa, Helicobacter pylori
SNIKYELDKESGALMVDRVLYGAQNYPANYGFVPNTLGSDGDPVDTLVLSDVAFQAGSVVKVRLVGVLNMEDESGMDEKLLALPIDKIDPTHSYVKDIDDLSKHTLDKIKHFFETYKDLEPNKWVKVKGFEN

SEQ ID NO: 69951 - protein, 266 aa, Gossypium mustelinum
LSVEEIEVAPPQKNEVRVKIHFTSLCHTDVYFWEAKGQNPLFPRILGHEAGGVVESVGEGVTDVQPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 69952 - protein, 169 aa, Triticum aestivum
  misc_feature (55)..(55): Xaa can be any naturally occurring amino acid
  misc_feature (74)..(74): Xaa can be any naturally occurring amino acid
MAKARKQTAFSAAERFLGFHHRPGSATVAPSPYDDLPDLAESDVWYSPSSDAPTXHRGSGRDSAHGQGAQGRAXRRVGGLSRAFADGRQVASSAPVEVPAWPSRFADLELEPEPDEQQQDDADGWVPPHVYLARRQARASVVEGVGRTLKGRDASRVRDAVWSRTGFPG

SEQ ID NO: 69953 - protein, 302 aa, Oryza sativa Indica Group
MADGPWPMVPHVSLLPRPGILAKTEDEEERKKGWKVKRFDSRSHRLDHASCVASITPPVDRSSLQTLRRKDRSELQKPSRQDRPDEILRLADYHATGLSSRLVASRCLASQGVEPSRPSGQPPAGGGAARPHRPIDGSAAPGVYRLQPAALLLERVRLSSPLVGDSDMAGRGKAIGAGAAKKATSRSSKAGLQFPVGRIARFLKAGKYAERVGAGAPVYLAAVLEYLAAEVLELAGNAARDNKKTRIVPRHIQLAVRNDEELTKLLGGATIASGGVMPNIHQHLLPKKAGSSKASTVDDDDN

SEQ ID NO: 69954 - protein, 334 aa, Xanthomonas axonopodis pv. citri str. 306
MTASTDRYAASLRLSVAPMMDWTDRHCRVFHRLLAPSARLYTEMVHANAVIHGDRARLIGFDPVEHPLALQLGGSDPALLAQAAAIAQEWGFDEINLNCGCPSDRVQAGRFGACLMREPALVAECVAAMCAATHLPITVKCRLGVDDDDDYALFARFVDQVVAAGAAMVVVHARNAWLKGLSPKENREVPPLRYDWAYRLKQERPGLPVVLNGGIVAVEPAIAHLQHADGVMLGRAAYHDPYVLHCLDAALNQRPEQPRESLLRAYQPYVESQLAQGLGLKHMTRHVLGLFHGQPGGRAFRQVLSEGAHRPGAGWELVEQALERTDTRSWRVVA

SEQ ID NO: 69955 - protein, 272 aa, Gossypium barbadense
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMTYSSSLLAGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 69956 - protein, 132 aa, Helicobacter pylori
SNIKYELDKESGALMVDRVLYGAQNYPANYGFVPNTLGSDGDPVDALVLSDVTFQAGSVVKARLVGVLNMEDESGMDEKLLALPIDKIDPTHSYVKDIDDLSKHTLDKIKHFFETYKDLEPNKWVKVKGFEN

SEQ ID NO: 69957 - protein, 376 aa, Oryza sativa Japonica Group
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVQVLIEMTNGGLDRAVECTGNINAMISCFECVHDGWGVAVLVGVKDDVFKTHPMNFLNEKTLKGTFFGNYKPRTDLPNVVELYMKKELELEKFITHSVPFSEINTAFDLMLKGESLRCVMRMDE

SEQ ID NO: 69958 - protein, 272 aa, Gossypium darwinii
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMTYSSSLLAGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAVVSAFECVHD

SEQ ID NO: 69959 - protein, 468 aa, Clostridium perfringens str. 13
MSNLKKKRVKSREQDPIERGKNFKEVSLGYGEEEAIEEANRCLGCKNPKCVEGCPVSVNIPSFISFIKKGDFSASFEELSKYNALPAVCGRVCPQESQCEGKCVLGIKGEPLAIGQLERFIADFARNNKLSSLKKSEKILEKVAVIGSGPAGLTCAGELAKLGYRVTIFEALHESGGVLVYGIPEFRLPKKDVVKYEIEEIKKLGVKIENNVVVGKTVDIDELIENEGFKAVFIGSGAGLPKFMGIKGENANGVFSANEVLTRVNLMKAFKNESHTPLNLGKKVAVVGGGNVAMDAARTSLRLGAETHIIYRRSEKELPARLEEIHHAKEEGVILDVLTNPTEILTDEKGWVKGIKCIRMKLGEEDSSGRRRPIEIENSEFIMEVDSVIMSLGTSPNPLISNATKGLKTNKRGCLLVDEESLKTSLKGIYAGGDAVTGAATVILAMGAGKKAAKSIDSYLRKEEQNNI

SEQ ID NO: 69960 - protein, 297 aa, Oryza sativa Japonica Group
ELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFECVHDGWGVAVLVGVAGKDAAFKTHPTNFLNERTLRGTFFGNYKPRTDLPGVVEMYMNKELELEKFITHSVPFSEINTAFDLMLSGESLRCIIRMED

SEQ ID NO: 69961 - protein, 498 aa, Oryza sativa
  misc_feature (196)..(196): Xaa can be any naturally occurring amino acid
LPSPTTLFLSPIPLSSRRAGNVPPPPPEPAGLPLVGHLHLFRKPLHRTLARLAARHGGAVFGLRLGSRRVAVVSSAPAAEECLGAHDVAFADRPRLPSGRILSYDWSTMGTASYGPYWRHVRRVAVTEILSARRVQHFADVHVREARAMARHLHRAAVRHGVGGAARVRVELKSRLFELLMNTMMAMICDKTYYGXSDDDGKVSKEARWFREMVEETMALSGASTVWDFLPAALRWVDVGGVGRRLWRLRESRTRFLQGLINDERKEMEQEQGGDRAQPAARRRTMIGVLLSVQRQDPDACPDQLIRSLCISSLEAGTDTSADTIEWAMSLLLNNPNVMRKARDEIDAFIGQPCIIMETLRLYPPAPLLVPHEASTDCSIAGFHITRGTMLLVNTFAIHRDPQVWNEPTSFIPERFENGRSEGKMAIPFGMGRCKCPAENLGMQMVGLALGTMIQCFEWERVGEELVDMTEGSGLTMPKEVPLQAFYQPRASLMHLLY

SEQ ID NO: 69962 - protein, 567 aa, Oryza sativa Indica Group
MGCVLEVDVDGEEVFLVDKEVLAPFCGRIKNLGGGGAGGEGVVGAAAAARVVLRGFPGGAEAFELVARFCYTGGGGGVAVTASNACALRCAAEFMDMAAAAAEVSTPPSLVKMTEKALDEMPQWSWQSVVDAVRQCQRLLPTADATGVFDRVVGALVSHVAVSPGDATPTSSSPESSAFRFSCDTKSSCLSARCTSRTWWFEDLAVVLGPGMVERVAGALLARGTDHGVVSRFLFYYLKCRVAGAATADDKRAMLEAAIAAMSGLDRSSVSCRGLFGILRVSSPLKLPTSCHDSLVAMIGAKLDHATLDNLLVPAPPGTTSSLYDVTLVLRFLDAFLHQAAATGARGETPRLKKVGKLVDLYLAEVAPDPSLRPAMFVELATALPAAARDCHDALYRAIDVYFQVHTRLTEEEKMRICKGINYEKLSPECCKHLARNAGFPTRAAVQALASQHTVLKSLLRGGGPDEHLRPVSAAKHRAGGEDHDDLVSAGGQVVLYAGRLDLSLESQNLRSLLDGMHWRVMELEKVCSRMKTQMSKMKAARRATGGGGGGAAGRRAASRSLPRMCS

SEQ ID NO: 69963 - protein, 814 aa, Oryza sativa Japonica Group
IFRSFLSIDCGLDQDSRTDSLVGGITYVSDGAYVDAGENRRVTTVYKDDWKGPRYQTLYTLRSFPTSVTGERSCYSLPTKKGDKYNVRLEFLYGNYDGLDSASLTFNLTLGVNHWDTVILDTTIHYGYKAYAAVFVAWAMSAPVCLVNTGGGTPFVSTVELRPFESLAYPTDNQSLSLYERKSMRSGADVDIIRFPDDQYDRYWYAWELTGNDPYSNISTQSAIELNTTFMVPLRVLQTAFVPDNKTREFTVSIDSGMQSGPISPPYLKGWSIINWSSDSEDLSIKLVATATSSLPPILNAYEVYSRIIHEYPMTFSQDFDAIMAIKHEYGIRKNWMGDPCYPSNSVWDGVECTNPGDDKTMRIISLDLSNSELQGQISYNFTLFSALKYLNLSCNQLTGTIPDYLRKSNGSIVFSYESDGDMCKKPITSSSRNRAATLAVYVAAPVLVVAMLVVAYLIWRAKRKPHFSTDDSPTVPEQISPPGHWTNHWDHLQKPENRRFTYEELAKFTDSFKCLIGHGGFGNVYYGCLEDNTEVAVKMRSESSSHGLDEFLAEVQSLTKVNHRNLVSLIGYCWEKDHLALVYEYMSSGNLSDYLRGKTSMGGTMNWATRVRVMLEAAQGLEYLHKGCNLPIIHGDVKTNNILLGGNLKAKIADFGLSKTYHSDSQTHISAIAAGSMGYIDPEYYITGRLTESSDVYSFGVVLLEVTSGEPTIIPGNGHIVERVKQKMVTGNISSVADARLGGSYNVNSMWKVLDAAMMCTADIAAQRPMMSAVVMQLKESLELEEAHGDMGDMENIARDNKFSMSMLGPSAR

SEQ ID NO: 69964 - protein, 280 aa, Brassica napus
  misc_feature (275)..(275): Xaa can be any naturally occurring amino acid
MATKRSVGTLKEADLKGKSVFVRVDLNVPLDDNSNITDDTRIRAAVPTIKYLMGNGSRVVLCSHLGRPKGVTPKFSLKPLVPRLSELLGVEVVMANDSIGEEVQKLVAGLPEGGVLLLENVRFYKEEEKNDPEFAKKLAALADVYVNDAFGTAHRAHASTEGVAKYLKPSVAGFLMQKELDYLVGAVANPKNPFAAIVGGSKVSTKIGVIESLLSTVDILLLGGGMIYTFYKAQGHSVGSSLLEEDKLDLARSLMEKAKAKGVSLLLPTDVVIAXQFAPD

SEQ ID NO: 69965 - protein, 203 aa, Oryza sativa
MRGPSTTTMATFKQSFLKNLLSSLKSSSKNKAAMSTLSERKRAIKSSADIAMATARTGIAGAARWPHAILASSSSSSSSSSSSSSSSSMPRTTFPCKMMQGKVRRRCKSIVRRRTPLMSSSSEVARRLVKKRDKVLRRMIPGGELIADEISLLHEAMDYVVHLHAQVDVLRRVSRAAVARRSSGLAQLKERTVQISGETENPC

SEQ ID NO: 69966 - protein, 366 aa, Chlamydomonas reinhardtii
MASAGRGLGLRLPMYVVDAFTSCPFAGNPAAVCLLGPGVTLSDELRQKIAAEMNHSETAFIEPLEGSAAAASTATATATTAATTATGVPDVFATAREFRLRWFTPTTEVPLCGHATLASAAVLIQACGNTQPSVSFHTKSGELVVSRAAAASIYQTTQEPSGSAVVLSMSLPAYDPVDPLPPPARDPAGPLVAACSSLALAGLSGQPRQPHQLPVKEVRYAAKGGLNYLLVVLGEGVSRQQLEAVEPDFEAMRRGAGAEDVHGVIVCARGGADDEHEVHSRFFGPWLGVNEDPVTGSAHAVLGPYWQPLLRPAGGGTATGPMRMRQCSARGGDVEVEVLAGVGEGGEDRVRVSGSAALVLEGTLRL

SEQ ID NO: 69967 - protein, 315 aa, Oryza sativa
MDAPPALRSSSPSSSNASVPMVVITVVGILAAFALLASYYAFVTKCQALRGLWSRGATPWHGHGGGGARRRAAREASVIRTVATEERGLGMPFIRMLPVVRFTAAACGGAGGEGGGGGVGARISVSECAVCLSEFVERERVRLLPNCSHAFHIDCIDTWLQGNARCPFCRSDVTLPFTPPAAAAPVRPTSATHPDDDEDAESARRHHHHHHHHHHNHNHRPDDELINSIVIEVRGEHESWVSHRGGAAAAPPATKRTPQRWRKPESVGDEAIDTRKKYDEEFAVQPMRRSLSMDSSCHKQLYVSVQEFLTQQRQV

SEQ ID NO: 69968 - protein, 290 aa, Brucella melitensis 16M
MGTMKTNRISFQGEAGANSDTACRNMFPDMEPLPCPTFEDAFNAVETGAADLAMIPIENTLAGRVADIHYLLPLADMHIVGEYFLPIHFQLMVLPGVRREEIKTVHSHIHALGQCRNVIRQNGWKGVIAGDTAGAARLVADVKDRSMAALAPRLAADLYGLDILEENVEDSENNVTRFVVLSKNKQWAARPENDERIVTTFVFRVRNVPAALYKALGGFATNGVNMTKLESYQLGGRFIATQFYADIEGHPEERSVQLALEELRFFTKEVRILGVYKGSDIRGTQLLAAE

SEQ ID NO: 69969 - protein, 418 aa, Desulfitobacterium hafniense Y51
MSRIKNLREEALEFHKVQPGKLEVRVTVPAQDRDDLTLAYSPGVAEPVKEIAADLENLDIYTNHANYVSIVSNGTAILGLGDLGAAASMPVMEGKSLLFKAFGDVDAFPLCVNTTDVDKIVEIVELTSPTFGGVNLEDIKAPECFEIEEKLKARGIFKGPIFHDDQHGTAVVTLAGLVNALKVVGKKIEDIKVVANGAGAAGIAIIKLLMSMGLKNVIMCDTKGAIYEGRTVGMNPWKEEIAKATNPEKFSGDLAGALVGADAFIGISAANVLNEDMIRSMAKDPIVFCQANPIPEIWPIERAFEAGAKVISTGRSDVINQINNVLAFPGMFRGAIDVRATDINDAMKVAAAYAIAGIVKDEELSADYIIPSTFNPEVAPAVAAAVAKAAIDSGIARRPMDPQEVADGLKKRLANQYK

SEQ ID NO: 69970 - protein, 477 aa, Synechococcus elongatus PCC 6301
MNQKLSRYPKSSWAYVVIACPIAIALIFSSPVKAKLPLGDRLTWGNAVTETSPAYRQALNQAKTFRMPAEFEPITSIWMAYPTYENQAGYPSQTVQKAMVKAIAPTVKIDFLLNEPEEKVIINGWLKTAGIPASQVRYHLVPHEDLWIRDMGPIFAVNADQTQVVDFGFNAWSYLAATDPAAMTDEQVDRKVAGDLDLPILRSSLISEGGNREFNGKGTLMLTEAVELQRNPGLTKEKIETELKRVFNLKKVIWLQEGVIDDELSYRGKLPDGSLTVLATGGHIDEYARFVDSNTILLAEVTAEERASDPLAAINYQRLEENLKILQAATDQDGKPFRIVRIPAAKPIYVNMTKEDAVFQALQELTFEDGTVIQDDDQIKTILAASYLNFVIANDVVIVPRYWQPDRNLEYQQKDQAALAAFQSVFPNKKIVAINPENINAGGGGMHCIVQQQAVVDAVARSLSTGAGDRSKSRSNL

SEQ ID NO: 69971 - protein, 462 aa, Chlamydomonas reinhardtii
SEDEGVEDYKKGGYHPVNVGEKYNNGRYTVLKKLGWGHFSTVWLVHDAETGEYRALKVQKSAQHYTEAARDEITLLTQLRDGDPNNEMKCVRLYDSFDHVGPHGRHVCLVFEVLGDNLLALIKRYDYRGIPIPVVRNLAQQMLVALDYMHRCCDIIHTDFKPENVMLVEPLRDRTWVIPDPSAPQSALQALKLAQPAATTATAAAEAPTASTGSGGAAACGGAEGLTRNQRKKLKKKMKRAAAKKTDLADGAGDDDDCSDVESTSGMTGAMQSGDPDAQMTTAACKVVDFGNACWTYKQFTTDVQTRQYRCPEVILGAKYSTPADLWSLACVVFELVTGDLLFDPRSGDKWDRDEDHLALFIELLGRMPRKVYEKGKFSRDYFNRNGELRHIKKLRFWPLDRVLVEKYKLSEEEAAGLASFLHPMLRFVPEERATAAEMLNHPWLRGERSPPQADTDARPDK

SEQ ID NO: 69972 - protein, 500 aa, Gibberella zeae PH-1
MSLDIQLTAPNGRTYKQPTGLFINNEWVKSSNGEKITSINPTNEQEITSVYAGSSEDVDKAVRAARRALHNPSWRDLPGTERGKLLSRLATLVEENKEILATIETWDNGKPYTVALNDDVNEVAETLRYYGGFADKVYGQVIETTGDKFGYTIREPIGVCGQIIPWNFPLAMAAWKLGPALACGNAVILKPAEQTPLSILYLANLIVEAGFPPGVVNIINGLGTVAGAALASHMDVDKIAFTGSTPTARSIMKMASSNLKNITLETGGKSPLIVFDDADVDLAAYWAHAGIMYNQGQVCTATSRILVQESIYDKFMAAFGAQVKNISKVGDPFEESTFQGPQVTKAQYERILSFVDVGKKEGAKLALGGQPFKVGDGKGYFVEPTVFTDVTPKMRVFQEEVFGPFVVVTKFSSEDEAIHLANDTQYGLGSALFTTNLTRAHQVAKRIEAGMVWVNSSNDSDWRIPFGGVKQSGIGRELGEAGLAAYSNIKAVHVNIAAKL

SEQ ID NO: 69973 - protein, 171 aa, Synechococcus elongatus PCC 6301
MDLKTLIREIPDFPKPGILFRDYTTVLKDPQGWRYSIDRLTELIKPLEPTAIVGIESRGFILGAPLAYQLGLGFVPVRKPGKLPADTHSVEYELEYGSDRLEIHQDALAPGDRVVVVDDLIATGGTASATATLIDRCSATLAGFAFVIELEGLNGRDRLPEVPIISLVSYD

SEQ ID NO: 69974 - protein, 435 aa, Blastopirellula marina DSM 3645
MSDRRAFGLWTLTFLVIANMVGAGVFTTSGYTLASVGSPGWVVIAWLVGGLIALMGALSYGQLSRVMPESGGEYLFLSQALHPAAGFVGGWISLLAGFTGAIAYAAITLEKYVMHSVDLPFFNGAVAIVTVGICGLLHGLGTRLGAGLQNVVVLLKLALLGLFLFLAASSDIDWQGAPLAIDQQPEGWDFALAFGNSLIWIAFCYLGFNAAVYVASEAKNAGDVPRSLLLGTVIVVVLYVLLNSVFVYAPLPGAIANQAEVAAIAAEAIGGKSLSQLVSATIVIALFTSVMSMIMAAPRVYAKMADDGFLHHSFRAQESAPQTAIALQSVLAIGMILFYSHLKDLLDYLGLTLSLCAALTVACALLPAVRQGPLLRLASLPPVLYLLGTLVSALLMAINKPWALLPVAITFGLGGAVFLAIRGRAQPVIEQPFES

SEQ ID NO: 69975 - protein, 234 aa, Escherichia coli O157:H7 EDL933
MNDIAHNLAQVRDKISAAATRCGRSPEEITLLAVSKTKPASAIAEAIDAGQRQFGENYVQEGVDKIRHFQELGVTGLEWHFIGPLQSNKSRLVAEHFDWCHTIDRLRIATRLNDQRPAELPPLNVLIQINISDENSKSGIQLAELDELAAAVAELPRLRLRGLMAIPAPESEYVRQFEVARQMAVAFAGLKTRYPHIDTLSLGMSDDMEAAIAAGSTMVRIGTAIFGARDYSKK

SEQ ID NO: 69976 - protein, 491 aa, Ralstonia eutropha JMP134
MKTQEVLPICIAGEWRLGTGDRYATRYPATGEVVAELNAASLADVEEAVQGAQRAFETSGWARRKPHERAAVLYRVAELIRAQAEPLAQRQRLDNGKPISETRALVASAASTFQFFAAACETLEEQITPQRGECLTMSVYEPMGVVAAITPWNSPIASEAQKMAPALAAGNAVVVKPAEVTPLMALELARICDEAGVPKGLISVLPGKGSVIGDAITKHPLVRRVSFTGGTTTGKHIAHIAADKMMPVSLELGGKSPTMVFDDADLDHAVNGVLYGIFSSSGESCIAGSRLFVARSQYEPFIERLAAGAAHLRVGDPADERTQMGPLITDRHRDSIESYVAMGVQDGGQLRTGGLRPDVAGLPNGYFYTPTIIEGLDNHARIAQEEIFGPVLVAIPFDDEDDLIEQANDSVYALAAGIWTRDYKRAWRVARAVQAGNVWINTYKQFSISAPFGGWRDSGLGREKGRLGILQYMEQKSVYWGLNEQPLPWAN

SEQ ID NO: 69977 - protein, 220 aa, Brassica juncea
LADVKLDCSYQLLVTNLWGLYRMRIGDIVKVTGFHNKAPKFRVIGRENTLLSIDTDRTTEEYLLKAVNRARLVLESSDLRLVAFTSCADIPSSPGHYVIYWEVKTKEEDMKELDEKTFLECCSVMEDTLDEEYMYCRANEFIGPLEIRVVNDGTFDSLMNLSISKGASITQYEYWRQMWLLDSSVLSEHLMCLSHDIWSKKRGRNVCVLSVLSCFLLTIF

SEQ ID NO: 69978 - protein, 484 aa, Nostoc punctiforme PCC 73102
MTDILAMGVNIKQETVQFPIVAENFDSFWDKEIRPLFTDESLSFRVKTLKGNYVNYVNLDNGATTTPFTTLKQHVDEMLDTYGSVHRGSGQKSIITTREYDASRNVIRDFVGSSSDNYVIFAKNTTEAINGAATLWAKKPGKILVSDIEHSSNLLPWVTRDEVVQYRTQPDGSVSVAEIEDIFKAHQNLPEAEQIKLVTITGASTITGYRPPIYEIAALAHRYGAKIFADVCQLIQHERVDMRADDDPCHLDFVAFSGHKMYAPYGTGVLLGPKEFFDSSYPYQIGGGNLPYITRNLEIKRFYTERAHDPGTPNAMGAIAIAKAIEIIEAVGRDRIAKYEHSLVEFTYTRLRLIPGVKLHIPGDNLAHVIPFDIDGFDGRLVAEILAQEYGIGVRAGAFCTYEYIRKLKNISDERDYEIAQEVDRGITRNIPSIIRASFAVYNTLEDCDRFIDAIAQIAKNGFAHYSPNYTEDEITGVWTAINS

SEQ ID NO: 69979 - protein, 338 aa, Ralstonia eutropha JMP134
MKKISDRIASFSRLQLVGAVTPLEKLDRLSRMLGRDVYIKRDDTTPLAFGGNKLRKLEFLAADALSKGADTLVTAGAIQSNHVRQTAAVAARLGLRCHALLENPINTTDVDYLRSGNRLLLDLFDAHGEPVATLDNADAQLQALAERLRGDGYQPYIIPIGGSNPLGALGYVHAGLEMAQQADAMGVSFAAVVLASGSAGTHGGLALALAHAMPDAQVVGITVSRPVEAQAPKVAGLIDGTAELLDIEVPAELRLELWDEYFLPRYGEPNRAALDAIRLLARTEGVLLDPVYTGKAMAGLLDGVMRKRFAGEGPLLFLHTGGAPALFAYRDALPAVLI

SEQ ID NO: 69980 - protein, 348 aa, Escherichia coli O157:H7 EDL933
MEFFKKTALAALVMGFSGAALALPNITILATGGTIAGGGDSATKSNYTAGKVGVENLVNAVPQLKDIANVKGEQVVNIGSQDMNDDVWLTLAKKINTDCDKTDGFVITHGTDTMEETAYFLDLTVKCDKPVVMVGAMRPSTSMSADGPFNLYNAVVTAADKASANRGVLVVMNDTVLDGRDVTKTNTTDVATFKSVNYGPLGYIHNGKIDYQRTPARKHTSDTPFDVSKLNELPKVGIVYNYANASDLPAKALVDAGYDGIVSAGVGNGNLYKSVFDTLATAAKNGTAVVRSSRVPTGATTQDAEVDDAKYGFIASGTLNPQKARVLLQLALTQTKDPQQIQQIFNQY

SEQ ID NO: 69981 - protein, 602 aa, Brucella melitensis 16M
MDTQSADGAYRVLARKYRPQNFDDLIGQEPMVRTLRNAFETGRIAQAWMLTGVRGVGKTTTARILARALNYKTDTVDQPTIDLSTPGEHCQAIMEGRHVDVIEMDAASHTGIDDIREIIEQVRYRPVSARYKVYIIDEVHMLSTAAFNGLLKTLEEPPPHVKFIFATTEIRKVPITVLSRCQRFDLRRIESGTLAQHLRRIAEAEKIEVDDASLAMIARAGEGSARDSLSIFDQAIAHGAGSVTAEAVRSMLGLADRARIIDLFEMLMRGDVAGALTEFRAQYDVGADPSVVLTDLADFNHLVTRLRFTPDVAEDVSLSEDERVRGREFAQTLSIRALSRTWQMLLKGIAEVDTATRPVQAAEMLLIRLAHAADLPTLDEAIRGLDNGSVSAPRPQPSATPRPNGGSAPQAHGAADAVGSSALAPAAGGPATAMRIVETPPIQVSAPKPSEAAPQPSVPINSLQDIVALADKYRDMQFKILVKNCVRPASIAPGRLEIGLTDDAPKSLPSDIAQHLLNWTGIRWVVTVARDVAGQTIAEAEAERRDNLVTDARADPDVAAILAAFPGAKIIDVRIAVPDKSKDEDIDLDAVAEVPDVLPEDD

SEQ ID NO: 69982 - protein, 249 aa, Arabidopsis thaliana
  misc_feature (52)..(52): Xaa can be any naturally occurring amino acid
  misc_feature (63)..(63): Xaa can be any naturally occurring amino acid
  misc_feature (76)..(76): Xaa can be any naturally occurring amino acid
  misc_feature (84)..(84): Xaa can be any naturally occurring amino acid
TQVAPQAFWPRARLQACDTQPSILAGAAKEFIFSGRLDNLCMSFCSLKHYDXTSSGSDLEDEXGIEWCTIDHEEVXSNSAQGAXSPVMIDAMSHITSCFSSDTKVLKKAIQKSLLVSADMAHALHPNFMDKHEENHQPKMHGGLVIKHNANQRYATNAVTSFVFREIAEKHNLPVQDFVVRNDMGCGSTIGPILASSVGIRTVDVGAPQLSMHSIREMCAADDVKHSYEHFKAFFQEFTHLDAKLTIDV

SEQ ID NO: 69983 - protein, 349 aa, Nostoc punctiforme PCC 73102
MAKTPESLESSINEITDRALDRDCTTLSRHVLQQLQSFSPDAQDLSALMNRIALAGKLVARRMSRAGLMEGVLGFTGEVNVQGESVKKMDVYANDVFISVFKQSGLVCRLASEEMENPYYIPENCPIGRYTLLYDPIDGSSNTDNNLSLGSIFAIRQQEGTDSDGKATDLLANGRKQLAAGYILYGPCTMLVYTIGKGVHSFVLDPSLGEFILTEENIRIPNHGSVYSVNEGNFWQWEESIREYIRYVHRTEGYSARYSGAMVSDIHRILVQGGVFLYPGTIQNPEGKLRLLYETAPLAFLIEQAGGRATTGLVNILDVVPKKLHQRTPLIIGSKEDVAKVESFIQNGH

SEQ ID NO: 69984 - protein, 425 aa, Desulfitobacterium hafniense Y51
MARFLEYQGKEWLAKAGMPVPKGRPASTPEEAREAAEWIGGPVAVKGQVQAGGRGKAGIVKLVNTPDEAAAAAAEILSKTVKGLPVRKVLVEEKLDIKKEFYCSFVVNGAKEARSPMLMFSVEGGMDIESVPEDKLLKINVDPINGLQTYDAVDLAAKAGIAPEELTKFAKFLTKLSQTYKKYDCMTLEINPFVMTGNGNLICADCKMEIDNSSVGRHPEFGFDIARDLPGEPTELDYIGWSIEETDARGTGFLMNMGYDEVSPGYVGYHPIGGGSAMMGLDALNQVGLKPANYADTSGNPVASKIYRVAKSVLSQPNIDGYLLGGFMMANQEQWHHAHAIVKVLREILPTQKPGLPCVLLLCGNREDESLEILKTGLADLMTSDGPGKRIEIYGKEYVTDTKFIGERLLALSKDYRAEKEAQGK

SEQ ID NO: 69985 - protein, 511 aa, Emericella nidulans
MLSPTLFSAYVLVGAIVAVLVNVIRQIFFRNTNEPPMVFHWVPFVGSTISYGMNPYNFFFSCREKYGDIYTFVMLGKKMTVYMGVKGNDFILNGKLKDLNAEEVYSPLTTPVFGSDVVYDCPNSKLMEQKKFIKFGLSQSALESHVPLIEKEVLDYIKTSPRFKGDSGVLDAPAAMAELTIYTAGSALQGKEVRKKLTAEFADLFHDLEMGFTPINFILPWAPLPQNRKRDIAHARMRETYMEIINQRRKNPDAQDHDMIWNLMHSTYKNGNPVPDKEIAHIMITLLMAGQHSSSSISAWILLRLASEPQILEELYQEQFANLKRDPRTGAFEPLQYKDLDLLPLHQNVIKETLRVHLSIHSILRKVKNPIPVPDTPYIIPTSHTLLASPGATALSDEYFPNANMWDPHRWENQRPDKEDEEGELIDYGYGAVAKRMSSPYLPFGGGRHRCIGEKFAYVNLGVIVATIVRNLKLYNVDGKTGVPATDYSSMFMGPMKPAVVGWERRFPARS

SEQ ID NO: 69986 - protein, 244 aa, Triticum aestivum
MCTLEQRGRVFVLTLTGEDQHRLGHPLIAAIRAALAEVLAAAQAQPQGPGAALVTVAEGRFFSNGLDIGWAGASRARLGELVDALRPVAADLLALPMPTVAAVTGHASAAGFLLALCHDYRLMRADRGVLYMSEVDIGLPLPPYFVHVLRAKISQAHALRDVVLRGKKLKAPEAREMGIVDVVCPGAPETAAEALKLAEQLAARKWDGAVYASIRMSMSPDACRAVGIAVESDEEKSRHFASRL

SEQ ID NO: 69987 - protein, 517 aa, Actinidia chinensis
MGSGAWTIEKRSTFRNESFSKEYVTVSETGCLSIIVLGASGDLAKKKTFPALFNLYRQGFLQSNEVHIFGYARTKISDDELRNRIRGYLIQGSGSSDKQLEEVSKFLQLIKYISGSYDSGEGFQLLDKEISGYEFSKNTVEGSSRRLFYLALPPSVYPSVCKMIKNNCMNKSDLGGWTRIVVEKPFGKDLGSAEQLSAQIGELFDEPQIYRIDHYLGKELVQNLLVLRFANRFFLPLWNRDNIANVQIVFREDFGTEGRGGYFDEYGIIRDIIQNHLLQVFCLVAMEKPVSLKPEHIRDEKVKVLQSVVPIKDEEVVLGQYKGYRDDPTVPDNSNTPTFATVVLRVHNERWEGVPFILKAGKALNSRKAEIRIQFKDVPGDIFKCQKQGRNEFVIRLQPLEAMYMKLTVKQPGLEMSTVQSELDLSYGQRYQGVTIPEAYERLILDTIRGDQQHFVRRDELKAAWEIFTPLLHRIDDGEVKPLTYQLGSRGPAEADQLLERAGYVQTHGYIWIPPTL

SEQ ID NO: 69988 - protein, 406 aa, Moritella sp. PE36
MTNNVMGVTRKDFDDVMVPNYAPAAMIPVRGKGSRVWDQADNEYIDFAAGIAVSCLGHCHPPLVAALQQQSQQLWHVSNLLTNEPALRLANKLTKATFADKVFFANSGAEANEAALKLARRYALDKFGDGKDQIIAFNKGFHGRTFFTVTVGGQSSYSDGFGPKPGAIDHVDFNDLAAVEALMSDKTCAVMMEPLQGEGGINAANQQFLIGVRALCDKYNALLIFDEVQTGVGRTGTFYAYQHTDIKPDILTSAKGLGAGFPIAAMLTTGNIAKSLSVGTHGSTYGGNPLACSVAEVVVDTINNDDFLAQVKVKSAIFQEALTQINNQYAIFSDIRGDGLLLGAELKEQYQGQAIAIMNQAAQHGLLILVAGANVLRFTPALNIPEDDIHAGMKKLSQAIEKWLAA

SEQ ID NO: 69989 - protein, 140 aa, Brassica napus
MSKASVILYITVGILVLFLVSYSPKNKSDHDHHHHHGGGHTQHHRLKLRSSFNFKPTRHDPIPFDPLVADMERRREDKEWERQHIDHSHPELAAHDPAPGHESQPEWEDFMDAEDYLNDEEKFNVTDRLISLFPKLDVSP

SEQ ID NO: 69990 - protein, 411 aa, Actinidia chinensis
MNALAATNRNFKLAARLLGLDSKLEKSLLIPFREIKVECTIPKDDGTLASFVGFRVQHDNARGPMKGGIRYHPEVDPDEVNALAQLMTWKTAVANIPYGGAKGGIGCDPGELSISELERLTRVFTQKIHDLIGVHTDVPAPDMGTNPQTMAWILDEYSKFHGYSPAVVTGKPTDLGGSLGRDAATGRGVLFATEALLHEHGKSIAGQRFVIQGFGNVGSWAAQLISEIGGKVVAASDITGAVKNSKGLDIPSLLKHVKENRGVKGFHGGDPIDPSAILVEECDILIPAALGGVINRENANDIKAKFIIEAANHPTDPEADEILAKKGVVILPDIFANSGGVTVSYFEWVQNIQGFMWDEEKVNHELKTYMTKGFKDVKAMCKTHNCDLRMGAFTLGVNRVARATVLRGWEA

SEQ ID NO: 69991 - protein, 271 aa, Oryza sativa
VENQEGVVNFDEILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNEAVFKEMIRSAPLPMSPLESLASSAVRTANKAKAALIVVLTRGGTTAKLVAKYRPRVPILSVVVPVLTTDSFDWTISSEGPARHSLIYRGLVPLLAEGSAKATDSESTEVILDAALKSSCTKSSCARPGDAVVALHRIGVASVIKICIVK

SEQ ID NO: 69992 - protein, 411 aa, Actinidia chinensis
MNALAATNRNFRHAARILGLDSKLEKSLLIPFREIKVECTIPKDDGTLVSYVGFRVQHDNSRGPMKGGIRYHPEVDPDEVNALAQLMTWKTAVADIPYGGAKGGIGCTPKDLSKSEWERLTRVFTQKIHDLIGVNMDVPAPDMGTNAQTMAWILDEYSKFHGYSPAIVTGKPIDLGGSLGREAATGRGVVYATEALLAEHGKSIKDLTFVIQGFGNVGSWAARLIHERGGKVVAVSDITGAVKNPNGIDIQSLLNHKEATGSLNNFDGGDAMDPNELLIEDCDVLIPCALGGVLNRENAGKVRAKFIIEAANHPTDPEADEILSKKGVIVLPDIYANSGGVTVSYFEWVQNIQGFMWDEEKVNKELHRYMTRAFGNIKNMCQTHNCSLRMGAFTLGVNRVARATVLRGWEA

SEQ ID NO: 69993 - protein, 143 aa, Oryza sativa Japonica Group
MKERGVRNKQGVIMKALLDRCLSKHRNGGWPEPPEGSFAVYVGGGGGGGGAARERFVVRTECVNHPLFRALLEEAEEEYGYVADGPLELPCDAGEFVAVLARIEREMAEERTVGCAGGLVFRLHPAAHLMLVAPATPPPMIVG

SEQ ID NO: 69994 - protein, 1229 aa, Neurospora crassa
MPNGSRISKNQPRSLTDEHALGMNTSRPTTSPAAAVVNRSSDPDPVPDPAARHKPNPDRPGASDGPSKSGKPRGRSIEPPSSSPQPAPRHRHPSRHRSPDRSGRSSRLPHRSRGSPRSRRDRSREPRGRDGHFPPDRRHRSPVLPRGRGDAAHERGQNVDHGKHHSQLPPHPARASQRGSSRTPGSSKRRRSRTPSPGGPDSKKSRRGRSPRRGEKDDVNSLQLPRDCRRSPVDRRPSRSPSHHERRRSRDRKRSGRSRSPDRSRRRKSRSPDRGVFDRASGRVRRRSPSPRHRGRSDRPDRPERRHQSKSRSRTPPHRENRHPASDAGSRRRPSPDPDSREPYDHPQGSPRDRRRSKSSKKGKVRDDQKFDPASGVNSIEVNMAARNGYRGGYGAPMPPGYTETHDGRNYSHSSGHATPNSSFHGSPPAQSPYGAGRGWNNPQFSPQSQYGYPHGNYGPPTGPQAHYHSNQGHSPPYPPTGPAAQYPTGPFRGGHRAASGGFRGGSFGVARGGHRGGSKNAQWSPNAHNARGQYITPTTTITTATDNNPAHAQNNAAPSKYADSGQNTQEGTREDVNSSSRPDKDLQGDDTNSSGKEKEEQMQPPTRPAAASQSQPSNKFSFSMKNATKPVVAAPRPEISLKFNAVVPPREPSQKQPPKAPAAAPPTAPSAHRSNRDRHDLPKNVPTEPASARARHNDRRGPDPHRPVDSHRPVDSHRPVDSHRPAEQQKPRTRIVKKIVKKLKEKPALPPDLAKSKSVYHRKPGNESVIGSGTYGKVFKALNVYTKKQVALKRIRMEGERDGFPVTAVREIKLLRSLSHRNIVKLMEVMVEMNECFMVFEYLSHDLTGLINHPNYTLDPAQKKHLALQLFEGLDYLHTRGVLHRDIKAANILVSNEGVLKLADFGLARFYAKHHQLDYTNRVITIWYRSPELLLGETQYGPAVDIWSAACVMMEIFTKRAIFPGDGSEINQLDKIHSVLGTPTRNDWPNIIEMPWFELLRPTQRRANVFAEKYKELVTPAAFELLLWMFKYDPDKRPSAAQVLAHPYFTTEEPAPRQAVELKDIDGEWHEFESKALRKENERKEREARRAVKDGAPAAAAAPSGGGGSSSTREKDRDPRKRPAESREPPPSERDSKRPHLDSHAANKPSTILSSSAPPPPQQQQREPERSSVPTRPREQHQQEQQQEQQQCRPSASSSSHLPPAQAQARARAPTNAPSGPAASQSHN

SEQ ID NO: 69995 - protein, 354 aa, Arabidopsis thaliana
MSISELSQDLLEEILCRVPAISLKKLRSTCKLWNSLFIDKRVARNHFDKAAKQSLILMVTNKLRRVTVSQVFHCDGLLLYINGVDTIMVVWNPFMGQTRWVQPIARDQTHKYVLGSYQDIKSRITSYKILRYRYTLCGSKLAFEICELYSSSWRVLDITMDFDLYHNSCVSLKGKTYWLTFDKKDRELDMFSFDYATESFGNRMPLPYQFPRCSYETVALSVVREEKLSVLLQLRGTSRKEIWVTNKINETTQVLSWSKVLTLDNSDFGYCPGLSFFVDEEKKQVLCFEKCRVFHIHTNDEVFENKVYTVGEDNKVTQLRFEQSFCPKMDPYVFGYVPSLVQIEQPRRKRKRGD

SEQ ID NO: 69996 - protein, 342 aa, Myxococcus xanthus DK 1622
MRGAAVVWTEGRLGMADTQGTHGSHDATGPEGMFANRLRKGDKRFRKWARTQGLTAFRVYDRDIPEYPYAIDVYGDRVHVVEYPRRRAIASGAADTQREEVLAAVTQVLAVPSERVFVKTHTPQPWGRSQYGRVGQDSGRIVVEEQGLKFWVNLGDYLDTGLFMDHRNTRARVREEARGKRFLNLFAYTGAFTVYAAAGGAASTMTVDLSNTYLDWAEDNLDLNGLADARHTLVRADAKAWVEAQADAPERYDLVVCDPPSFSTSKKMSGSFNVQRDHPRLLAAIRALLAPGGVLYFSTNFLGFQLEPKATRGMEVEEITPRSIPEDFQRKEIHRCWRMVAP

SEQ ID NO: 69997 - protein, 171 aa, Oryza sativa
  misc_feature (95)..(95): Xaa can be any naturally occurring amino acid
MRPASSPVPAVLTAPATAATAAIAVKPTPPQRALQASRRELVVAAGGVAAAAVALGPCGGAARAASDDEYVSETKDVIGKVRSTINMDRADPGVXADAVAELRELSNSWVAKYRREKSLLGRPSFREMYSALNAVSGHYISFGPTAPIPNKRRARILEEMDTAEKALLRGR

SEQ ID NO: 69998 - protein, 405 aa, Vibrio vulnificus CMCP6
MAGVLGMILAGGEGSRLRPLTESRSKPAVPFGGSYRLIDFALNNFVNADLMRIYVLTQFKSQSLFHHMKKGWNINGITDRFIDPIPAQMRTGKRWYEGTADAIYQNLRFMELSEPEQVCIFGSDHIYKMDIKQMLSFHKEKLAALTVSALRMPLAEASQFGVIEVDAEGRMVGFEEKPSAPKSIPGDPDFALVSMGNYIFEADVLFAELIEDADNENSSHDFGKDIIPKMFPRGDVFVYDFSQNRISGEKAEVYWRDVGTIDAYWQAHMDLLKTDAPFSLYNRKWPLHTYQPPLPPATFTDSDNGRVQIIDSLVCNGSYVRGSRIEKSVLGFRSNIASACDISESILLGDVKVGEGCVLRRVIVDKDVDIAPGTQIGVNLQEDKKIFHVSDDGIVVIPKGARVGY

SEQ ID NO: 69999 - protein, 255 aa, Escherichia coli CFT073
MFNSDNLRLDGKCAIITGAGAGIGKEIAITFATAGASVVVSDINADAANHVVNEIQQLGGQAFACRCDITSEQELSALADFAVSKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 70000 - protein, 307 aa, Bacillus cereus G9241
MNVYRGVHELIGHTPIVEITRFSLPEGVRLFAKLEFYNPGGSVKDRLGRELIEDALEKGLVTQGGTIIEPTAGNTGIGLALAALQHDLRVIVCVPEKFSIEKQELMKALGATVVHTPTEQGMTGAIAKAKELVNEIPNSYSPSQFANEANPRAYFKTLGPELWDALNGEIDIFVAGAGTGGTFMGTASYLKEKNIDIKTVIVEPEGSILNGGKAGSHETEGIGLEFIPPFLKTSYFDEIHTISDRNAFLRVKELAQKEGLLVGSSSGAAFHASLLEAEKAAPGTNIVTIFPDSSERYLSKDIYKGWE

SEQ ID NO: 70001 - protein, 109 aa, Bacillus thuringiensis serovar konkukian str. 97-27
MNSQRQGYAGWWQGGHGGWPGGHGGWQGGHGGWQGGHGGWQGGHGGWQGGHGGWQGGHGGWQGGHGGWPGGHGGWQGGHGGWQGGHGGWPGGHGGWQGGHGGWQGGHGY

SEQ ID NO: 70002 - protein, 141 aa, Moritella sp. PE36
MAIQRTFSIVKPDAVRKNLIGAIYSRIEASGLNVVAAKMLHLTREQAEGFYAEHEGKVFYEPLMEFMTSGPLMVQVLEGENAITFYRELMGATNPENAAAGTLRCDYAESMRLNAVHGSDSEESAAREIAYFFTENEVCPR

SEQ ID NO: 70003 - protein, 132 aa, Helicobacter pylori
SNIKYELDKESGALMVDRVLYGAQNYPANYGFVPNTLGSDGDPIDVLVLSDVAFQAGSVVKARLVGVLNMEDESGMDEKLLALPIDKIDPTHSYVKDIDDLSKHTLDKIKHFFETYKDLEPNKWVKVKGFEN

SEQ ID NO: 70004 - protein, 175 aa, Triticum aestivum
  misc_feature (107)..(107): Xaa can be any naturally occurring amino acid
MAPPLMASSATSVAPFQGVKSTAGLPSSRRSKGVSLGSVSNGGRIRCMQVWPIEGIKKFETLSYLPPLSTEALLKQVDYLIRSKWVPCLEFSKVGFIFREHNASPGXYDGRYWTMWKLPMFGCTDPTQVINEVEEVKKEYPDAYVRIIGFDNMRQVQWVSFIAFKPPGCEESGKA

SEQ ID NO: 70005 - protein, 249 aa, Arabidopsis thaliana
MFCRNVSVRRKKNSGTVPVYLNVYDLTPMNVYGYWLGIGIYHSGLEVHGVEYGYGAHEKSSSGIFEVEPKKCPGFTFRKSILVGETEMKAKEVRSFMEKLSEEYQGNKYHLITRNCNHFCNHVSLKLTHKSIPSWVNRLARLGFLCNCVLPACLNETKVKRVGKDGKLLLEGENTKKKKRKKKIRRSRSGPLSSSSSNARLDNTPTHNRSISTGNPPLSASPSCPLRPRLPSVASGAEDQNPPSVSVKT

SEQ ID NO: 70006 - protein, 294 aa, Yarrowia lipolytica CLIB122
MNTSSQFQQLEKLGEGTYATVYKGRNRTTGQLVALKEINLDSEEGTPSTAIREISLMKELKHENIVTLYDVIHTENKLNLVFEYMDKDLKKFMDTNGNKGALETKQVKWFMYQLLRGILFCHDNRVLHRDLKPQNLLINAKGQLKLADFGLARAFGIPVNTFSNEVVTLWYRAPDVLLGSRTYSTSIDIWSAGCIMAEMFTGRPLFPGSSNDDQLQHIFKLMGTPNESTWPNISSLPNYRSNFQVYAPQDLRVIIPQIDNVALDLLLSLLQLKPENRITARQSLEHPWFAEYHQ

SEQ ID NO: 70007 - protein, 248 aa, Brassica napus
EHNLFYIIISSHATNSMSVVVWWLVTVVMVTVHSASAGVVELNWEVEYKLRWPDCKEGIVIAINGEFPGPTIDATAGDTVIIHVTNKLSTEGVVIHWHGIRQNGTPWADGAAGVTQCPINPGETFTYNFIVDKAGTHFYHGHYGMQRSAGLYGMMIVRSPKETLQYDGEFNLLLSDWWHQGSHAQELYLSSRPMRWIGEPQSLLINGRGQFNCSLAAYFTREDEECSQDNDDCALHSEGRALKLSSRS

SEQ ID NO: 70008 - protein, 490 aa, Erycibe glomerata
MRINPSSSGSEVSVVEKKNLGRIVQIIGPVLDVAFPPGKMPNIYNALVVQGRDNEKANVTCEVQQLLGNNRVRAVAMSDTDGLMRGMEVIDTGAPISVPVGGSTLGRIFNVLGKPVDNLGPVDTNTTSPIHRPAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLTETIRGFQLILSGELDGLPEQAFYLVGNIDEATAKAMNLKT

SEQ ID NO: 70009 - protein, 397 aa, Klebsiella pneumoniae subsp. pneumoniae MGH 78578
MKALTYHGPHHVSVDTMPDPALEAADDIILRVTATAICGSDLHLYRGKIPGTHHGDIFGHEFMGEVVEAGSEVTAVRKGDRVVIPFVIACGDCFFCRLQQYAACESTNSGQGATLNRKGISPPAALFGYSDLYGGIPGGQAEYVRVPKANTGPFKVPDTLPDEKVLFLSDILPTAWQAVKNAEVKPGSSVAIFGAGPVGLLCASCARLNGAEQIFIIDHNDYRLDFAQQRYGAIPINFDHHDDPAQWIIDNTPGHRGVDAVIDAVGFEAKGSLTETVLSTLKIEGSSGKALRQCIAAVRRGGIVSVPGVYAGFIHGFMFGDAFDKGLTFRMGQTHVHAWLPDLLALIEQGLLTPEEIVTHHMPLEEAARGYQIFEKREEACRKVILVPGMQPGKATL

SEQ ID NO: 70010 - protein, 376 aa, Aquifex aeolicus VF5
MASSTKKDYYEILGVPRNASQEEIKKAYRRLVRKYHPDICKKPECEEKFKEINEAYQVLSDPEKRKLYDMYGHAAFEGAGAQQRVETTEIPPIEEILREFFDFDIGSIFERATGRRRARRRRSVKGEDIVVPVEITLEEAFKGTTVPIEVEREVPCSACGGTGYDESKSRTCPTCGGRGETVQGNWFFQVRQTCPTCGGEGVIYENCHACTGRGYGLVKETIKVKIPPGVRDGSKLVVEGKGHAGRYGGPPGDLYIIVKVKPHKIFERKGDDLYVDVNITYPEAVLGTEVEVPTLDGEKVKVKIPPGTKEGELIKVPGKGMPRLKGSGRGDLYVRVHIDVPKIGVLSKLLGDGKKVEELLKQLQEVLPKPERIVER

SEQ ID NO: 70011 - protein, 354 aa, Brassica napus
MEKYELVKDIGAGNFGVARLMKVKNSKELVAMKYIERGPKIDENVAREIINHRSLRHPNIIRFKEVVLTPTHLAIAMEYAAGGELFERICSAGRFSEDEARYFFQQLISGVSYCHAMQICHRDLKLENTLLDGSPAPRLKICDFGYSKSSLLHSRPKSTVGTPAYIAPEVLSRREYDGKMADVWSCGVTLYVMLVGAYPFEDQEDPKNFRKTIQKIMAVQYKIPDYVHISQDCKHLLSRIFVANSLKRITIAEIKKHPWFLKNLPRELTETAQAAYFKKENPTFSPQTAEEIMKIVDDAKTPPPVSRSIGGFGWGGKGDEEEEEVDEEEVVEEEEDEEDEYDKTVKEAHASGEV

SEQ ID NO: 70012 - protein, 484 aa, Novosphingobium aromaticivorans DSM 12444
MVQREALLLIGNADVAASGGATFERTGPLGGEPTVAAAASAADAIAAADAAAAALPAWAALGPNERRRLLLAGADALEAQTGAFVEAMAAETGASNGWAGFNVHLAAGLLREAAALTTQVKGETILSDRPGCYAMTLRRPAGVVLGIAPWNAPVILGVRAIATPLACGNTVVLKASEHCPATHRLIGTALRSAGFPAGVVNVVTNAPADAGEVVAALVNHRAVRRINFTGSTRVGRIIAGLAAQQLKPCLLELGGKAPMIVLDDADLDAAVAAAGFGAYMNSGQICMSTERIILEDGIADAFVERFRARVDGLTAGDPRAGSAPLGSVVDEATGRRVRHLIEDAVGKGARAHGDWQTGGTLIPAIVVDGVTPDMLLYSEESFGPVTTILRAANEDVAVRIANDTEYGLTSSVFSQNIARALRVAERIEAGMCHINGATVHDEAQMPFGGTKASGYGRFGGEAGIAEFTELKWVTIDTQTPHWPI

SEQ ID NO: 70013 - protein, 393 aa, Desulfitobacterium hafniense Y51
MGGKVLKARRLSSLGASVFTEMDDLRKELEKAGKQLINLSIGSPDRSPSAEIRKVLAEGVLDGGSYGYTLTRGTESFRSGCARWYKERFGVNLDPEKEVLPLMGSQDGLAHIFLALCDPGDVALIPDPGYPIYTAGLVLAGGEKVALPLREENGFLPDLSAIADEVAQQAKIMFLNYPNNPTAAVAPLSFFEEVVDFARKNRIVVCHDAAYSELAFDGYRPVSFLQVPGAKEVGIEFHSVSKTYNLAGVRLGFAVGNREIIGALAELKSNIDYGVFEPALQAGAYALSASQENVEQNRRAYQERRDIWVKGCAQAGWSMPSPRGSMFIWAPVPTAQDSRSFAFALAREAGVIVVPGVAFGEYGEGYVRIGMVQDQEVLQEAVRRVQEFLAAQG

SEQ ID NO: 70014 - protein, 176 aa, Actinidia deliciosa
MAASTISSSAVTSVTRASLASPFAGVKSPSTISLGRKLENGSRSSGFKVKCMQVWPPLGKRKFETLSYLPPLPVDALLKQIDYLIRSGWIPCIEFTVGEGFVYREHHHSPGYYDGRYWTMWKLPMYGCTDSTQVLAEVEANKKEYPNSYIRIIGFDNKRQVQCVSFIVHTPPSFHG

SEQ ID NO: 70015 - protein, 176 aa, Actinidia chinensis
MAASTISSSAVTSVTRASLASPFAGVKSPSAISLGRKLESGSRSSGFKVKCMQVWPPLGKKKFETLSYLPPLPEEALLKQIDYLIRMGWIPCIEFSVGEGFVYREHHHSPGYYDGRYWTMWKLPMYGCTDSTQVRAEVEANKKEYPDSFIRIIGFDNKRQVQCVSFIVHTPPSFHG

SEQ ID NO: 70016 - protein, 153 aa, Zea mays
  misc_feature (29)..(29): Xaa can be any naturally occurring amino acid
  misc_feature (113)..(113): Xaa can be any naturally occurring amino acid
SSQHISAPKPPCSPAAFSRFMSASSATLXDREYETATVTDVLKSTRKSADACSVWCTREDSGYDYAKSMTQDNVRSLLGAKSEQNMSITSTVTERDYLRKNIVEGRTSEPTKXVADFMTEENTLISVSPDTKVLQAMHFMTENRVIHIPVIDT

SEQ ID NO: 70017 - protein, 435 aa, Aspergillus oryzae
MILFSTSRESLLRPQWNPLRLQNNLPNGSTIATTKLQSSTPSPSPVIKEQSLPARAISVVVPSPSSQLKKEIESAKWASSSQSCTPELKGVLEKFYPTNAHVERGRKGAYPAARKVNRAAIPLPTGTPGPILQKRPEALDQQYRTLERKLSTIKGPKITFAPADGPKLAKVTANFQFINSYKLHKGVSPAPAEFIGGCSCGKHCDPERCPCSEKEDDSTENIIPYQRAKDRPDLLVLTPEFLRRTAMIFECGAQCACDKSCWNRVVQRGRTVELEIFYTGNRGFGLRSPRYIREGQFIDCYLGEVITKQHADIREETAVKNGHSYLFGLDFSPEVDEEDIYVVDGQRFGCATRFMNHSCKPNCRMFTVTNTIGDERLYNLAFFALKDIPPMTELTFDYNPGTERSEKVDSSVVACLCGEDNCRGQLWPSKRKGTK

SEQ ID NO: 70018 - protein, 963 aa, Aspergillus oryzae
MSTTAPSSASPSVVRSHSTTSRPPSYRPVVSSDNPHRTRSVAVRPATAHQSSPQHHHHHSQHYHSHSHSKSQSYDRRPPSNQAVFDNIARRDLEHPVSTRRSNSRERSQERPSTAYRAEPPSNKHHRNLSVQGHQRDSIDMAAAGPVMAEGVAGPQQIASGSRLHPGTMPSKRRTTITTPSGQWALGKTLGAGSMGKVKVGKNIETGEQVAVKIVPRQSTEEHRSSRDAERADRSKEIRTAREAAIVSLVNHPYICGMRDVVRTNYHWYMLFELVNGGQMLDYIISHGKLKEKQARKFARQIAGALDYCHRNSIVHRDLKIENILISKTGDIKIIDFGLSNLFSPRSLLKTFCGSLYFAAPELLQARQYTGPEVDVWSFGIVLYVLVCGKVPFDDQSMPKLHAKIKQGVFEFPQGLSAVTELGIMAECRSIISRMLVTDPKQRASLAEIMNHPWMNKGYSGPPENYLPHREPLQLPLDPEVIEKMTGFDFGSPEYITAQLTKILESEDYQHAVRTSIREHPAPNHGEKKRGMFDFYKRRNSTSRDTLSAPSAEAVQLGNDPLNAYSPLLSVYYLVKEKLEKERAEKSPGALGVPHSAGDAMLQMPDLPAPEAAHTNQYQVPGEKDNTRRARPRARTHGDDDLAEGVKNLNLAPGQGSPAPTASQPETPVKKESTAAGILRRFSTRRTKDRGRDPDRGRVSNQTPQKETRTGRTHASRTMSLGHARRESIQARRARRDAAREANVPEETDADISGAGTALESANEGEDLSKPVYLKGLFSVSTTSSKPLPVIRADIIRVLRQLSVDYDEIKGGFSCCHTPSIEIDKVVDVGPPSPDRQGHVSNHRRRISFGGFLGHDDGKEEIRHTPRSQRRTRAPDHSFVTNSEASEEYLAARDNNVVVGERVMGETTTRVQSDTGENLVLRFEILIVKVPLFSLHGIQFKKVSGGMWQYREMAKKILDALKL

SEQ ID NO: 70019 - protein, 630 aa, Triticum aestivum
MSGHLDRLARPVSGFEGCSSHDDRRSYERRSDFEISEDEKKTRMGSLKKKAIDASSKLRHSLKKKNRRKSGSRVLSVSIEDVRDLGELEEVEAFRQALILDELLPSRHDDYHMLLRFLKARKFDIEKAKQMWTDMLQWRKEYGTDTIVEDFDYTELDTVLEYYPHGYHGVDKEGRPVYIERLGKVDPNKLMNVTTMDRYVRYHVKEFERSFLIKFPACSLAAKRHINSSTTILDVQGVGLKNFSKTARELIMRLQKVDNDNYPETLHQMFIVNAGPGFRMLWSTVKSFLDPKTTSKIHVLGNKCQSKLLEIIDASELPEFLGGTCTCPEYGGCLKAEKGPWKDANILKKVLNGEAQCARQIVTVSNGTETIISYPKSKYQMVRGSDTSTAESGSEAEDVTSPKALRSYISHPKLTPVREEVKMIRATSFSTRMPEYDVPVVDKAVDATWKRELPRKAPVLPKDSSLATTTKASNRSLDQIIPALMAFVIAIVTLLRSVKDVATKRLPDKNESDEQSSAVYQDCIPKEEFRPPSPGPGFAESDLFSLVLQRLAELEAKVHALEAKPSEMPCEKEELLNAAVRRVDALEAELIVTKKALHEALIRQEELLAYVDRKTIAKAQKKKKKPMSCY

SEQ ID NO: 70020 - protein, 1516 aa, Aspergillus oryzae
MTEEKRTGSSRSSSIHEDVTDMRQQYKRRGSKFDDASVFESINPENRAELTRIASNFPLQRRATGSQESEARLQRKDTLEDIGLDHPSLDPTSGQFDQYKWTRMRLKLMDKEGIPRPPSTGVVFQNLNVSGSGSALQYQSTVGSILLEPFRPSGWLSFAKKSPEKHILRNFDGLLKSGEMLIVLGRPGSGCSTFLKTLCGQLHGLKLRKSSEIQYNGVSMEKMHKEFKGEVLYNQEVDKHFPHLTVGQTLEFAAAARTPENRLLGLKRQQFAKHITKVAMAVFGLLHTYNTKVGDDYIRGVSGGERKRVRLVCPIYRDFSGAPMGAWDNSTRGLDSASALEFVKALRLSSNLVGTSHAVAIYQASQAIYDVFDKAIVLYEGREIYFGPCDEARDYFTGMGWHCPPRQTTGDFLTAVTNPQERQARDGMENKVPRTPDDFEKYWKKSPQYAALQQEIDEYHMEYPVGGEAEQSFGEMKRVKQAKHVRPESPYIISIPMQVKLCTIRAYQRLWNDKPSTLTTVLGRIFMALIIGSMYFGTPTASAGFYSKGAALFFAVLMNALISITEINSLYDQRPIVEKQASYAFVHPFTEAFGGIVSDIPVKFVSAVIFNIIFYFLAGLRYEPSQFFIFFLFTFLSTLAMSGIFRTLAAATKTLAQAMAMAGVLVLAIVIYTGFVIPVPQMHDIPWFSWIRWINPIFYTFESMIANEFHGRQFICSQFVPAYPSLSGDSFICSVRGAVAGERTVSGDAFIESQYTYTYTHEWRNLGILIGFWIFFSVIYLLATEINSQTSSKAEFLVFRRGHVPAHMRDLDKTQGDSGSTEVAQSHKEKETENAASVIPKQRSIFTWRNVCYDIPVKGGQRRLLDHVSGWVKPGTLTALMGVSGAGKTTLLDVLAKRVSIGVVTGDMLVDGKTLDNSFQRKTGYVQQQDLHLATTTVREALRFSALLRQPKSVSRKEKYDYVEEVIEMLNMQDFAGAIVGTPGEGLNVEQRKLLTIGVELAAKPELLIFLDEPTSGLDSQSSWSIVAFLRKLADHGQAVLSTIHQPSALLFQQFDRLLFLAKGGKTVYFGEIGDQSRTLLDYFEGNGARACGPEENPAEYMLEIIGAGASGKASKDWSAVWNESPESSNVQKEIDRIYQERASASNGSDDTHHGKPAEYAMPFMYQLWYVTHRVFQQYWREPAYVWAKILLATLSSLFIGFTFFKPNSSQQGFQDILFSAFMLTSIFSTLVQQIMPKFVVQRSLYEVRERPSKAYSWAAFLIANVIVEIPYQILAGVISWACYYYPIYGANQASQRQGLMLLFIVQFYIFTSTFATFIISALPDAETGGTIATLLFIMATTFNGVMQPPNALPGFWIFMYRVSPLTYLIAGMTATGLHGRAIRCDTAELSVFNPPSGSTCGDYLAPYLQSAPGVLYNPSATQGCEYCQLRNADQYLASSNIYYSERWRNYGLGWAYIGFNVMGTVALYYLFRVKHYNPTSLVRGVANGAKLVCRVFKRRSGTTPRGREAENGRLV

SEQ ID NO: 70021 - protein, 123 aa, Brassica napus
MGYAQLVIGPAGSGKSTYCSSLYEHCETVGRTMNVVNLDPAAEIFNYPVAMDIRELVSLEDVMEELGLGPNGALMYCMEYLEDSLHDWVDEELDNYRDDDYLIFDCPGQIELFTHVPVLKNFV

SEQ ID NO: 70022 - protein, 348 aa, Rhodopseudomonas palustris CGA009
MAAGWLNSAHRIARGGNEMAETAVLVTGAAGFIGYHVARELLEAGNVVVGLDSLNDYYDPALKQARLDLLTPYPGFSFVHADLSDRPAIADLFAKHRFPVVIHLAAQAGVRHSLSHPHDYADSNLEGFLNVLEGCRHNGCSHLIYASSSSVYGANTKLPFSVDDPTDHPISLYAATKKANELMAHCYSHLYRLPTTGLRFFTIYGPWYRPDMALYLFARAITEGRPIKLFNHGKMRRDFTFVDDVTRVVTKLMTLVPTAEPGQNGGAPARVYNVGNHSPEELMHVVALLERELGRPAIKEMLPMQPGDVPETFADVEALFRDVGFRPSTPIEDGVRAFVRWFRDYHRV

SEQ ID NO: 70023 - protein, 505 aa, Blastopirellula marina DSM 3645
MTSLEMLPNDEHNAALVKHVHPDDWSNPIPSGRYNLIAIGGGSAGIISALGATGLGGTSALIERKLLGGDCLNYGCVPSKSLIRSARAAHAFATAPSYGVNPVCDPRVEFAQVMERMRRVRADISRHDAALRFAGMGVDVYLGGAKFVAPDAVTVAGQTLKFARCVIATGGRPQIPPIPGLEESGYLTNETIFSLTKLPARLAVLGMGPIGTEMAQTFGRFGSEVHGIERQSRILSREDPSASEVVRQQLAREGVQLHLNHLVTHVERIGDVTRVTIEGEGESKILEVDAILVALGRRPNVEGLDLDKAGVQFNKKGVIVNDRLQTTNPRIFAAGDIAGSYQFTHAADAMARVCLRNALFYGNARLSSLIMPRTTYSDPEVAHVGMTPAQAQEQGLLIDSYREEMKGVDRAAVDGETAGFAVIHTRRGSGKVVGATIVAPHAGEMIGEITLLMSTRRTLDTLADVIHCYPTQVEVLKRIADQYRRTRLSPWVKTAFQKWLAWQRS

SEQ ID NO: 70024 - protein, 228 aa, Brassica napus
MPLGERGGWERSESRYCGVETDFSDDVPSLLSFNISTGGFDYVLALLMNPSYRPSLVEGKGSETQVLPVSGSDLVLAPSQWSSHVVGKISSWIDLDSEDEVLRMDSETTLKQEIAWATHLSLQACLLPTPKGTSCANYARCVNQILQGLTTLQLWLRVPLVKSDDATSEGLTDSWELWNSFRLLCEHDSKLSVALDVMSTLPSETSLGRWMGESVRAAIISTDSFLTN

SEQ ID NO: 70025 - protein, 494 aa, Vibrio vulnificus CMCP6
MNVLARQDRDVHRDQGVMATHDATASELATWFSELQTAYQAEPSASYLVRKHRLLALKKQLSRYQDILAEAMSQDFGGRSHTESIMADVLAPILDINHVLKHLKGWMKPSRRATEWLFKGNQLEVRYQPKGVVGIICPWNFPLYLSIGPMITALAAGNRCMIKMPPNCPQTTRQLRRMLAEIYPTNLVRIVEGTHPEAMDISHLPFDHLVFTGSPTSGKIIMANAAANLTPVTLELGGKSPVVVFDDYEIEKAAQRIAHGKGFNSGQICIAPDYAFVPEGKQEAFIDALKSAHQSMYGDIKANQDYTALVDDAQYQRFHSLLEDARSKGATITQCLEPGEGRKTPLYIATNLTPDMRICQEEIFGPLLPVHTFQAIEEVIDYINQRPRPLACYLFSHHPKQRETLLTQTHSGGVTINGWGWHVLNHSVPFGGVGNSGIGNYHGEEGFRELSHARTVLKMRDWFPIQLFAPPYGNWVQKLVVRVFAGKPDPTLKE

SEQ ID NO: 70026 - protein, 408 aa, Malus x domestica
ALGEDSPYFAGWKAYDENPYHESSNPSGVIQMGLAENQVSFDLLEKHLEENSEASNWGSKGTKGVSGFRENALFQDYHGLLSFRKAMANFMEQIRGGRAKFDPVRVVLTAGATAANELLTFIIADPGDALLVPTPYYPGFDRDLRGRTGVNIVPIHCESSNNFQITPQALEAAYKEAEAKNMRVRGVLITNPSNPLGATIQRAVLEEILDFVTQKNIHLVSDEIYSGSAFSSSEFISVAEILEDRQYKDAERVHIVYSLSKDLGLPGFRVGTVYSYNDKVVTTARRMSSFTLISSQTQHLLASMLSDKEFTGNYIKTNRERLRTRYDMIVQGLKKSGIECLKGNAGLFCWMNLSPFLDEPTRECELTLWDSMLHEVKLNISPGSSCHCSEPGWFRVCFANMSEQTLEG

SEQ ID NO: 70027 - protein, 363 aa, Bacillus anthracis str. A2012
MGILMKKDGGNMTIDRVCTIGPASNNKETLAKLINNGMKIVRLNLSHGTHESHKDIIRLVKSLDDSIKILGDVQGPKIRLGEIKGEQITLQAGDSFMLRTQPVTGSSTEASVDYEGIANDVKVGSRILMNDGEVELIVEKVSTDKIETKVKTGGNISSHKGVNLPGAIVSLPAITEKDKKDIQFLLEEDVDFIACSFVRKPSHIKEIRDFIQQYKETSPNLIAKIETMEAIENFQDICKEADGIMIARGDLGVELPYQFIPLLQKMMIQECNRTNTYVITATQMLQSMVDHSIPTRAEVTDVFQAVLDGTNAVMLSAESASGEHPVESVSTLRLVSEFAEHVKKDGPFVMKDVLELLHKSLDE

SEQ ID NO: 70028 - protein, 448 aa, Zea mays
MGTCGRRVLGVWFFFWFLLTLEQCTSLNREGAALLRFKAAIEADPYGALLDWNQESLSPCTWFGVECSDDGLVMSLSLANLGLKGVLSPELGKLMQMKSLILHNNSFYGTIPREIGDLQDLKMLDLGYNNFSGSIPSELQHILSLEFLCRFLEGITLFRRSELETACEGFSNIIDTLPGFTLFKGTLPCGAEIAVASTSVAYAGGWSAIDEAHYMNKVGALSKVNHKNLLNLVGYCEDEKPFIRMMVFEYASNGSLFERLHVKEAEHLNWQSRLRIAMGVLYCLQYMHQQNTPVTLKNLNSSYIYLTEDDAAKVSDISFSVDKREDDEYDAPDEYSTVYKFALLLLETISGRRPYSEDDGLLVLWARRYLTCASPVMGMIDPTLNSVPEEHARALSELIRLCLSEDRRQRPTMAEVTKRMQEITGITQDQAIPRNSALWWAELEIMTS

SEQ ID NO: 70029 - protein, 487 aa, Dinetus truncatus
  misc_feature (473)..(473): Xaa can be any naturally occurring amino acid
NPTTSGSEVSAVEKKNLGRIVQIIGPVLDVAFPPGKMPYIYNALVVQGGDNEQTNVTCEVQQLLGNNRVRAVAMSDTDGLMRGLEVIDTGAPISVPVGGSTLGRIFNVLGKPVDNLGPVDTNTTSPIHRSAPAFIQLDTKLAIFETGIKVVDLLAPYRRGGKIGLFGGAGVGKTVLIMELINNIAKAHGGVSVFGGVGERTREGNDLYMEMKESGVINEETVAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVXNIDEATAKAMNLKT

SEQ ID NO: 70030 - protein, 336 aa, Arabidopsis thaliana
MNRAPDQSSFLRSRRSKALYQFKQQKLPACKPVLTPISVITVFMLMGFVFIPIGLITLRASRDAIEIIDRYDVECIPEEYRTNKLLYITDSSIPKNCTRYLKVQKYMKAPIFIYYQLDNYYQNHRRYVKSRSDQQLLHGLEYSHTSSCEPEESSNGLPIVPCGLIAWSMFNDTFTFSRERTKLNVSRNNIAWKSDREHKFGKNVYPINFQNGTLIGGAKLDPKLPLSDQEDFIVWMRAAALLSFRKLYGRIEEDLEPGKVVEVNLMNNYNTYSFSGQKKLILSTSNWLGGRNDFLGITYLVVGSSSVVISIIFMLLHLKNPRPYGDNSWNKKSLSS

SEQ ID NO: 70031 - protein, 249 aa, Arabidopsis thaliana
MAQDHDETENKTFADVVGGDDVGEIVNGGTKNGYRKPDSVEKEDDEDLKSLYSLICLTIGSIMFPDSKTGDASSFLERVRNSVAENGPKLREASERTGREILLWTRRGSSLRALLVITMGTIVLLTTMALVVFTLFFVAATANAIIISLLISLAVAGGFLALFFLCLTGVYIGALSVAAFVISTATVSAVVSVLIASGWIGFFYAVWLGTRGSLRLAKQSVSVVGSAISGNTISRHQHQDREVNIESTN

SEQ ID NO: 70032 - protein, 414 aa, Arabidopsis thaliana
MATGPVVHPQPVRGDPIDLKNAAAKNRRALGDIGNVDSLIGVEGGKLNRPITRNFRAQLLENAQVAAAANKKAPILDGVTKKQEVVRAVQKKARGDKREPSKPIEVIVISPDTNEVAKAKENKKKVTYSSVLDARSKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVNDLVYVTDNSYNSRQILVMEKTILGNLEWYLTVPTQYVFLVRFIKASGSDQKLENLVHFLAELGLMHHDSLMFCPSMLAASAVYTARCCLNKTPTWTDTLKFHTGYSESQLMDCSKLLAFIHSKAGESKLRGVLKKYSKLGRGAVALISPAKSLMSSAP

SEQ ID NO: 70033 - protein, 346 aa, Synechococcus sp. RS9917
MFGLIGHSTSFEAARQKAFELGFDHIADGDLDVWCSAPPQLVETFDVTSPTGRTITGAYIDSCFVPEMLSRFKTARRKVLNAMELAQKKGINITALGGFTSIIFENFNLLQHQHVRSTTLEWERFTTGNTHTAWVISRQVEINAPRLGIDLSKARVAVVGATGDIGSAVCRWLSQRTGVAELLLVARQQQPLLDLQKELGGGRILSLDEAVPEADVVVWVASMPRTLEIDAASLRQPCLMIDGGYPKNLNARIAGSGVHVLKGGIVEFGSDIGWNMMELAEMEKPQRQMFACFAEAMLLEFESCHTNFSWGRNNITLEKMDFIGEASRRHGFSTLNLSAPVQVAAA

SEQ ID NO: 70034 - protein, 454 aa, Gibberella zeae PH-1
MTPSHANLSTRGELFASPAYRQSLLDILSDLWHPETKSSGYTLMHKELIQHMTQNVKPPSHQYWVHANGFKLTITSHSLTCGDGFSGSHRLRDVLARFINRNFNPHEAVTNDQLIITSGVGRAIELSGFSLCDKGDGVLLGRPHYGNFPIDFGYRAEAKIIGVSFGDVDPFSIEAVELYEKTLTDAQDQGIRVKALLLCNPHNPLGRCYTPEVLQAYMRLCQKHSLHLLSDEIYALSVWENDNVPEAPGFTSVLSIDTNGLIDVNLVHALWGMSKDFGANGIRIGCLITRNEAFMRACVANSDLSGPSSLSDLAAASILSDDAFLESFIKTNRLRLAENYKIVTEFLTNHDIPYKEGSNAGLFVWADLFAPNSALINDSVMKQDDAGAALMTMEENMTEILLKERIFVASGGDFGTDVSGWYRIVFAHERTYLLEGLERIVRAVKKFCRDSKDY

SEQ ID NO: 70035 - protein, 831 aa, Aquifex aeolicus VF5
MKGVILAGGFGTRIQPLTNSIPKPMLPVANRPIMEHVVHRLKEAGIEEIVVLLYYQAEVIKNYFKDGSDFGVKITYVQPEADYGTAGAVKQAQNYLNETFIIVSGDVITDFNLSELIAFHKSKSSKFTLALYSVENPLQFGVVITNKEGKVLKFLEKPGWGEVFSDTVNTGIYVVEPEILNYIPEDKPFDFAMDLFPKLMKSGIDLWALKMRGYWRDIGNIDSYRDVHKDIFAGLVKIRIPGRIITTKEARIYVEEGTEIPENVSLKGTVILGKNVKVGEGSELKNCVIGNNTVIGRNVKLFDSVLWWNVSIDEESEIRNGVICNDVKIGKRVKAKEGVVIAEDCEVEDEVLFLKDVVVWPEKVIEKGSVVTKNIVCESKWEKGIFKGNKVIGRINVELTPDNATKLGMALGSVLPPKSTVILARDYHRASRTIKRSFLGGILSTGINVIDLHLSPLPVMRFTLTEDKKAVCGVYFSISQEFPGSVEICVFDENGLPIDTNFQKKIERVFFREAYRFETFTDLGLIKEKPYFSENYVTKLLSSIDGDSIKLSSNKVVYDALHSPISPFISEVLGKLEIENVILNALYDERKLSRISTYASSSEGNVSKVLKALSYDVGFVMEPSATKLKLVDDRGRTISGDRLLLVVLMLLDKSAEKQLRVYLPVWAPEVLDAILNNVIVERGKFTNLRKSFIEDFYMLADTDGSFTFTEFSYSPDALYASLKIMEMLTKLKVKVSEIYDSLPEYYFLHEVVSCSSEKKGTVLRKISEMAEGKEASFIEGVKIYEDYGNWVLVLPDSYKDLIHVYVQSTERERAEELIKNYMEIVRGICKK

SEQ ID NO: 70036 - protein, 460 aa, Oryza sativa Indica Group
MAMAAASAMRPLAPLFLFFFFSLAASASDNILANSSLADGQKLVSAGGVFELGFFTPPGSTTAARFLGIWYRDIDPPTVVWVANRDAPVSGTAGSLAVVVNGGGGGGGGGGRLVLGDGSGRVVWSSAPSNVTASDPVAARLLDSGNFVLAGGGGAGDVIWQSFDYPSDTLLPGMKFGWDLTTGLDRYLTTWRSAGDPSPGDYTFKIDPRGAPEGFIWYNGTSPVYRNGPWDGLQFSGEPEMEPNNTSFRFEFVANRTDVYYTFVVDGGGGGGVLSRFVLNQSSAQRYVWLPQAGGWSLYWSLPRDQCDQYAHCGAYGVCDVGAASMCGCPAGFAPASPRNWELRDSSAGCARRTRLNCTGDGFLPLRGVKLPDTTNATVDAAIAVDQCRARCLANCSCVAYAASDVRGGGSGCIMWSSPLVDIRKFSYGGEDLFMRLAASDLRMILLSSLVRMPYTFLRF

SEQ ID NO: 70037 - protein, 446 aa, Arabidopsis thaliana
MKQSKTLEFNSFALLCSLHFIKFNTEDSMSSFNGDSMDDFKGLRITQLDDDDDDETAVEPINMDEFDDDDEEDDEDYEPVMLGFVESPKFAWSNLRQLFPNLAGGVPAWLDPVNLPSGKSILCDLCEEPMQFVLQLYAPLTDKESAFHRTLFLFMCPSMSCLLRDQHEQWKRAPEKAMRSTKVFRCQLPRANPFYSSEAPKHDGTDKPLGHGAPLCTWCGTWKGDKLCSGCKNARYCSPKHQALHWRLGHKTECQQLRTVSETSDSGPVNNGVAPTEKQKVASKSLWKEFVLINEDESEYDTEMSGDDEVAKPLVSKREVDDQMKSLMNDFEGDADKKNWVNFQQRVDKAPEQVLRYSRSSGAKPLWPIASGRVSKSELPSCKSCGGPRCFEFQVMPQLLFFFGGKNERESLDWATIVVYTCENSCDSSLSYKEEFVWVQLYSQTT

SEQ ID NO: 70038 - protein, 827 aa, Aspergillus nidulans FGSC A4
MPGDIPTKVGHGLAKVLRLKLPEKPQPDAVTRGESTFSVGTFDTYSYVEPEPTAAEWFAEITPSWKEIGLYFYRLFPFLSWITRYNTTWLIGDLVAGITVGAVVVPQGMAYAQLAQLPVEYGLYSSFMGVLIYWFFATSKDITIGPVAVMSTLVGNIVTEAAETLPDVEPHVIASCLAVICGGIVTFMGLARLGFIVDFIPLPAITAFMTGSAINICSGQVSTMLGETDKVNTRGATYNTIIQTLRALPSSTLDAAMGVTACAMLYIIRFACNTAAKKQPHRAKMWFFISTLRTVFVILFYTMISAATNLHRRDNPAFKVLGTVPRGFKHAAVPTVNAEIIKTFASELPAAVIVLLIEHIAISKSFGRVNNYTIDPSQELVAIGVTNLLGPFLGGYPATGSFSRTAIKSKAGVRTPLAGVITAVVVLLAIYALPALFWYIPKASLAGVIIHAVGDLITPPNVVYQFYRVSPLDCVIFFVGVIVTVFTSIEIGVYCTVCISVAVLLFRVAKARGEFLGRVTIHSVVGDHVLEESKPGLGDADRTRSIFLPLNHADGSNPEIEIEQPYPGIFIYRFSEGFNYPNANHYTDYLVETIFQKTRRTNPFTYSNPGDRPWNNPGPRKGKQEEDRSHLPTLRAVILDFSSVNNVDVTSVQNLIDVRNQLDIYASPHTVQWHFAHVKNRWTKRALAAAGFGYPTPQSEDGFHRWKPIFSVTEIEGQSSAAAHAEIVANENTRQASSHGHDLESGIKNPSHTAERETHGIEESSNSSIGEDDKLQRDLKDSKAYQNRRKMAVVQGVNLPFFHIDITSALESALANSQEEPADVSSD

SEQ ID NO: 70039 - protein, 334 aa, Klebsiella pneumoniae subsp. pneumoniae MGH 78578
MSSLAFSETRLPHIVILATGGTIAGSAASNTQTTGYKAGALGVQTLINAVPEMSKIAHVEGEQVANIGSENMTSDIILQLSKRVNALLARDDVDGVVITHGTDTLDETPYFLNLTVKSNKPVVFTAAMRPATAISADGPMNLLEAVTVAADPDARGRGVMVVLNDRIGAARFVTKTNATSLDTFRAPEEGYLGVVVGGKPQFETRVDKIHTLRSVFDVRQLKVLPKVVIIYGYQDDPEYMYDAAIAHHADGIIYAGTGAGSVSVRSAAGIKKAQQAGIVVVRASRTGSGVVPPDDSQPGLVADSLNPAKARILLMTALTQTKDPQLIQQYFHTY

SEQ ID NO: 70040 - protein, 257 aa, Listeria monocytogenes EGD-e
MDSEKIDYLARLWIMEAAAKIKQSFKETLDIDVKSGRNDLVTNMDKETEAFFVQQIKDHFPDHCLFGEEGMASDVTDLDGVVWILDPIDGTLNFVEQQRDFAISLAVYEDGIGRLAYIYDVTRDELYFGEKGKGATVNGRTIPKLDPAIDLKDTLLIANLSVTRKFPTMWEAVKVSRGLRLHGAASLEYMDVATGRAGAYLSANLAPWDIAAGKIIVEELGGKVTRINGEKINMLEKGSSIVASPKIHQTLLDNYLP

SEQ ID NO: 70041 - protein, 470 aa, Arabidopsis thaliana
KLVLTGQLPDYSDGKCRLCEKKIDSPLFYHCSPCNFTLDMRCALNPPSISFEDSKTHDHQLTLLPRLDSFTCNACGLKGDRSPYICVQCNFIIHQECLTLPRLININRHDHRVARTNLLGLVYSVCGVCRQKVDWTWGGYSCQRCSNYVVHSKCATRKDVWNGKELEGVIEETEDIEPYVVIDDNTIQHFSHEEHYLKLDDNGVLCDENKRCSACTHSVCLESFYGCMDCDFILHQNCAKFPKRKRHVLHNERLTLFTREAGHFWCNVCGRISNGFSYQYGDMKLDVICCSVLEPFVHPSHPDHPLYYISPEMEEVCNGCNMSGTRMLRCIEDGCGFVLCFKCATLPRVLKHRVDDYPLLLCYGEKANGIYWCEICEKKMNPEKWFYTCKDQWASLHTECVVGDFSGLMPGSVVKAETGSYEVVLNKNVSRPFCRQCKSHCMYPIIYKIPETSVSYLCSDICIKRFTKRD

SEQ ID NO: 70042 - protein, 493 aa, Pseudomonas putida KT2440
MTLVRFQMCIDGQWRDAQSGKTFDSLNPATAQAWAQLPDADEADVELAVQAAQRAFDSKAWRSITATARGKLLRRLGDLIAENKEHLAQLESRDNGKLIRETRGQVGYLPEFFHYTAGLADKLEGGTLPLDKPDLFAYTVHEPIGVVAGIIPWNSPLYLTAIKLAPALAAGNTIVLKPSEHASATILELARLALEAGFPAGVVNVVTGYGPSTGAALTRHPLVRKIAFTGGAATARHVVRSSAENFAKLSLELGGKSPNIIFADADLDSAINGAVAGIYAASGQSCVAGSRLLVQDEIFDEFVERLIARAKRIRIGNPQDDASEMGPMATAQQLAVVEGLVAAAKAEGAKLHMGGKRADVEGDGWFYEPTLFECDSNAMTIMQEEVFGPVAAVIRFKTEEEALAMANDSQFGLAAGIWTRDLGRAHRLARDVRSGIIWVNTYRAVSAMAPIGGFKNSGYGRESGIDSVLAYTELKTVWINLSTAPMPDPFVMR

SEQ ID NO: 70043 - protein, 432 aa, Moritella sp. PE36
MTQKTHSESMKFDQQHIWHPYTSMTKPLPCYHVDSAEGVYLTLNDGTRLIDGMSSWWASIHGYNVPALNQAMQRQASKMSHVMFGGITHQPAINLCQKLVDITPDGLECVFLADSGSVSVEVAMKMAIQYWHHQQPTKKKFVTIRNGYHGDTFGAMSVCDPDNGMHELFTGFLAPQFFIDAPSIKFNQQWQQSAMQDLEQTLVDNHQQIAAFILEPIVQGAGGMKFYHPEFLRQAKLLCERFEVLLIADEIATGFGRTGKLFACEHAGITPDIMCLGKGITGGYMTLAATLTTRHVAETISNGPSGVLMHGPTFMGNPLACAVANASIDLLMTSDWQQQVARIEKQLQQAILPLVEHDNVSDARVLGSIGVIETKRSIDLAKAQVLFVELGVWIRPFGKLLYIMPPYIISETELDTLCNVIKQVLDADIWAK

SEQ ID NO: 70044 - protein, 172 aa, Synechococcus elongatus PCC 6301
MKRTLSVLVEDEAGVLTRIAGLFARRSFNIESLAVGPAEQVGISRITMVVQGDDREIEQITKQLYKLINVLKVQDISEVPCVERELMLIKVNANSSNRSEILELVQIFRARVVDVAEDSLIVEVVGDPGKMVAIVQVLQRFGIREISRTGKVALTRESGVNTEFLKALEARV

SEQ ID NO: 70045 - protein, 435 aa, Streptococcus agalactiae 2603V/R
MSIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 70046 - protein, 85 aa, Taraxacum officinale
KCFQTVELWVAIATFVGRKLTRRETTSELHLLLRPQDSTYVGEVQLSVHHCLLALPGVRKEYLNRVISHPQALSQCELTLTKLGL

SEQ ID NO: 70047 - protein, 488 aa, Aspergillus oryzae
MTIEQRANLGRVNVELNKIKKISFKLSMTIMDSVAIIRNQLKERGVENHDLIQACYAFATEFGKRSSNVDPNRRAMNTARLVELSLDWVSFICDDCDAADRKTFKWAVSALEFAMAITSNRRVDEDAKRQALGRVLEGSNEADRSLAVLSSSATNVTLRWQQGQFIGGGTFGSVYAAINLDSNYLMAVKEIRLQDPQLIPKIAQQIRDEMGVLEVLDHPNIVSYHGIEVHRDKVYIFMEYCSGGSLASLLEHGRVEDETVIMVYALQLLEGLAYLHQAGIVHRDIKPENILLDHNGIIKYVDFGAAKIIARQGRTVVPMDAFASAGHKEAIVPKDAQIANQRGKNQKTMTGTPMYMSPEVIRGDSNKLIHRQGAVDIWSLGCVILEMATGRRPWSALDNEWAIMYNIAQGNQPQLPTHDQLSDMGIDFLRRCFECDPLKRPTAAELLQHEWIVSIRQQVVLEPPTPSSDHSGSISSSTSGSRQNSTYL

SEQ ID NO: 70048 - protein, 122 aa, Nostoc punctiforme PCC 73102
MDCIHLTGIRGYGYTGYLPEEQVLGQWFEVDVRLWLDISTAAKTDAIEDTLDYRSVISLIQHLIKTSKFALVEKLVATIADSILQECDRVTQVQVILSKPAAPIPDFGGKISIELTKSKSNL

SEQ ID NO: 70049 - protein, 300 aa, Mycobacterium sp. JLS
MTKWTTADIPSQSGRTAVVTGANTGLGLETAKALAARGAHVVLAVRDTEKGKRAADEIAAAHPEAAVSVQSLDLGSLRSVRAAAEALKADFPRIDLLINNAGVMYPPKQTTEDGFELTFGTNHLGHFALTGLLLENVLAAPNSRVVTVSSQGHRIRAAIHFDDLQWERSYSRVGAYGQSKLSNLLFTYELQRRLDTRDAIAVAAHPGVSNTELMRHLHLPSVFNPLVGVLTQSPTMGALPTLRAATDPTVRGGQYFGPSGLGEIRGYPELVTSSAQSRDVDLARRLWTVSEELTGVAFPL

SEQ ID NO: 70050 - protein, 337 aa, Rhodopseudomonas palustris CGA009
MTVLVTGGAGYIGSHTVLALVEAGESVVVIDNLSTGFSQFVPEGVPLFIGDAGDENLVDGVIASHRVDAIIHFAGSVIVSASMRDPLGYYRNNTSTSRSLLSAATRRGVKNFIFSSTAAVYGNPDRIPVGEDAPTRPLSPYGRSKLMTEIMLHDAAEAYGVNYVALRYFNVAGADPLGRVGLATEGATHLIKIAVEAATGQRSRIDVYGTDYPTTDGSCIRDFIHVTDLAEAHGAALGYLRAGGGPVTLNCGYGHGYSVFETIDAVKRVAGRNFAVAAASRRPGDIMTMIADTSRIRRTLDWIPRYDDLDTIAAHALGWEEKLLRQRQAVELQAIPA

SEQ ID NO: 70051 - protein, 521 aa, Solanum tuberosum
MAASIGALKSSPSSNNCINERRNDSTRAVSSRNLSFSSSHLTGDKLMPISSLRSQGVRFNVRRSSLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGLVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPLVASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVEIINKDNVQEAARETDGYFIKSGIVTVIKDALIPSGIII

SEQ ID NO: 70052 - protein, 457 aa, Yersinia pestis CO92
MEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 70053 - protein, 78 aa, Helicobacter pylori
MALFEDIQAVIAEQLNVDAAQVTPEAEFVKDLGADSLDVVELIMALEEKFGIEIPDEQAEKIVNVGDVVKYIEDNKLA

SEQ ID NO: 70054 - protein, 313 aa, Yarrowia lipolytica CLIB122
MRFYVILVLLTTLVLASVGDRSPDFRNCVTNCIRHTCQTQKYVPPLMHRLLLWDCPQECDYRCQQIITFARLNQGQEIVQFHGKWPFFRFFGIQELASVVFSLANFVPHYRGWLMLKHLNQRKPNPLIPYYIGFALVGMNSWIWSAVFHTRDFPVTEKLDYFSAGLSVLYGFFFATVRIFRLDRDSRETTRLVLASVCVTLFLAHVSYLSFIKFDYGYNMTANVVVGALQLIMWSVYSFTQFAKTHQWWSLMPFGLCVTISAAMGLELFDFPPWKFFIDAHSLWHAATVIPCFLWYTWMKKDLQYEERAEKQE

SEQ ID NO: 70055 - protein, 178 aa, Arabidopsis thaliana
MSGVAIHASSWGAALVRISPYTFSAIGIAISIGVSVLGAAWGIYITGSSLIGAAIEAPRITSKNLISVIFCEAVAIYGVIVAIILQTKLESVPSSKMYDAESLRAGYAIFASGIIVGFANLVCGLCVGIIGSSCALSDAQNSTLFVKILVIEIFGSALGLFGVIVGIIMSAQATWPTK

SEQ ID NO: 70056 - protein, 493 aa, Frateuria sp. ANA-18
MSKKFIEQHGLWTDVQKAAAVEVLKQADQAGLQMIRLSWPDQYGLLRGKMLSIAALRSAFGSGSEITMAPFFFDTASAIVFNPFSADGGFGSAELAGSPNVVMVPDPTTFHILPWADRTGWMLADLYMTSGRPFPLSPRAILKKGLRELEALGYDFQAGLEVEWYLTRIVDPCLDPETIGSPGTPAAPPKVMPVAKGYSYLLENHLDEVEPIMAEVRHHLLALGLPLRSIEDEWAPSQMETTFDVMPGLDVADSMVLFRNAVKQICRRRGYLASFMCKPAINGFYASGWHLHQSLTARDTGFNAFIPQQGEPLSQLGQAYVGGLLEHACAASSFTTPTINGYRRRRPYSLAPDRVTWAKDNRAAMARVISAPGDPASRVENRIGEPAANPYLYLASQVFSGIDGIRRQRDPGPLQETPYASRCDDFDRTTCPRALEALESSSFFREAFGDEFIHYWLHLRRSEWKRFTEAEGEVDMAADPVTHWEHREYFELF

SEQ ID NO: 70057 - protein, 371 aa, Brassica napus
MTMAATFAKRLIGSRSSQILGTVNSTSTATTRAFCSSTTPITATLFPGDGIGPEIAESVKKVFTTAGVPIDWEEHFVGTEIDPRTQSFLTWESLESVRRNKVGLKGPMATPIGKGHRSLNLTLRKELNLYANVRPCYSLPGYKTRYDDVNLITIRENTEGEYSGLEHQVVRGVVESLKIITRQASLRVAEYAFHYAKTHGRERVSAIHKANIMQKTDGLFLKCCREVAEKYPEITYEEVVIDNCCMMLVKNPALFDVLVMPNLYGDIISDLCAGLVGGLGLTPSCNIGEDGVALAEAVHGSAPDIAGKNLANPTALLLSGVMMLRHLKLNEQAEQIHRAIINTIAEGKYRTADLGGSSTTTDFTKAICDHL

SEQ ID NO: 70058 - protein, 465 aa, Aquifex aeolicus VF5
MEFDLIIVGAGSGGYEAGLYAFRRGMKVAFVELSPETVGGNCLNRGCIPSKYMRHGAYLLDKFQKMEQYGIISKGYDIEYKKLKEGRDNVVVTIRENFKKFAQQLRIPIYYGKGVLKDPNTVFVEGPEETLKAKYILVATGSSPTSVGNLVPDGKYVIDTDQIWEIDYVPKKVLIVGGGAVGVEFAYIFRKYGSEVVLVEIKDRLLPTPDIPEDSGRYLARKLRELGVDIRTRTSVESWEKTQNGVKAKLTDGSEVVADFILLGVGRKPNTKGIGLEELGIEMDERGFVKTNEYAQTNIPNIYACGDITSPLMLAHKSMYEGKIAVSHILGERDWKKNERIIPKIIYSALEVASVGLTEEQAEDEDIEVRVGVASFVSNPKAMDDGENEGFVRIVADDETGEILGCHIVGPHAGELIHQVVHMIKDGKTVEFASKTMYSHPSLSENIGIASSEVYYGPISWVKRR

SEQ ID NO: 70059 - protein, 421 aa, Coprinopsis cinerea okayama7#130
MTTASINSVTRQIAALEISNKKQGGGISSSSSSSSSFRPGHTKQPSGTNVAKLLTKFSAPNPYTNSSKPTASSSLRNLNQNQASGTSSSSSSSSSSQQSSKSSSRSQTTQPLDIGSYDGGLETENEKRGEKVYGEAAQDLALDSSVNGKNPTREWTLHDFEMGRPLGKGKFGRVYMVRTKCEPRYILALKTLYKSEIVQSRVEKQIRREIEIQQNLRHPNVLRLYGYFHDEKRIFLMLEFAGKGELYKQLSKYGHFSERRSARYIYQMADALIYLHSKHVIHRDIKPENLLLGINGELKIGDFGWSVHAPGNRRMTLCGTLDYLPPEMVEGKEHSERVDYWALGVLTYEFLVGAPPFEDKNSVNNTYRRIARVDLKFPSYLSPEVKDLIAKLLQHDPSKRLALTEVIRHPWLIKHRAIPTS

SEQ ID NO: 70060 - protein, 365 aa, Mangifera indica
QMGLAENQLCFDLIEDWIRKNPYASICTAEGVDEFKEIANFQDYHGLPEFRKAVAKFMGKVRGGRVTFDPDRIVMGGGVTGANEQIIFCLADPGDAFLVPSPYYPAFDRDLGWRTGGEIVPVPCDSSTNFQITRDALEEAYEKAREANINIKGLIITNPSNPLGITLDRDTLKSLVSFIDEKNIHFVCDEIYAATLFCPPKFVSVAEVIQEMDCNLDLIHIVYSLSKDMGLPGFRVGIVYSYNDAVVSCIRKMSSFGLVSSQTQYLLASMLSDDEFVEKFLAESSKRLAKRYHIFTKRLEKVGINCLKGNAGLFFWMDLRHLLQQETVDAEMKLWGTILNDVKLNVSPGSSFHCQEPGWFRVCFA

SEQ ID NO: 70061 - protein, 450 aa, Pseudomonas putida KT2440
MSSLNMYTLTEESKFNRFHGLILFWCVLILIIDGYDLAVVGAALPAIMADMQIDATSAGVMAGSALFGTMLGAIFLGTLADRIGRPKMIAICVALFSVFTAAAGFTDSPLTFSIMRFIAGLGIGGVLPICTAQMGEFSPLKVRTRLVTIVFAGYSVGGILVALTGKQLIESYGWQYVFYVAVLPVVLIPFILKSMPDSIGFMLKQGRQDELKVIARRLRPDLVIKDDTQFVGNPQIISAQDKPVRSLFLEGRGYSTVMIWMAFMTGLFMVYALNSWLTKLMAMAGFSLGSALNFVIVFNLGSIFGAILGGWLSDKFSIKHVLVVFYVVGAVALTLLGYTRSTELLFVVVFIVGASTLGTQLLAYAYAGDFYPSTIRSTGVGFASGVGRVGAIVAPVLIGALVSMALPLEQNFMAIALAGLVGAVAVTMINQSRSDSAVVRKKATVAHELT

SEQ ID NO: 70062 - protein, 290 aa, Listeria monocytogenes EGD-e
MKVKKAVIPAAGLGTRFLPATKAMPKEILPIVDKPTIQFIVEEAVASGIEDILIVTGKGKRAIEDHFDSVPELENNLREKNKLDLLHLVEETTNINLHFIRQSKPKGLGDAILQAKGFIGNEPFVVMLGDDIVQSKTPCAKQLIDQYEKTHSSVIGVQNVPREETYRYGIIDPDKEVSDRLYNVTGFVEKPNVEDAPSNLAILGRYLLTPEIFKYLETQEAGSGGEIQLTDAINRLNEIQPVFAYDFEGERFDVGDKFGFIETTLKFALKHPEIKDDVRDLIIRLGDELK

SEQ ID NO: 70063 - protein, 374 aa, Natronomonas pharaonis
MGLLARLKAIGPGALVAAAFVGPGTVTTASVIGAEYAYLLVWTIAFSILATMVLQEMSARLGLITRDGLGEALRNEFSNPLAKWATVGLVVSAIGIGTAAFQTGNIVGGAAGLATITGVSENVWGPAIGLVAAALLWSGNYKLIERVFIALVAVMGVAFVLNTIIVRPDLGALGGGLVPTIPEGSAYLIVGLVGTTVVGYNLFLHASTAQERWDDKSDLTECRTDTIAMVAAGGIITTAIVVTAAAVFPAGTEIDDVGEMANQLEPVFGGYALTFFAVGLFAAGFTSAMSAPLAGAYATAGALGWERDLTSMRVRAIWMTILGVGIVGSAMDLNPVSVIVFAQVANGLLLPILAVFLIYAMNNDDLLGEYTNSR

SEQ ID NO: 70064 - protein, 244 aa, Synechococcus elongatus PCC 6301
MFKTLAADFRIIFERDPAARNGLEVLLCYPGFQALVCHRVAHWLYQQRLPVIPRLLSHLSRLLTGVEIHPGARLGQGIFIDHGMGVVIGETAIVGDYCLIYQGVTLGGTGKQSGKRHPTLANNVVVGAGAKVLGNIQIGENVRIGAGSVVLRDVPSDCTVVGIPGRVIYRSGVRVDPLDHSQMPDSEARVIRMLLDRIEALEDQLEGLNLPPAEEAIDVTLAPVGDRCQLRDRTIEEFLDGAGI

SEQ ID NO: 70065 - protein, 244 aa, Oryza sativa Japonica Group
MSSTNNSSGEPPPAVRVLGGWASPFTNRVVVALKLKGVEHEMLQETVGKKSELLLRSNPVHKKFPVLLHHSKPLPESLVIVEYIDEVWPASNGGAPAILPRDPHGRAVERFWARYVDDKILPGLRVLRGSVAGDKDQTAGEMSTTLQRLEEAFVKCSQGKEYFGGDSIGYLDIALGSFLGWIKAVEKIAGVELLNETKLPILAVWADRFCAHPAVVDVVPDADKLVEFTVQYGSVLNTVNVLPK

SEQ ID NO: 70066 - protein, 822 aa, Oryza sativa Indica Group
MAAARGGRRRRPCSCGSPFLMMLISCLLWLHREAAPSLAADTVTVGRPLSGGQVLVSRGGKFALGFFQPDNSSQRWYMGIWYNKIPDHTKVWVANRRAPLSDPDTSRLAISADGNMVLLDRARSPVWSTNVTTGVAANSTVGVILDTGNLVLADASNTSVVLWQSFDHFGDTWLPGGRLGRNKLTGEVTRLVGWKGYDDPTPGMFSLELDPGGASQYVMSWNGSSRLYWSSGNWTGGMFSSVPEMMASNADPLSLYTFNYVDGENESYFFYDVKGEVVLTRFVVDVTGQIKFMTWVDSAAQWVLFWSEPKAQCDVYSICGAFGVCAEDALPACSCLRGFHARQPRRWLQGDHTAGCARSTALQCGGGGGAQPAAQKTKSDRFFVMPNVNLPTDGVTAASASARDCELACLGNCSCTAYSFNGSCSLWHGDLISLRDTTGAGNGGGRSISIRLAASEFSGNGNTKKLIIGLVVAGVAAAVILAVVVTVLVRRSRRLKALRRVEGSLTAFTYRDLQVATKSFSEKLGGGAFGSVFKGSLPADGTPVAVKKLEGVRQGEKQFRAEVSTIGTIQHVNLIRLLGFCTERTRRLLVYEHMPNGSLDRHLFGHGGGVLSWEARYQIALGVARGLDYLHEKCRDCIIHCDIKPENILLDDAFAAKVADFGLAKLMGRDFSRVLTTMRGTVGYLAPEWITGTAITTKADVFSYGMMLFEIISGRRNVEQGQDGAVDFFPATAARLLFDGDLKGAVDGRLAGNADMGEVERACKVACWCVQDSEATRPSMGMVVQVLEGLVDVNAPPMPRSFKVLGDPSNYVKFFSALPSIS

SEQ ID NO: 70067 - protein, 478 aa, Prochlorococcus marinus subsp. pastoris str. CCMP1986
MAERFSQKNLRVRPSSDEDKIVTNAKKHFEKTLVEISGELVGSVAALEHPTKNLKLNYGEIFLRDNVPVMIYLITQKRYDIVKKFLKVCLELQSTNYQTRGVFPTSFVEEEGKLIGDYGQRSIGRITSADASLWWPILCWFYVNKSGDHSFGKSQSVQRGIQLLLDLVLHPTFEGTPVLFVPDCAFMIDRPMDVWGAPLEVEVLLHGCLKSCINLMELSREDHVSRLLDQRLILTSQWVEDLRSFLLKHYWVTSQTMQILRRRPTEQYGDDQHFNEFNVQPQVVPSWLQDWLENRGGYLIGNIRTGRPDFRFYSLGNSLACMFGVLPSEEQRALFRLVLHNRQHLMAQMPMRICHPHMDVEEWQNKTGSDPKNWPWSYHNGGHWPSLLWYFGASVLLHQKKFPTEDVILMEEMRSLIEESYWCQLNQLPKQEWAEYFDGPTGTWVGQQSRTYQTWTIVGFLLMHHFLREENDLDMFNL

SEQ ID NO: 70068 - protein, 213 aa, Oryza sativa Japonica Group
MVVYNDECEIAPEHEREEAPRTAKKLSWWALSFSLSNVWCKFYRKSQAWNSTASFSDVDEKNRKGGDAEDDFTHSRPDHVFRGVHRAIICGKVGQVPVQKILRNGHTVTVFTVGTGGMFDQRTVGAENLPMPAQWHRISVHNEQLGAFAVQNSAVYVEGDIETRVYNDRINDQVKNIPEICVRRDGKIQLMQSGDSNVGKSLEELTDDDTVLI

SEQ ID NO: 70069 - protein, 242 aa, Ipomoea batatas
SAPPCVAEVKVESYVFPATAKPPGTAKTLILGGAGARGLNIDGKFVKFTAIGVYLEADAVPSLAVKWNGKSAEELTDSVQFFRDIVTGPFEKLTRITMILPLSGKQYSEKVSENCVAFWKAAGIYGDAESKAIEKFNDVFSDQMFPPGASIFFTQSPLGWLTISFSKEGSMPEIASAVIENKPLSEAVLESIIGSKGVSPEAKQSLAVRLSELFKNGVSGGDAITGKVGCENDVIPQTVVSK

SEQ ID NO: 70070 - protein, 463 aa, Prochlorococcus marinus subsp. pastoris str. CCMP1986
MNILDKSYKSNIEELKNKVITGQTESISWRIQQIRKVSQLLDENKKEIIKALFLDLGKSELEALSEILLIKEEISLIKKNLRLWMRPKKVKTPIYLFPSFSKVIYEPLGCVLILGPYNYPLLYLLKPLVNIFSSGNTAVIKPSEKCSSTSKLIKKLTDKYFQKDILFTIEGDYKESIKLVEQNFDHIFFTGSTETGKSIMKSASTNLTPLTLELSGTNPVIIFKNANLEIAAKRIVWGKFFNSGQSCMAPNHIFVEKEIENQLVKELKKFINIFYGEDPIISKNLSKLEKKQFSITSELLKKYKKEKRILFGGTCSKKRMKISPTILKVKLHDNNIIQKELFSSLLPVIGIDNKDLALKKINQASKPLAIYIFGGNKKIHDHISKVTSSGTVCINDVMLPVLIPNLPFGGVGESGMGKFHGEEGFKNFSNQKSITYKGFLFDLDFRYPPYNKVMKIIKFIFKI

SEQ ID NO: 70071 - protein, 173 aa, Triticum aestivum
MAFWDYSEKKLIQKAKAEWSVISEWSPDGRHFMTATTAPRLQIDNRIKIFDHTGSLQFIKEFEKLYQVDWKPESPERFVDIAELTISLNGLKIEETKKQGQGSKSAQTSSKAAKPAGAYRPPQSKHTAALQDKLFGGLAPTGGEMSKTALRNKKRREKQKEKKAGEGSSADDS

SEQ ID NO: 70072 - protein, 431 aa, Clostridium perfringens str. 13 [sequence omitted]

SEQ ID NO: 70073 - protein, 512 aa, Clostridium perfringens str. 13
MSKKPVMLMILDGFGISPNKEGNAVAAANKPNYDRLFNKYPHTELQASGLEVGLPEGQMGNSEVGHLNIGAGRIIYQELTRITKEIKEGTFFTNKALVKAMDEAKENNTSLHLMGLLSNGGVHSHIDHLKGLLELAKKKGLQKVYVHAFMDGRDVAPSSGKDFIVELENAMKEIGVGEIATISGRYYAMDRDNRWERVELAYNAMALGEGEKASSAVEAIEKSYHDNKTDEFVLPTVIEEDGHPVARIKDGDSVIFFNFRPDRAREITRAIVDPEFKGFERKQLHVNFVCMTQYDKTLECVDVAYRPESYTNTLGEYVASKGLNQLRIAETEKYAHVTFFFNGGVEQPNTNEDRALIASPKVATYDLKPEMSAYEVTDELINRLDQDKYDMIILNFANPDMVGHTGVQEAAVKAIEAVDECLGKVADKVLEKEGTLFITADHGNAEVMIDYSTGKPMTAHTSDPVPFLWVSKDAEGKSLKDGGKLADIAPTMLTVMGLEVPSEMTGTCLLNK

SEQ ID NO: 70074 - protein, 406 aa, Aquifex aeolicus VF5
MFRTKAGKKVVYVDHIATTPVAEEVLEAMLPYFREKFGNPTSLHSFGQEAKKAVEKAREQVAQLINANIPEEIIFTSGGIEANNLAIKGIAKAYQRRGKHIVTTEIEHHSILHPCKTLEREGWEVTYLKPDKYGLIDPEQVREAVREDTVLVSIGHSNREIGTIQNIKELVKAAKEKNPKVIFHTDAAPSLGHYPVDVQDWGVDAASFTAHLMYGPKGVGALWTRKGVKVKPLIEGGTQERGVRAGTENVPGIVGFGAAAELAMKELDDRMKRLSHYRDKLRKGLEEKVDYIEFTGHPTQRLPHHLSIIVHFVEGEAMLLRLDLMGIETASGSACVSLALKQSHVLTAIGIPKEVSNGSVVFSFGRENTEEDVDYILEEFPKVINWLREVSPFNPENWEKYVKSRG

SEQ ID NO: 70075 - protein, 248 aa, Clostridium perfringens str. 13
MRTPIIAGNWKMHYTIDEAVKLVEELKPLVKDAKCEVVVCPTFVCLDAVKKAVEGTNIKVGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAYEPIWAIGTGKTATSDQANETIAAIRAMVAEMFGQEVADKVRIQYGGSVKPNTIAEQMAKSDIDGALVGGASLVAADFAQIVNY

SEQ ID NO: 70076 - protein, 546 aa, Methylococcus capsulatus str. Bath
MPQSTDLPAWRTLSEHFKTIAPRHMRDMFADDPGRFEAFSVRLGDLLFDYSKNRITRETVATLIQLAEEAGLREKIDAMFRGERLNVTENRAVLHVALRNRSNRPIRVDGKDVMPEVNRVLDRMRRFSQSVRTGEWRGATGKAITDVVNIGIGGSDLGPKMVVKALQPYADPRLRAHFVSNVDESDLVEILRPLNPETTLFVVASKTFTTQETMTNGRSARAWFLERISDESAIARHFVAISTNRNKVAEFGIDPRNMFEFWDWVGGRYSLWSAIGLPIALSVGMDRFEELLEGAHFVDEHFRTAPFERNIPVLMGLLGIWYINFFGAQSHAVLPYDQYLEDLPAHLQQADMESNGKTVDVEGRPVNYSTGPVIFGQPGTNGQHAFYQLLHQGSMLVPCDFLAAAESHHPLAEHHDILISNFLAQTEALMRGRTTDEARQEIASEELPPERLEALAAAKTFPGNKPTNSFLYRRLDPHTLGMLIALYEHKIFTQGVIWYINSFDQMGVELGKQLAKTILAELPGDAPVASHDASTNGLIRYFKSLR

SEQ ID NO: 70077 - protein, 397 aa, Clostridium perfringens str. 13
MNFNKKTIEDVQVKGKKVLVRCDFNVPLKDGVITDENRLNGAMPTIKYLVDNGAKVILCSHMGKPKGEAKPEFSLAPVAKRLSEMLGKEVVFAADDNVVGENAKKAVAEMKDGDVVLLQNTRYRKEETKNGEELSKELASLAEMFVNDAFGTAHRAHCSTVGVTEYLKPAVCGYLIQKELKFLGDAVETPERPFVAILGGAKVSDKINVINNLLEKVDTLIIGGGMAYTFLKAQGYTVGSSLVEEDKVEYAKEMLAKAEEKGVKLLLPVDHRVAKEFKDVEAVVTEDQNIAEGFMGLDIGPKTEAIYAEAIKDAKTVIWNGPMGVFEFENFNKGTIAVAKAMAEADATTIIGGGDSAAAVNILGFGDKMSHISTGGGASLEFLEGKVLPGIAALNDK

SEQ ID NO: 70078 - protein, 465 aa, Yersinia pestis CO92
MKIVNHWIDGKNITSNDYFTTINPATGEVLADVASGGIKEINQAVAAAKSAFPHWANLPMKVRARLMRRLGELIEQQIPEIAQMETQDTGLPIYQTQNALIPRAAHNFEFFAEICQQMNGQTYPVDDQMLNYTLVQPVGVCALVSPWNVPFMTATWKVAPCLALGNTAILKMSELSPLTADKLGELALEAGIPAGVLNVVQGYGATVGDALVCHQDVRAISFTGGTATGNRIMQRAGLKKYSMELGGKSPVLIFDDADIERAMDAALFSIFSLNGERCTAGSRIFIQESLYSAFIQRFAERASRLRVGDPQDLDTQVGALISKPHWDKVSGYIQLGIEEGATLLAGGPDKPIDLPAHLRGGHFLRPTVLADVDNRMRVAQEEIFGPVACLIPFKNEDAGLRLARSIEAGMVFVNTQNVRDLRQPFGGIKASGTGREGGKYSFDVFAEVKNVCISMGEHPIPRWGM

SEQ ID NO: 70079 - protein, 332 aa, Clostridium perfringens str. 13
MVKVAINGFGRIGRLALRLMIDNPEFEVVAINDLTDAKTLAHLFKYDSAQGRFNGEIEVKEGAFVVNGKEIKVTAKSNPAELPWGELGVDVVLECTGFFASKEKASAHLTAGAKKVVISAPAGNDLPTVVYNVNHDILDGSEDVISGASCTTNCLAPMAKALNDNFGLNKGFMTTIHAYTNDQNTLDAPHKKGDLRRARAAAANIVPNSTGAAKAIGLVIPELAGKLDGNAQRVPVITGSLTELVCTLDKKVTVEEVNAAMKAASNESFGYTEDPIVSSDVIGISFGSLFDATQTKIMEVDGQQLVKVASWYDNEASYTNQLIRTLKCLVSK

SEQ ID NO: 70080 - protein, 271 aa, Xanthomonas axonopodis pv. citri str. 306
MLQSASRNAWRVAFPPWHRPSHPRSAFFLPEFVHARFQVASVTSHQPAVPVHRRRLGRGGHGANRTARKQAGGGARDRAAYRAIDANLGTLLLSYSAVPLVVRNTGHSIQLDLHDGGSMATGGKQYQALQLHFHHPSEHLLNGRRFPMEAHLVHQGPDGTLGVLAIFFETGKANTAFQRVLDAMPKDKDQTRQVANATVSAEAFLPPSNQRSFYRYEGSLTTPPCSETVDWVVLSQPVQVSEAQINAFERVYPFNARPLQPLDRRFLLKSH

SEQ ID NO: 70081 - protein, 610 aa, Xanthomonas axonopodis pv. citri str. 306
MPQWRVRMHSGGLELALVLMLAAIVAVPVFKRFGLGAVLAYLVAGVVLGPDGAGVVQDAERISGAAEIGVVMLLFVIGLELSPARLKVMRHSVFGAGATQVLVTAVILGGLLMAAQLGWKSALIVGVALALSSTAVGLQLLAERKALSSDYGRLAFAILLFQDLIAIPLLAAIPLLGGSKNATLQWQDVAKAVAALALVIVCGRFVLRHLFNVVARTRMPEVFTASALLVVLGTAWIMQEAGLSASLGAFIAGVLLADSEFRHELESQIEPFEGLLLGLFFISVGMGIDLHRVVAEPWLIAAGVAILLVVKFSLLVGIGSVAKLPLRSSLMLGSVLWLGGEFAFVVFNEADRVGLLEPANHDRLVAIVGVSMALTPLLLLGMQRILNGPLRARAPKTDRPFDTIDAQTPKVLVAGMGRFGQVVARLLTARHVPFVALEHNPDTVEDLRRFGSQLYYGDPTRPELLRAAGAERIKVFVIAVDDPETNIKTVRLIRRLYPQATVLARARNRQHAWKLMDLGAEPFREVFASSLELSERVLTSLGLGEALAHDHVKRFRQHDEDLLRRQHLVYDDEAKVIQTSRDARADLMNLFEADVRADVDGEPAPTLRER

SEQ ID NO: 70082 - protein, 262 aa, Aquifex aeolicus VF5
MERIETWKEKIEKRLNEILKPEGPEELIEAMKYYPLQKGKRIRPLFTVAVASALGGNEDDAITVGSGIELIHNYSLIHDDLPCMDNDVWRRGLPTCHIKFGEAMALLAGDALLTYTFEVLSQRENYKTLSCEEILEINKIIAQKAGSNGMVGGQVLDIKGYEDLYEVSVKKTGALFEACFMCGAVVAKRREKLKEMESIGRKVGLLFQMVDDYLDKDGFYEKLGECLKEEIKKLYEELKEKEIFKESQELRYLLDLIYKRIT

SEQ ID NO: 70083 - protein, 612 aa, Xanthomonas axonopodis pv. citri str. 306
MSEQATTPPCIIVVFGARGDLTKRLVMPALYNLRRSGALGDDFAIVGMDHGDISERAWRTNMGQSMTQLLSSRDAEFQTDEFDTATWDWLRERMHYLRGDFTDQGAYRSLGGVLDKLHKRYGTQGNVLFYLATAARFFEPVLLNLGEAGLVKQREGEGWRRVIVEKPFGYDLPSAQHLNATVAKVLHEDQVFRIDHFLGKETVQNILAFRFANGLFEPVWNRDRIDHVQITAAETIGVEGRGRFYDPTGCLRDMVPNHLFQLLAMIAMEPPAAFTTEAMHRRRAEVIEAVRPIKPEDVVRGQYASGAVNRNAVPGYREEDTVPDDSDTETYVAMKLQVDTWRWAGVPFYLRTGKRLRERTTEIAIRFKPAPLAPFRSTEVGGYGPDWLVLHIQPDEGISLQFDVKRPGAQVALAPVRMDFRYRDWFPKEYTVGYERLLQDCMNGEAGLFQDAAMVEGAWRIVQPILDAWKQPPSDFPNYAAGSAGPSAADALLAMNGGHAWRALTPGRKPPPRRPPEARAGAAAPIKKTTGKSAKKAAKAPAEKVTKAPARRASAASARPSQDAATSPSSAARKAVSKRVTGKVAKAAGKTAAGKGAAKKSASKTVARTPRR

SEQ ID NO: 70084 - protein, 645 aa, Coprinopsis cinerea okayama7#130
MAEDESVLGKRIRDEAAAQQDNGQDNANDSDSDDVGPMPLPAGAAGTAKKKRKVLPHEKLYLEHLPNTEQYYKSFMHRDVLNFVVMTKTEFLITTSVDGHLKLWKKQEEGIEFVKHYRAHLNPVVSVSASADGQLFATVSEDQTAKVFDVVNFDMINIIKLGYTPLACCWVHKSGQAQGILAISEVGSGRIRLYDGRGNETPLETIDSVHRFPVHVMTYSDRYHTVISADEAGFVEYWQPIEPFVQPKNVPGLWQYKSETDLYEFKKSKSTPTCITLSPNSSSFVTFSLPDRQVRIFSFLSGKLTRKYDESLEAIQEMQQAGTAVYRVEDMEFGRRLAAERELELPGPDGKIPGRWINAVWDESGAFIIYPTLLGIKVVNTYTNRVARLLGKDEVVRFLSLTLYQGAPSKKSLTTVAMAASANPILAEKGQRDPTLICTGFKKNRFYMFTRSEPEDSKTGDRDVFNERPTHEERTVAAATANTPAGPSRFANAATIHTTLGDIHIRLFPQQAPKAVENFVGHSRSGYFEGVIFHRVIPKFMIQTGDPLGDGTGGTSIWGKEFEDEFSDDLKHDRPYTVSMANAGPGTNGSQFFITTTATPWLDKKHTIFGRVLSGLEVVHAIENVKTNKLDKPFEDIKIINIDVE

SEQ ID NO: 70085 - protein, 345 aa, Myxococcus xanthus DK 1622
MRARKVVIRKAGGYEQLHLEEVNQDSPGIGEVRVATEAIGVNYADCVIRMGLYASAKEYVGWPITPGFEFAGHVDAVGPGVEDLAPGARVFGVTRFGGYATHVTVPRHQVFTLPARLSMEQAAGFPTVFLTAYYALFELAHPRPGANVLVHSAAGGVGGALLQLGRIAGCRMVGVVGGTHKVETARAQGAEVVIDKSREDLWSVAKKAAPRGYDVVLDANGPSTLRDSYKHLASPGKLVIYGFHSMLPRTGGRPNYAKLAWDWLRTPRFDPLTLTNDNTSVLAFNLSYLFEQRAVLEESMAQLLGWLEEGKLVPPPVKSFPLDAVADAHRALESGGTVGKLVLVP

SEQ ID NO: 70086 - protein, 428 aa, Neurospora crassa
MASAIFFLDLKGKTLLARNYRGDIPMSAVEKFPILLSEAEEESSAVPPCFSHEGINYLYIRHNNLYLLALTKRNTNAAEILLFLHKIVEVFTEYFKALEEESIRDNFVIIYELLDEMMDFGYPQTTESKILQEYITQESHKLEIQARPPIAVTNAVSWRSEGIRYRKNEVFLDVIESLNLLVSANGNVLRSEILGAIKMKCYLSGMPELRLGLNDKVMFETTGRTTRGKAIEMEDVKFHQCVRLSRFENDRTISFIPPDGEFELMSYRLNTQVKPLIWVECVVESHSGSRIEYMLKARAQFKRRSTANNVEIIVPVPDDADTPRFRTNVGSVHYAPEKSAIVWKIKQFGGGKEFLMRAELGLPSVRGDDEHGAKRPIQVKFEIPYFTTSGIQVRYLKITEPKLQYPSLPWVRYITQSGDIAVRLPDAV

SEQ ID NO: 70087 - protein, 221 aa, Agrobacterium tumefaciens str. C58
AGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKASAFAALGASLLGVIINGLFVAISMTSGGGAWDNAKKSFEDGFIDKDGVRHVKGSEAHKASVTGDTVGDPYKDTAGPAVNPGHQD

SEQ ID NO: 70088 - protein, 298 aa, Thermotoga maritima MSB8
MGSDKIHHHHHHMQVPKVTLNNGVEMPILGYGVFQIPPEKTEECVYEAIKVGYRLIDTAASYMNEEGVGRAIKRAIDEGIVRREELFVTTKLWVSDVGYESTKKAFEKSLKKLQLEYIDLYLIHQPFGDVHCAWKAMEEMYKDGLVRAIGVSNFYPDRLMDLMVHHEIVPAVNQIEIHPFYQRQEEIEFMRNYNIQPEAWGPFAEGRKNIFQNGVLRSIAEKYGKTVAQVILRWLTQKGIVAIPKTVRRERMKENISIFDFELTQEDMEKIATLDEGQSAFFSHRDPEVVKWICSLKR

SEQ ID NO: 70089 - protein, 436 aa, Rhodopseudomonas palustris CGA009
MRITMIGTGYVGLVSGACFADFGHQVTCVDKDAGKIAALHRGEIPIYEPGLDELVAANVKAGRLDFTTDLTLPVGEADAVFIAVGTPSRRGDGHADLSYVYAAAKEIAAALKGFTVVVTKSTVPVGTGDEVERLIRETNPTADAAVASNPEFLREGAAIRDFKFPDRIVIGTADERARKVMGEIYRPLSLNQGPLMYTARRTAELIKYAANAFLATKITFINEMADLAEKVGADVQDVARGIGMDNRIGSKFLHAGPGFGGSCFPKDTRALVQTAHDHDVPVRIVEAVLAVNDNRKRAMARKVSHALGGNMRGKTIAVLGLTFKPDTDDMREAPSIPLVTGLTDMGAKVKAFDPAGMAQAKAELPDITYCEDAYDCAKGADALVIVTEWVQFRALDLPRLKAAMAQPIVVDLRNIYRPAEMAEHGFSYHSVGRGDA

SEQ ID NO: 70090 - protein, 888 aa, Arabidopsis thaliana
MEKYFHGVLCVFIITVAFIHVVQAQDPNGFITLDCGLLPDGSPYTNPSTGLTFTSDSSFIESGKNGRVSKDSERNFEKAFVTLRYFPDGERNCYNLNVTQGTNYLIRAAFLYGNYDGLNTVPNFDLFIGPNKVTTVNFNATGGGVFVEIIHMSRSTPLDICLVKTGTTTPMISTLELRPLRSDTYISAIGSSLLLYFRGYLNDSGVVLRYPDDVNDRRWFPFSYKEWKIVTTTLNVNTSNGFDLPQGAMASAATRVNDNGTWEFPWSLEDSTTRFHIYLHFAELQTLLANETREFNVLLNGKVYYGPYSPKMLSIDTMSPQPDSTLTCKGGSCLLQLVKTTKSTLPPLINAIELFTVVEFPQSETNQDEVIAIKKIQLTYGLSRINWQGDPCVPEQFLWAGLKCSNINSSTPPTITFLNLSSSGLTGIISPSIQNLTHLQELDLSNNDLTGDVPEFLADIKSLLIINLSGNNFSGQLPQKLIDKKRLKLNVEGNPKLLCTKGPCGNKPGEGGHPKKSIIVPVVSSVALIAILIAALVLFLVLRKKNPSRSKENGRTSRSSEPPRITKKKKFTYVEVTEMTNNFRSVLGKGGFGMVYHGYVNGREQVAVKVLSHASKHGHKQFKAEVELLLRVHHKNLVSLVGYCEKGKELALVYEYMANGDLKEFFSGKRGDDVLRWETRLQIAVEAAQGLEYLHKGCRPPIVHRDVKTANILLDEHFQAKLADFGLSRSFLNEGESHVSTVVAGTIGYLDPEYYRTNWLTEKSDVYSFGVVLLEIITNQRVIERTREKPHIAEWVNLMITKGDIRKIVDPNLKGDYHSDSVWKFVELAMTCVNDSSATRPTMTQVVTELTECVTLENSRGGKSQNMGSTSSSEVTMTFDTEVNPVAR

SEQ ID NO: 70091 - protein, 336 aa, Novosphingobium aromaticivorans DSM 12444
MTGAVVCFGEMLLRLSPPGARMMIQAQSLEMVVGGAEANVAAALAALGHETRMVTLLPGNPLGDRARAELGAAGVDTRFVVRGAGRMGLYFMEPGAGMRPSSITYDRAGSAFALADVGAFDLDGALAGAALLHVSGITPALGPGGVALARAAVAAARAAQVPICFDGNYRAQLWESWDSDPRSILTELVGAARVLIGNHRDISLLLGRTFSGDGAERRREAVDAAFAAFPNLELVASTARHVVSSDHHRLAARVDTRTGKHQTGEIDVTGIVDRIGTGDAFAAGVLHQFLKGGNEQAMAECGLALAALKHSLPGDFCLIDGAELAAFSADGGDVRR

SEQ ID NO: 70092 - protein, 297 aa, Gloeobacter violaceus PCC 7421
MSIQEGVLKYSELINRPILDLRTTEELGRVDNLSTVEDAHRVAGIIYKSGFLGGQKKTLLLSQIRAIGPDALMVNTDGETDEQIKSGESLVGHEVWTDGGSRIGKITDFLFDGQTGVISHYLFAASGWSGITDGTYLLEASAITTPGKKRVIVNEAVAKSSTLYSEGLKQRLGTALEQAKERSQSLTDQLKERTAALGEQAKGLVDQAKERGQVLGEQAKERAAALGEQARELADQAIERGQSLVESTQERLHPPTTDVEATVVEEPQPLPPAEPVDSSVTPSEPLEPQPKDPHTPH

SEQ ID NO: 70093 - protein, 274 aa, Pseudomonas putida KT2440
MQRLSTRTGLDLPAIGLGTWPMTGSECTQAVRQALDVGYRHIDTATAYENEAAVGQALRDSDVPREQIHLTTKVWWDRLEPKAMRQSLEDSLRALGTEQVDLFHIHWPGTDWDLARSIDTLVALRDEGKARHIGVANFPLGLLRQVVETLGAPLSAIQVEYHVLLSQQPLLDFARGHDLLLTAYTPLARGQAAAQPVIQAIARKHGVLPSQVALKWLLDQDGVAAIPKASSRENQLANLAALTVPLDDEDRTAIAGLPKDQRVVSPPFAPDWNS

SEQ ID NO: 70094 - protein, 302 aa, Clostridium perfringens SM101
MKYYNDIRDLIGNTPILKLNNISTKEGVNIYAKIEGTSPGGSCKDRVGIYMIEKAEKEGKLKPGSTIIEATAGNTGIGIALAAINKGYKIIFIVPDKFSIEKQKIMKALGAEIINTPKEEGMEGAINLANSLLSEIPNSLSLNQFKNEANPLAHYETTGRELYDGLDGQIDYFVAGAGSGGTISGVLKFLKENISEVKGILADPVGSIIGGGQCGTYKIEGIGNNFIPETMDMSLVDDVIKINDEEAFDAVKLLAKKEGLIVGSSSGAAFAAALKLAEKIDKGNIVTIFPDRGDRYFSTDLF

SEQ ID NO: 70095 - protein, 334 aa, Gloeobacter violaceus PCC 7421
MAPPAKTLLRRTASCSLALGLALGAVAFDGAEAWARRSSGGRIGGGSFRAPSRSYTPAPSPRTYSPAPGGYYSPPPVMPVPVPIPGPGYYPPVGGGYAVGGPGIGLSSILLIVVVVGAGFYVLRVIRRGASGAVGGQDGAYAAGFDPDKVEIFRLQVALLASAKQLQRDLTRIAEEADTTTPEGLARLNQEVSLALLRNPEFWVYAKSDQQILPRLTAESQFNRLALTERTKYTDETVSRSGEQSALVKKTFVNDNPDETAEYIVVTILVASESGVPTLEEVRSSDQLRQALATIGSLSGEQIVALEIIWSPSDEKDTLTAEELLTQYTDLVRI

SEQ ID NO: 70096 - protein, 518 aa, Listeria monocytogenes EGD-e
MFKIMKDFTEQEKIIVLDFGSQYNQLITRRIREFGVYSELHPHTITVEEMKALNPTGIIFSGGPNSVYDEDAFRADERIFDMGIPILGICYGMQLMTTHFGGKVERAKDREYGKADIHVEKPNRLFAGLPTDQVVWMSHGDLVVEEPAGFEVTVTSKSCPIAGIADEERSLYGVQFHPEVRHSVYGNELLKNFALNVCGCKGDWTMENFSEVEIAKIQEIVGDKKVLLALSGGVDSSVVGVLIHKAIGDQLTCIFVDHGLLRKGEADQVMETLQGEFNMNIIKVDAKKRFMDKLAGVSDPEQKRKIIGNEFIYVFDDEANKLDGVEFLAQGTLYTDIIESGTATAQTIKSHHNVGGLPEDMQFKLIEPLNTLFKDEVRALGTELGMPDAIVWRQPFPGPGLGIRVLGEITEEKLEIVRDSDYILREEIKNAGLEREIWQYFTALPNIRSVGVMGDGRTYDHTVVVRAVTSIDGMTADWARIPWDVLEKISVRIVNEVDHVNRVVYDITSKPPATVEWE

SEQ ID NO: 70097 - protein, 339 aa, Hordeum vulgare subsp. vulgare
MENILHATPAPVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 70098 - protein, 81 aa, Glycine max
  misc_feature (14)..(14): Xaa can be any naturally occurring amino acid
PPAVALGALFKAVXSGVIKALPRTVVFSTVLGLKFTQSKFDSLFKAIKVLACRYAKLPMQVKADFGSVMHVFKTSLLCKAH

SEQ ID NO: 70099 - protein, 511 aa, Vitis vinifera
MRCLAHPHPKATFSAAAVEELITPTVQINYTQLLINGQFVDAASGKTFPTFDPRTGEVIANVAEGDAEDINRAVSAARKAFDEGPWPRMSPYERSRILLRFADLAEKHNDELAALETWNNGKPYEQAAKAELPLFVRLFRYYAGWADKIHGLTVQADGPHHVQILHEPIGVAGQIIPWNFPLMMFAWKVGPALACGNTIVLKTAEQTPLTALFAAKLFHEAGLPPGILNIVSGYGPTAGAALASHMDVDKIAFTGSTDTGKIVQELASKSNLKPVTLELGGKSPFIVCEDADIDQAVELAHFALFFNQGQCCCAGSRTFVHESVYDEFIEKAKARALSRTVGDPFKKGIEQGPQIDPEQFAKVLRYIRSGIESNATLECGGGRIGSKGYFVQPTVFSNVQDDMLIAKDEIFGPVQSILKYKDLDEVIRRANSTRYGLAAGVFTKNINTANTLTRALRVGTVWVNCFDVFDAAIPFGGYKMSGVGREKGIYSLNNYLQVKAVITPLKNPAWL

SEQ ID NO: 70100 - protein, 466 aa, Mycobacterium sp. JLS
MTHYDVVVLGAGPGGYVAAIRAAQLGLNTAIVEPKYWGGVCLNVGCIPSKALLRNAELAHIFTKETKTFGISGEATFDYGAAFDRSRKVAEGRVAGVHFLMKKNKITEVHGYAKFTDDHTIEVDLNEGGTETLTFDNAIISTGASTKLVPNTSLSENVVTYEEQIMERELPGSIVIAGAGAIGMEFGYVMKNYGVDVTIVEFLPRALPNEDAEVSKEIEKQFKKLGVKIMTGTKVESIKDEGGDGSVTVTVSKDGKSQELKTDKVLQAIGFAPNVEGYGLDKAGVELTDRKAIGIDDYMRTNKPHIYAIGDVTGKLQLAHVAEAMGVVAAETIAGAETLPLGDYRMMPRATFCQPQVASFGLTEEQAREEGYDVKVAKFPFTANGKAHGMGAPGGFVKLIADAKYGELIGGHLIGHDVSELLPELTLAQKWDLTANELARNVHTHPTLSEALQEAFHGLAGHMINF

SEQ ID NO: 70101 - protein, 570 aa, Emericella nidulans
MSPPSAKSMEEGRTPSVQYGYGDPKTLEGQIEEHTATKRGLSSRQLQLLAIGGCIGTGLFVGTSTVLTQTGPAPLLMSYIVMASIVWFVMNVLGEMTTYLPIRGVSVPYLIGRFTEPSIGFASGYNYWYSFAMLLACEVSTMALLSFLSCWNPDNVGHCLGLIIEYWNPPVSVGLWIAIVLVESEFWFAGLKILAIIGLIILGVVLFFGGGPNHERLGFRYWQDPGAFNPYLVPGDTGKFLGFWTALIKSGFSFIFSPELITTAAGEVEAPRRNIPKATKRFIYRVFTFYILGSLVIGVTVAYNDPTLEAGVESGGSGAGASPFVVAIKTLVLEGSTMSSMLPSGSLPGHPVTHGCYAGSEKLYSLAGEGQAPKIFTRTNRTGVPYVAVLATWTIGLLSFLNLSSSGQTVFYWFTNITTVGGFINWVLIGIAYLVCFPPSLHLNTPDQKQRFRKALQFHGMLDMLPFKTPLQPYGTYYVMFIISILTLTNGYAVFFPGRFTASDFLVSYIVFAIFLALYAGHKIWYRTPWLTKVSEVDIFTGKDEIDRLCENDMERQPRNWLERVWWWIF

SEQ ID NO: 70102 - protein, 414 aa, Variovorax sp. Pal2
  misc_feature (272)..(272): Xaa can be any naturally occurring amino acid
  misc_feature (326)..(326): Xaa can be any naturally occurring amino acid
MTTATTTTTSSRESHPFLAGRVLGAKPSATKEMTRLANQLKREGRNVIALSQGEPDFPTPDHVREAGKQAIDRGESRYTDVAGTFALREAVVRKFERDHGLRFDPEQVQVGCGAKQILYNALQATIDPGDEVVVPTPAWVSYPEMVLLAGGTPVIVRCGAASGFKLTPRQLEEAITPRTKWLMLNSPSNPSGAVYSHDELAALGAVLLRHPQVWVMADDIYEKIRYQTGAFATPAAVMPELASRTLTINGVSKAYAMTGWRVGFGAGPLELXKAMNLVQSQSTSHTSSISQAAAVAALDGPMDFLPQFVEAFRRRRDSVVGQLNRXEGIACDLPPGAFYAFPGCQGLLGRRDPAGHLIATDADLALYLLREAGVAIVPGSAFELPGHFRVSYAASDAELDEAMARIAAACGRLG

SEQ ID NO: 70103 - protein, 214 aa, Zea mays
MFGRGFFGSESRSNDLTTRLTVHFGSAMIDTTVTRDAAVADEWVRTVRAANPRGAPLIVGLDCEWKPNYRSWTTSKVAILQLCAGDRCLVLQLFYVDRIPASIRSFLADPDVFFVGIGVGEDAAKLATDYGLTCASPVELESRCNDYLGYYTGGPRLGLKGYAREVLGLVMEKPRGVTMSNWEKHDLEDAQIRYACIDAYVSYKLGEKVLVLTD

SEQ ID NO: 70104 - protein, 1000 aa, Gibberella zeae PH-1
MHFFPTADSTLLSSTVDYHSLPPRPKAVGPIFDANNFKTPVDPWDSDDQTNLYPPKDDPFDPSAIPAEPSCPSSRYPRSRLAKNERLRLSMLWYYTRDLDEHPELLAGLQEKACLAQENSGWEYAVVGLLDINVYIRLATVGLQLAILPRGETLCAHTVTQPPGNVFLLPNMLEDWRYRESPYVEHGGLIAYAGVPLRIQHESGESVGLGSLCVASATSKPPLTKHQQLALARLGDWIVADIVQCARARRQRERHRLTDLITTLLREPEGDDVQEPILHILRQAYPDESVTLQFTGTDSYDTTVPYAASDPKHGLWEDDEYIDNFILTSNCNDPPTDRVVRFISAQCESKLGPSVLVVATKDFRRIFDDVDSGFVQACATMLTQRWQKRLLSEVMRAKEKFLRGVSHQLRTPIHGILGAAELLTEHLKALTITGCSKLPPPGVEELIQPLAELGKSSVYLDTISTAGRELMSTVNSMITLNRWADIASAERQYATHSIQELEDILVKGSSDITLRDTSKRAPIFFHHDLPPCCQSLRIDVELFRDSVLPLIVNAIQNTFEGIITVTLSYIQDTKTLVVDVQDTGCGIAANDQGRIFQLYEKVGEHSTGPGLGLTLASKFSALLHGSVELVSSEVHRGSHFRGTFGDIRSIPSSTPFLPIASQLKRLPLSFHHLTSDSPEIHLNSHLSKYLTCNGFVQSDDSADCLIVMDYIRDPDQRQKYHATLPKGQVAICPVPDMEDIENSPSTSNIVFVRGPFCTSSLDAGLREADELCAMAPRTITTPLPLASPSLTRDGRGILPYRPSPSGHNSTDEGYGSNTTPSNNGSPIPQARTEESLSTSNESAPAVPAASKTPPPDVPVRTLPNTYKPMTLLVDDNAVNLRILEMYCKKRGLPYRSAIDGQQAVNLFHQQQSPTSSDPPFDLILMDLQMPVCDGISATTQIRSLEKTGDKTSVLFIITGQDSQKDREAASAAGADNYLVKPVGIKMLDGSLKRYFPDLKI

SEQ ID NO: 70105 - protein, 475 aa, Ralstonia eutropha JMP134
MYQDLALYIDGEFIKGGDRKEQDVLNPATQEVLGKLPHASRADLDRALAAAQRAFESWKKTSPLERSKILRRVGELARERAKDIGRNITLDQGKPLAEAVGEVLVCAEHADWHAEECRRIYGRVIPPRQPNVRQIVVREPIGVCAAFTPWNFPFNQAIRKIVSAVGAGCTLILKGPEDSPSAVVALAQLFHDAGLPPGVLNIVWGVPSEVSTYLIESPIVRKISFTGSVPVGKQLAALAGAHMKRVTMELGGHSPVLVFDDADIEPAAEMLARFKLRNAGQVCVSPTRFYVQEKAYDKFLARFTEVIGSIKVGNGLEDGTQMGPLAHERRVFSMEQFLDDANQRGGKVVAGGSRIGDKGYFFAPTVVTDLPDDAKLMVDEPFGPVAPVTRFKDTAEVLRRANSLPFGLASYVFTNSLKTATEVSNGLEAGMVNINHFGMALAETPFGGIKDSGIGSEGGQETFDGYLVTKFITQV

SEQ ID NO: 70106 - protein, 331 aa, Klebsiella pneumoniae subsp. pneumoniae MGH 78578
MTIKVGINGFGRIGRIVFRAAQKRSDIEIVAINDLLDAEYMAYMLKYDSTHGRFDGTVEVKDGHLVVNGKKIRVTAERDPANLKWDEVGVDVVAEATGIFLTDETARKHITAGAKKVVLTGPSKDNTPMFVRGANFDAYAGQDIVSNASCTTNCLAPLAKVINDNFGIVEGLMTTVHATTATQKTVDGPSHKDWRGGRGAAQNIIPSSTGAAKAVGKVLPELNGKLTGMAFRVPTPNVSVVDLTVRLEKAASYEEIKKAIKAASEGAMKGVLGYTEDDVVSTDFNGEVCTSVFDAKAGIALNDNFVKLVSWYDNETGYSNKVLDLIAHISK

SEQ ID NO: 70107 - protein, 308 aa, Methanosarcina thermophila
MGRIFSDITWTIGNTPLVRLNRITKGLHADVLAKVESFNPMGSVKDRIGLAMIEEAEREGRIKEGTTIIEATSGNTGIALACVCAARGYNLILVMPETMTVERRKLLKALGAELVLTSGAEGMRGAVNKAEQMAADDSALYFIPQQFQNPANPEIHRRTTAEEIWRDTDGKADVIVAGVGTGGTITGIASAIKKRRPSFKAIAVEPAESPVLSGGSPGPHRIQGIGAGFVPDVLQLELIDEIIKVTGDEAAATARRLAKEEGILAGISSGAATWAALQVASREEMRGKTIVVILPDTGERYLSTDLFD

SEQ ID NO: 70108 - protein, 137 aa, Klebsiella pneumoniae subsp. pneumoniae MGH 78578
MANKPTPEELKNGLSEMQFYVTQHHGTEPPFTGRLLHNKKNGVYHCLVCDAPLFNSQTKYDSGCGWPSFYEPVSAEAIRYLTDNSHGMQRIEIRCGNCDAHLGHVFPDGPQPTGERYCVNSASLSFTDEQNGEQIKG

SEQ ID NO: 70109 - protein, 430 aa, Penicillium chrysogenum
MSSGGDVNQAEKSVFGMPGFVVDFLMGGVSAAVSKTAAAPIERIKLLIQNQDEMHKQGRLDRKYNGIVDCFRRTAAAEGVVSLWRGNTANVIRYFPTQALNFAFRDTYKSMFAYKKDRDGYAKWMMSNLASGGAAGATSLLFVYSLDYARTRLANDAKSSKGTGERQFNGLVDVYRKTHNGIVDCFRRTAAAEGVVSLWRGNTANVIRYFPTQALNFAFRDTYKSMFAYKKDRDGYAKWMMSNLASGGAAGATSLLFVYSLDYARTRLANDAKSSKGTGERQFNGLVDVYRKTLATDGIAGLYRGFGPSVLGIVVYRGLYFGMYDSIKPVLLVGPLEGSFLASFLLGWTVTTGAGVASYPLDTVRRRMMMTSGEAVKYNSSMDAARQIVAKEGVKSLFKGAGANILRGVAGAGVLSIYDKAQMLLLGKKF

SEQ ID NO: 70110 - protein, 400 aa, Solanum lycopersicum
RILGLGDLGCQGMGIPVGKLALYTALGGVRPSACLPITIDVGTNNEKLLNDEFYIGLRQRRATGQEYYDFLHEFMSAVKQNYGEKILVQFEDFANHNAFELLAKYRNSHLVFNDDIQGTASVVLAGLIASLKLLGGALCDHTFLFLGAGERGTGIAELIALEISNKTNIPVEETRKKIWLVDSKGLIVSGRKETLQAFKKPWAHEHEPVNNLLDAVKAVKPTVLIGTSGTGRTFTKEVVEAMACMNKRPLIMALSNPTSQAECTAEEAYSWSEGRAVFASGSPFPSFEYDGKLNIPGQANNCYIFPGFGFGLVMSGTIRVDDDMLLAASEALAAQVTEEHYAKGMIYPPFADIRKISAHIAASVARKAYELGVATSLPRPADLVKYAESCMYTPNYRSYR

SEQ ID NO: 70111 - protein, 243 aa, Methanosarcina thermophila
MRIREDIETVFKKDPAARSTLEVICCYPGLHAIWIHRVSHSLWNRHFYFLARLLSHISRMLTGIEIHPGAKLGRRVFIDHGSGVVIGETAEVGDDVLIYMGVVLGGTTLEKKKRHPTIENDVVIGSGATVLGPITVGRGAKIGAGSVVIRPVPPGATVVGVPARIAEPRPSPSAGQLDHDKLPDPGLIVIGQILDRLSRLEDQFKAHEKSISREEKTTQEAALKDEQIYSLLKEVIDPGVGMD

SEQ ID NO: 70112 - protein, 253 aa, Novosphingobium aromaticivorans DSM 12444
MGKLANGQMDGKVALVTGGASGLGAEDARVLAREGARVVITDMQEDLGQKVASEIPNCVFLKQDVRDEARWGEVVAETLRLFGRLDTLVNNAGLVRFGTVEDLSWDDYKLQTDVMAGGTFLGCKAAIPHMSKDGSGSIINMASVGGIKGISAIPAYAAAKAGIIGMTRSIAVHCREQGYRIRCNSIAPGGIVTPMTAQALAELPADNAGLDQAHNHGMGQPIDIANMVLYLACDDGRHITGTNIVIDNGETMA

SEQ ID NO: 70113 - protein, 354 aa, Triticum aestivum
MAESFDKMKVEFTGHEESVQALAATVHDSGEVPERYIRPEIEADPPAADAGGHALPTIDMSRLLDPEFSVEESAKLGSACEHWGFFQLVNHAVDGGLLGQTKADVAEFFGLPLEEKSAVAIPPNGMQGFGHHFVFSKEQKLDWVDLLFLATRPAQERSLDFWPTKPSTFRDTLDKYTTELASVAEQLFRFMAKDLGVDQEALLGTFKGLPQCVRINYYPPCRQAGKVLGLSPHTDGVGMTLLLHANDVQGLQIRKDGEWFSVHALPGALVVNIGDVLEILTNGKYRSIEHRAVVNPDKERITIAAFHSVHLPCTIGPFQELGDARYKTVDGLDFTKGYFAAKLEGRRYVESLKL

SEQ ID NO: 70114 - protein, 470 aa, Exiguobacterium sibiricum 255-15
MVVGEFAQETDLLVIGAGPGGYVAAIRGAQLGLKVTIVERENVGGVCLNVGCIPSKALITAGHNFQHAKGSDSMGITSENVAVDFSKVQSWKQSVVNKLTGGVGGLLKGNNVETVVGEAYFQSEDTVRIINEDSSTPYKFKKCIIATGSTPIELPAFKWSKRVLSSTGALNLPELPKKLIVIGGGYIGMELGTAYANFDTEVVILEGTKDILSGFEPAMTQVVKKKLKQKGNITIHNEALAQSVEETEEGVKVTFEVKGETQTVEADYVLVTVGRRPNTSDLGLEMAEVKVSERGLVEIDDQCRTSNENIYAIGDIVPGPPLAHKASFEAKIAAEAAAGHPAYLDYSAIPAVVFTDPELATVGYTEAQAKEEGLDYIASKFPYAANGRALALNEPDGFLKMITRKADGLLIGAQIAGTGASDMIAEMGLAIESGMTAEDIALTIHAHPSLGEIAMETAEVAIGSPIHIMK

SEQ ID NO: 70115 - protein, 107 aa, Aster tripolium
GGHVNPAVTFGLAVGGNITILTGLFYWIAQLLGSVVACFLLQFVTGGLAVPTHGVADGMNGLQGVVMEIIITFALVYTVYATAADPKKGSLGTIAPIAIGFIVGANI

SEQ ID NO: 70116 - protein, 432 aa, Exiguobacterium sibiricum 255-15
MGLFEFKLPDIGEGIHEGEIVKWFVKAGDTVKEDDILLEVQNDKAVVEIPSPVDGTVKEVKVDEGIVAVVGDVLITFDVEGEGSAPSEEEAPEQPKAADNAKDVQDTDKKVEDKPNEVQIHKSERVIAMPSVRKYAREKGVDIREVQGSGDNGRVVKEDIDAFANGGQSSTAPAAEEKAPAAQASASKSEVKPYVAAQPELETREKIKGIRKAISKAMVNSKHTAPHVTLMDEVDVTNLVALRKNFKEVAAAQGTKLTYLPFVVKALTAAAKKYPAINASIDDVNEEVVYKNYFNIGIAADTDNGLVVPVVKDADRKSIFGLADNINDLAGKARDGKLSGDEMKGGSITITNIGSAGGQWFTPVINHPEVAILGIGRIAEKAVVKNGEIVAAPVLALSFSFDHRLIDGATAQNALNLVKRLLNDPQLLIMEG

SEQ ID NO: 70117 - protein, 648 aa, Flaveria trinervia
MISLNSSFLERSSVTGGSRTQSQSLRLSARRPVVTSMLNSNSLPERNVSVSVDSAVRDVNAPVAVEVDRSVGEKPFAAVGGGVEDMYGEDTATEDHYITPWSVSVASGYSLLRDPHHNKGLAFTEKERDAHFLRGLLPPVVVNHDLQVKKMMHNIRQYQVPLQRYQAMMDLQQRNERLFYKLLIENVEELLPIVYTPTVGEACQKYGSIFENSQGLFISLKDKGRILEILKNWPHKKIQVIVVTDGERILGLGDLGCQGMGIPVGKLALYTALGGVRPSACLPITIDVGTNNEKLLNDDEFYIGLKQKRAAGQEYAELMNEFMSAVKQNYGENLLIQFEDFANHNAFDLLEKYRTTHLVFNDDIQGTASVVLGGLISALKLVGGSLADQKFLFLGAGEAGTGTAELIALEISKQTNIPLEESRKKVWLVDSKGLIVRSRLDSLQHFKKPWAHDHEPVNEFLDAIKTIRPTVLIGSSGTGQTFTKEVVETMSSLNEKPIILALSNPTSQSECTAEQAYTWSEGRAIFASGSPFKPVEYNGKLYVSGQANNAYIFPGFGLGLIISGAIRVHDDMLLAASEAPAEQVTQEHFDKGLIFPPFTSIRKISAHIAAKVAAKAYELGLASRLPQPENLVAYAESCMYSPKYRIYR

SEQ ID NO: 70118 - protein, 184 aa, Vitis vinifera
MSSPSKRREMDVMKLMMSDYNVETINDGLNEFNVEFHGPKESLYEGGVWKIRVELPDAYPYKSPSIGFVNKIFHPNVDELSGSVCLDVINQSWSPMFDLLNVFEVFLPQLLLYPNASDPLNGDAASMMMKNKDQYEKKVKEYCERYAKKENITNERLEEDSEDEDFSDGKSASSDEDIAGHADP

SEQ ID NO: 70119 - protein, 333 aa, Desulfovibrio desulfuricans G20
MNLAKFPRRGYVQQATPIEKLDNFSAALGGKVQIYIKRDDLLPGCAGGNKTRKLDFCIADALEQGADTIITCGAVQSNHCRLTLAWAVKEGMDCHLVLEERVKGSYKPQGSGNNLLFHLMGVKSITVVPGGSDMMEAMTKVAGTLKEQGRNPYIIPGGASNTIGATGYVACAQEMMQQLFEQGINIDHMVVPSGSAGTHAGIVVGMAATNSGIPVSGVNVSRTKPVQEELVHKLACATAERVGVSGGIAREEVVCFDGYVGAGYSLPTDSMVEAVKLLASTEGILLDPVYSGKAMAGLIDLVRKGHFPEGSNVLFLHTGGSPALYAYTDTFME

SEQ ID NO: 70120 - protein, 886 aa, Thermoplasma volcanium GSS1
MAQTKKYIYLFEEGGKELVDLLGGKGAGLAEMTKIGLNVPPGFTITTEACIDFLRDGNFPKGMMEQTMDALHMIEEKVSRKFGNPENPLLVSVRSGAPVSMPGMMDTVLNVGLNDETVKGLAFMTDNERFALDAYRRLIQMFGEIVYGLPHEEFRGLIEKVKREKGYDEDKFTTSDITEIIKGENEIYRKHKKSFPQDPQEQLVESIKAVFNSWNSRRAKTYREINHIPENMGTAVSIVTMVFGNMGSDSATGVAFTRDPNTGEKRIFAEYLTNAQGEDVVAGIRTPKYIDDMKMEMPQAYSDLIRMCDILEHHYRDMQDIEFTIERGKLYMLQTRTGKRSAKAAIRIAVEMYEEGIISEEEAIMRVTPEIFDRILHPQVKTNGKETPLGKGLAASPGAAIGSIVFSSERAIELGKSKKMILVRPETTADDVRGMAVCEGFLTQKGGMTSHAAVVARAMGKPAVVGVETMHVDTTNNTLTINGKTLHEGDVVTIDGTSGLFYLGELPVEKPEIDKFSKKLLELADKNRKLGVRANANTPEEAHLARENGAEGIGLARTERMFLGNERIPIMRSMIMSESKEERQKYLEQLLPMQISDFVEFFKTMEGYPVIIRLLDPPLHEFLPDKETILNKIYEIKSGKNGSDELQYYEKLLKTVRDLEEFNPMLGFRGCRVGLVYPEIYDMQVRAIMEAAVRVQKEGRRIMPEIMIPLVGHHNELKILMERLEKTAKSVKDSDQVDYKFGTMIEIPRACVTADKIAKYADFFSFGTNDLTQMTFGYSRDDAEGKFMFFYLENGILEKDPFSSVDEDGVGELMRMAVEKGRKSNEKLEVGICGEQGGDPDTIYFCHKIGLDYVSASPYRIPIARLAAARANISEMKPELASTYRY

SEQ ID NO: 70121 - protein, 371 aa, Penicillium chrysogenum
MFRQSVRRFATTAARAAEGSTAYCTRVSTAQGVVNGLTEAIGNTPLIRLKKLSEQTGCNVLGKAEFQNPGGSVKDRAALFVVKNAEEKGLLKPGGTVVEGTAGNTGIGLAHVCRSKGYKLVIYMPNTQSQGKIDLLRLLGAEVYPVPAVAFDNPQNYNHQARRHAESLDNAVWTNQFDNVANRQAHIETTGPEIWAQTQGKIDAFTCATGTGGTLAGTTRYLKTVSDGRVKSFLADPPGSVLHSYIQSGGTLIDRSGSSITEGIGQGRVTDNLQPDIDLLDGSVNISDEKTIEMVYRCLDEEGLYLGASSAMNVVAAKEVAEKLGKGNTVVTILCDGAYRYADRLFSSKWLESKNLLGSIPKHLQKYVVLP

SEQ ID NO: 70122 - protein, 107 aa, Aster tripolium
GGHVNPAVTFGAFVGGHISFFKSILYWIAQCLGSVVACLLLKFATGGLETSAFALSSGVGEWNAVVFEIVMTFGLVYTVYATAIDPKKGDLGIIAPIAIGFIVGANI

SEQ ID NO: 70123 - protein, 447 aa, Klebsiella pneumoniae subsp. pneumoniae MGH 78578
MDQTCTLEGFLTRVQQRDPHQTEFAQAVREVMTTLWPFLEENPRYRQLALLERLVEPERVIQFRVVWVDDRNQVQVNRAWRVQFNSAIGPYKGGMRFHPSVNLSILKFLGFEQTFKNALTTLPMGGGKGGSDFDPKGKSDGEVMRFCQALMTELYRHLGPDTDVPAGDIGVGGREVGFMAGMMRKLSNNSACVFTGKGLSFGGSLIRPEATGYGLIYFTEAMLKRHGLGFEGARVAVSGSGNVAQYAIEKAMELGARVVTASDSNGTVVDEAGFTKEKLARLIDIKERAHGRVADYAREFGLTYLEGQQPWSVPVDIALPCATQNELDVDAARQLIANGVKAVAEGANMPTTIAATDLFLEAGVLFAPGKAANAGGVATSGLEMAQNAARMGWKAEKVDARLHHIMLDIHHACVQYGGEAKQTNYVRGANIAGFVKVADAMLAQGVI

SEQ ID NO: 70124 - protein, 107 aa, Aster tripolium
GGHVNPAVTFGLAIGGNITILTGLFYWIAQLLGAVVASFLLGFVTGGLAVPTHGVADGMNAIQGVVFEIIITFALVYNVYANAADPKKGSFGTIAPVAIGFIVGANI

SEQ ID NO: 70125 - protein, 453 aa, Synechococcus sp. RS9917
METSFDLVVLGAGSGGLAAAKRAARYGARVAIVEGDRVGGTCVIRGCVPKKLLVYGSRVSEQLQEAPAYGVEIASAQFHTSRLLANVRQEVDRLNALHISLLEKAGVTLVSGWGRFQDPHRIAVSSRPGGEAEQVLQAGRTLIAVGGRPHRPQIPGAELGWVSDDMFLQDQFPERVVIVGAGFIACEFACILSGLGVQVTQLVRGDHLLRGFDRELSAVVQEGMEEKGIALRFCHSPAAIEGAPGDCTVITQAGERLACGGVLLATGRRPFLEGLNLEAAGVAVEGHHIAVDADQATNVPHIHAVGDVTDRICLTPVAVDEGRAYADTVFGRSPRRVDHDLVASAVFSQPELATVGLSEELALERYGAEAIVVHRARFRSMAQALPKSGPRCLLKLVVNKESDRVLGCHMVGEHAAEIIQMAAIAVGMGATKADFDRTMALHPTISEEFVTMA

SEQ ID NO: 70126 - protein, 507 aa, Gloeobacter violaceus PCC 7421
MSEQPIGIAPMDVHNTRLVAHTHPLDWVNPKPAGRYNLVVIGGGTAGLVSAGGAALLGGKVALVERHLLGGDCLVAGCVPSKALIRSARAMADVKDAHRYGIRVHGNVEADFGAVMERLRRVRADISPHDAAERFKNWGVDVFLGAARFTGPDTVRVGEVELRFKRAIVATGGRAARPEIAGLAEAGFLTNETVFSLTERPERLVVIGGGPIGCELAQSFARLGSQVTLLHKNERVLDREDPETSRIVGCALERDGVRVLTKARIEKVSRAGSIKTVHLAGGEQVACEAILLAAGRVPNVEGLGLEAAGVRYGKGGVEVDDRLCTSNPRIYACGDICLPWKFTHAAEASARIALENALFGGTLVLGQKKTSALTMPWCTYTDPEIAHVGLGEDEARKRGIAFDTIRLPLAESDRALTDGEEDGFIAVLLKQGSDKILGATLVARHAGEMISEITLAMVAGKGLATLSQVIHPYPTQAEIIRKVADAYESRSLERLRPFTEKWLAWLR

SEQ ID NO: 70127 - protein, 107 aa, Aster tripolium
GGHVNPAVTFGLAVGGQITIITGVFYWIAQLLGSVAASFLLSFVTGGLAVPIHGCADGVGAIQGMVMEIIITFALVYTVYGTACDPKKGDVGTIAPIAIGFIVGANI

SEQ ID NO: 70128 - protein, 509 aa, Triticum aestivum
MGLCTSSSAASPAGPAGNKEKGRKGSGGCRGIIACGKRTDFGYDKDFEARYALGKLLGHGQFGYTFAAVDRQSDERVAVKRIDKNKMVLPVAVEDVKREVKILKALHGHENVVHFYNAFEDDNYIYIVMELCEGGELLDHILAKKDSRYSEKDAAVVVRQMLKVAAECHLHGLVHRDMKPENFLFKSSKEGSPLKATDFGLSDFITPGKQFRDIFGSAYYVAPEVLKRKSGPESDVWSIGVITYILLCGRRPFWDKTEDGIFKEVLKNKPDFRRKPWANITPSAKDFVQKLLVKDPRARLTAAQALSHEWVREGGQASEIPLDISVLHNMRQFVKYSRFKQFALRALASTLNPEELSDLRDQFNAIDIDKSGTISLEELKQALAKDVPWRLKGPRVLEIVEAIDSNTDGFVDFEEFVAATLHVHQLVEHDTEKWKSLSQAAFDKFDVDGDGYITSNELRMNTGLKGSIDPLLEEADIDKDGKISLDEFRRLLKTASMSSRNPTPRSVSK

SEQ ID NO: 70129 - protein, 107 aa, Aster tripolium
GGHVNPAVTFGLAVGGQITILTGIIYVVAQLAGSIVACYLLSFVTGGLAVPIHGVADGVGAIQGVVMEIIITFALVYTVYATACDPKKGALGTIAPIAIGFIVGANI

SEQ ID NO: 70130 - protein, 515 aa, Zea mays
MAVAVPGQLNLDEAPSWGSRSVDCFEKLEQIGEGTYGQVYMAKETGTNEIVALKKIRMDNEREGFPITAIREIKILKKLHHQNVIKLKEIVTSPGPERDEQGRPIDGNKYKGSIYMVFEYMDHDLTGLADRPGMRFTVPQIKCYMKQLLTGLHYCHVNQVLHRDIKGSNLLIDNEGNLKLADFGLARSFSSDHNGNLTNRVITLWYRPPELLLGSTKYSPAVDMWSVGCIFAELLNGKPILPGKNEPEQLTKIFELCGTPDDTIWPGVTKMPWYNNFKPHRPLKRRVKDFFKHFDRHALDLLEKMLTLDPSQRISAKDALDAEYFWTDPLPCDPKSLPKYEASHEFQTKKKRQQQRQAEEAAKRQKLNHPPPHSRLPPIQQPGQAHPQIRPGQGMHNVPPVAAGPGHHYTKPRGPGGPNRYPPGGNQGGGYNPNRGGQGGGYGSGPYPQQGRGPPYPGGGMGGTAGPRGSGGSGYGAGGPNYQQGGPYGASGPGRGSNYSQGGGSRNQQQYGNWQ

SEQ ID NO: 70131 - protein, 107 aa, Aster tripolium
GGHVNPAVTFGAFVGGNITLLRGIVYIIAQLLGSTVACLLLKFVTNDMAVGVFSLSAGVGVTNALVFEIVMTFGLVYTVYATAIDPKKGSLGTIAPIAIGFIVGANI

SEQ ID NO: 70132 - protein, 294 aa, Zea mays
APPPARKNVAAFLGTIQVTKQHNEQLNGVQPGGANREDHSDTSKRTHENEVYNLAHQDEEPHQQMKKQKINAIGIDYRKEVLTEKVPFQNSGPASINKHSVLQNNGKTRVKDPEKKQQAGDEEARKEAGNEKSHETGASSQRRCDPPSNHDVEADQEGSLTTSIQSSGSDELEAKGLQEKKAAVSSKSRKGISKRDQHMPTSPRKRNSVHLQKRYSNPLAPPGRRKKLFWTEEEEAVLREGMAKFTPQNNAQIPWILILEHGRGVFHRTRLPSDLRVKWRSMQRKKSDAVDMEH

SEQ ID NO: 70133 - protein, 173 aa, Thermoplasma volcanium GSS1
MIYEFEGRVPDIDPSAYVSESATVIGKVKIGKEVWIGPGAVLRGDYGEIEVGDYSAIEDNCVIHARPGEKTFIGQHVTIGHLSVIHTGRIRDWAVIGMGSTVSDFAVVGVWAAIGEGAVVKNRQEIPDESIAVGVPAKVIGKIDEDYKKLWTDYKHNYNTFSSRYKTNLKKMK

SEQ ID NO: 70134 - protein, 278 aa, Physcomitrella patens subsp. patens
STAADLNVYVVTWNMNGKVPNNFADLFDVSGESHDFFVVGLQEAPNFDAKTCISEILGDKYCLVESSVLMSLQLFIFSKRSLKPFISGVKVDKVWEKGLSGIVGKQKGAAAVRLHFGDKSFLFITSHLAAHESNLKARNAQCAHICHSLFARSSESDVVIWLGDLNYRLELPRRFVQNSIKNKNLQEQLWAKDQLSVSLRKGQAFKGFHEGPLLFAPTFKYDVGTDNYDTGPKERVPSWTDRILYKTTNVKAELRSYDAISSVKTSDHRPVEAHLTFK

SEQ ID NO: 70135 - protein, 401 aa, Thermoplasma volcanium GSS1
MELPIEDVRVRKVLDSRGNFTVEADVYIPGGFGRTSAPAGASTGETEVIAFSKKGIDESIKFFETNVRRSIIGFNALDQKGFDALITDLDGSGNFSNLGGNLSTALSMSVAKAVSAHLGIPLYRYVGGINHSMPRPIGNVIGGGKHARNGTSIQEFLVSAQGKTFMESAYVNVLVHRKIGDILSEKMKDISIGVGDERAWSVNISDEEAFEVLNQAVNEVSSETKVKIYTGLDFAADSLYENGKYVYKHTVRSRDEQIDYAISINKDFGVYYIEDPMFDTDFEGFAEITKKIGDKAMIVGDDLYTTNPDRIRKGIELGSTNAVLIKVNQIGTLTKAQEAASLASSAGLKNVVSHRSGETTDDFLAHLSVAFSSTFVKTGTIGGERIAKLNELMRIEECLTS

SEQ ID NO: 70136 - protein, 282 aa, Zea mays
MAGGTLQDRSEAEDVRVGVDRFPERQPIGTAADDLGRDYSEPPAAPLFEASELSSWSFYRAGIAEFVATFLFLYVTVLTVMGGIAWAFGGMIFALVYCTAGVSGGHINPAVTFGLLLARKLSLTRAVYYVVMQCLGAVCGAGVVKAFGSALYESAGGGANAVSPGYTKGDGLGAEVVGTFVLVYTVFSATDAKRTARDSHVPALAPLPIGFAVFLVHLATIPITGTGINPARSLGAAIIYDNPHGWHGHWILWVGPFAGAALAAVYHQVVLRAIPFKSSALY

SEQ ID NO: 70137 - protein, 530 aa, Prunus persica
MAEVEGEPGSSMHGVTGREQTFAFSVASPIVPTDPTAKFDLPVDSEHKAKVFKIFSLANPHMRTFHLSWISFFTCFVSTFAAAPLVPIIRDNLNLTKQDIGNAGVASVSGSIFSRLVMGAVCDLLGPRYGCAFLIMLSAPTVFCMSFVSDAGGYLAVRFMIGFSLATFVSCQYWMSTMFNSKIIGLVNGTAAGWGNMGGGATQLLMPLVFDIIGRVGATPFTAWRIAFFIPGWLHVIMGIMVLTLGQDLPDGNLAALQKKGDVAKDQFSKVLWHAVTNYRTWIFVLLYGYSMGVELSTDNVIAEYFYDRFNLKLHTAGIIAATFGMANLVARPFGGFASDRAARYFGMRGRLWTLWILQTLGGVFCIWLGRANSLPIAVFAMILFSVGAQAACGATFGVIPFISRRSLGIISGLTGAGGNFGSGLTQLVFFSSSAFSTATGLSLMGVMIVCCTLPVTLVHFPQWGSMFLPPSKDVVKSTEEFYYGAEWNEEEKQKGLHQQSLRFAENSRSERGRRVASAPTPPNTTPSHV

SEQ ID NO: 70138 - protein, 424 aa, Methylococcus capsulatus str. Bath
MPESMHASSRFVSRLTRQTLALILAGGRGSRLQKLTEWRAKPAVPFGGKFRIIDFPLSNCVNSGIRQVGVLTQYKADSLIRHIQQGWGFLRGELGEFIDIMPAQQRLQESWYAGTADAVYQNLDIIRQRDPEFIMILAGDHVYKMDYGLMLAYHVERKADLTIGCMEVPLADAKAFGVMQMDGEQRIRKFVEKPSDPPPMPNRPDHAAASMGIYIFNTAFLFEQLIKDADTPGSNHDFGMDIIPQVIQKYRVFAYRFRNAQSGVQAYWRDVGTVDSYWAANMELIGVDPELNLYDQEWPIWTYQAQTPPAKFVFDDDDRRGMAVDSMVSGGCIISGAEVRHSLLFSNVRVNSFSRVLDSVILPDVNIGRHCRISRAVIDKGCNIPPNTVIGENLEDDRKRFYVSPEGIVLVTPDCLGQRLHFHR

SEQ ID NO: 70139 - protein, 404 aa, Nocardia farcinica IFM 10152
MRSQPHVLGIVLAGGEGKRLFPLTADRAKPAVPFGGAYRLIDFVLSNLVNAGYLRLCVLTQYKSHSLDRHISQTWRLSGFAGEYITPVPAQQRLGPRWYTGSADAIMQSLNLIYDEDPDYIVVFGADHVYRMDPEQMVSHHIDSGAGVTVAGIRVPRSEASAFGCIDSDESGRITQFLEKPAHPPGTPDDPNMTFASMGNYVFTTKVLVDSIRADAENSDSDHDMGGDIIPALVEAGEAGVYDFADNQVPGATDRDHGYWRDVGTIDAFYDAHMDLVSVHPVFNLYNKHWPIRGAAENLPPAKFAQGGLAQECIVGSGSILSAATVRNSVLSSNVVVDDGATVEGSVLMPGVRIGRGAVVRRAILDKNVVVGEGEIIGVDLDRDRERFAVSNGGVVTVGKGVWV

SEQ ID NO: 70140 - protein, 771 aa, Oryza sativa
MAAILPDLATQVLVPAAAVVGIAFAVVQWVLVSKVKMTAERRGGEGSPGAAAGKDGGAASEYLIEEEEGLNEHNVVEKCSEIQHAISEGATSFLFTEYKYVGLFMGIFAVLIFLFLGSVEGFSTKSQPCHYSKDRMCKPALANAIFSTVAFVLGAVTSLVSGFLGMKIATYANARTTLEARKGVGKAFITAFRSGAVMGFLLAASGLVVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMLYPLLISSVGIIACLITTLFATDFFEIKAVDEIEPALKKQLIISTVVMTVGIVLVSWLGLPYSFTIFNFGAQKTVYNWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNSIPGLMEGTTKPDYATCVKISTDASIKEMIPPGALVMLSPLIVGIFFGVETLSGLLAGALVSGVQIAISASNTGGAWDNAKKYIEAGASEHARTLGPKGSDCHKAAVIGDTIGDPLKDTSGPSLNILIKLMAVESLVFAPFFATHGGILFKWF

SEQ ID NO: 70141 - protein, 138 aa, Brassica napus
  misc_feature (64)..(64): Xaa can be any naturally occurring amino acid
RGGPHASANASGKTKKCFCWILAGPTGLGLKTAGGVDPSSTDVFFPREGKKDEMVGNKKRDFDXFSFDNVNDEKKPVEQFLRFPNALEFFESKLAVLQNLRQNHQSGRQVAFFEIDSSRKILFEKLRGSKGKELELLP

SEQ ID NO: 70142 - protein, 102 aa, Vitis vinifera
MAFLLNKATALSHFRSHSQKTEDSFSLSRRGFHVEPGPREKALLADNPSLKRFKSHKRNVWRLKRVGDVLTIVVVAGCCYEIYVKAVMREEARKQAAANEIA

SEQ ID NO: 70143 - protein, 622 aa, Bdellovibrio bacteriovorus HD100
MTPRRNSFSLGRMAITLLQLQSGHKAFGAKVLFDDATFAINEGEHVGVIGPNGAGKSTLFKILVDQEHLDEGIVTKSQQLRLGYLEQESDWDVDQKVEEYLEKNCIKPLWELKQFGLKLGLTEGHFQSHLKQLSGGYRMRVKLLYLIGQEPNLLLLDEPTNFLDLETLLVLESFLQEYKGAFLLISHDREFLRRVTDHILEVESGDIVKFPGSLDDYFEQKQMLAEILQKQVLSQQAKKKSIMDFVTRFGAKATKARQAQSRLKALEKMEVIEVKAAPTHSHIYIPPASPTGKMILEVENVECGYGDKVILKDVTLRLERGNHLGIVGLNGAGKSTLLKSLGEQIPLVRGSIKWGHQVSLSYFAQHTPESLNPEHTVLEAMASAAHKEVTQQDVLNIAGSLLFSGENVHKKVKVLSGGEKSRVALGQILLQKSPLLLLDEPTNHLDFDTVEALTTALEKYEGTIITVSHDRGFIGRVANKILEVNHGKLTLYPGTYDEYVWSLQKGFLAERDLNEGAATQKVSSEKATEAPKFNYKEERKKLETQIKKAQKLIEDCDKKIADLTKKRDALNENLMTAAGDKAAGLAKELHELSGAIEDLESSMLQAMEDQQKFEDELKQLVG

SEQ ID NO: 70144 - protein, 248 aa, Mycobacterium sp. JLS
MGDSTLILLRHGESEWNAKNLFTGWVDVDLTDKGRAEATRAGELIADLDRLPDELYTSLLRRAITTANIALDKADRHWIPVHRDWRLNERHYGALQGLNKAETKEKYGEEQFMAWRRSYDTPPPPIEAGSEYSQDRDPRYADIDGGPLTECLADVVARFVPYFEQTIVPDLREGKTVLIAAHGNSLRALVKYLDGMSDEDVVGLNIPTGIPLRYDLDSDLKPTVAGGTYLDPEAAAAGAAAVASQGAK

SEQ ID NO: 70145 - protein, 341 aa, Streptococcus agalactiae 2603V/R
MAKIISLGEVLLRLSPPQYHTLMQANHLKCQFGGSELNVLASLAQLGYHVGLVSALPDNDLGKMASQFILSQQISPAAIIKKEGRLGIYYYEQGFSVRTNKVIYDRNYSSFWESTLSDYDFTSIFKGVDWFHVSGITPALTKDLYEVTRFLMTKAKEGGVKVSIDLNFRESLWSSFQEAREQLSPLLGLLDVCFGLEPIYLAGESEDLKDELGLSRPYLDIELLEKITQKIVQEYGLDYIAFTQREMEYTNQYMLKSYLYHNNMLYQTDKTGVEVLDRVGTGDAFAAGLIHALLEKETPQRALEIAMATFKYKHTIQGDINIMTRDDIAYLIEKETNDIKR

SEQ ID NO: 70146 - protein, 269 aa, Burkholderia sp. 383
MGRRLDWHEETRMTNALERFRLDGRRALITGSGRGIGLTLARGLAEAGAAIVINDRNEEKAATLVRHLREEGFTADYAVFDVAEHAQVRAAIDDFEARVGAIDILVNNAGIQRRAPLDAFEPDDWHALMRVNLDGVFNVAQAVARHMIARGRGKIINICSVQSELARPTIAPYAATKGAVRMLTKGMCADWARHGIQANGLAPGYFETELNRALVDDAAFSDWLCKRTPAGRWGRVDELCGAAIFLASAASDFVNGQTLFVDGGLTSAV

SEQ ID NO: 70147 - protein, 506 aa, Oryza sativa Indica Group
MAVDMELDGGGDGKGKAPPQISLSGLFLACMVAGGVQYGWALQLSLLTPYIQTLGIPHALTSVMWLCGPIAGLIVQPCVGLYSDKCTSSLGRRRPFILTGCIIICISVIVIGFSSDIGYALGDATEDCKVYRGPRYHAAAAFILGFWLLDFSNNTVQGPARALMADLSGRHGPSAANAIFCSWMALGNILGYSSGSTNDWHKWFPFLMTRACCEACANLKAAFLVAVVFLGLSTAVTMVFAREVALDPVAAAKRNEGEASGPLAVFKGMKNLPVGMPSVLIVTGLTWLSWFPFILFDTDWMGREIYHGRPDGSPAEVTAFQEGVRQGAFGLLLNSIVLGISSFLIEPMCRRLGARAVWVMSSAVVCVAMAAVSVLSAWSLGDFGGSVQDAARAPAEEGGVRASALALFVFLGLPFAVLCSVPFAVTAQLTASRGGGQGLCTGVLNISIVVPQMAIALGAGPWDELFGEGNIPAFAMASVFAAAAAAAGVVLLPKVSVRSVSMAGGH

SEQ ID NO: 70148 - protein, 707 aa, Physcomitrella patens subsp. patens
MGTRGQEFSHPAPSPAAENMRQVCSTLGSLLACAAFGVCLVLHGCCHLVAAMLWDESDSDGDDHSDSDSEDTELYEEIVWEGLRNKTIVVKNGDNTYRCPLSPGRKKQSYKYRELLAHATGVATGKKGPVKAGGHRAVMKYLLAELGDRPMIPQAERILYLDQVVPKRKGRATRLLAPWMGILVNIDNSRTNENGFRLAPGPAEIKEKFKEYKPERVDVFHDFRGHQGTALLTFRSDIRGLEDAQAFEHSFAATNRGRKAWWEEARSANRDLYGWQAAEKDLESNLGRLAKHIKNYCDVKTVKDMVQENERLNKQIVEDLVKIVDKKNDMVAASHTQFVTLQNMVADVEALRLKAEEEKRNMEAQHKRDLEEMILKAHKKEAAHNEIVMSRQVALTNKLRTLESRCEQMRDTETKLRLSKEAVQLQFEKEMENAQRLLKEASKKAELHAAMRCKQTVEQKELIQKHEGENMELELAVQKKKMELMQKQLLELEKHQVKGLLEMEKSEESNKDKIAELEAELEMNQVMVNALSTKERTANEELEEARKVALDLLKTYGDENTVGIKYAGSIKKAPWIAACKKKNHPDGYQVAASKMISEWEQRLKDPKYHPFTTVDVGGDNWKRVINKNDEFLKELKMKLGMEVLQTVTTAVMEMEEYNASGRFVVEVAWDFRKNQRVLLKDVLLHFKELLESKRWKFGAKKKRVAEY

SEQ ID NO: 70149 - protein, 460 aa, Zea mays
EDVRATYTFGRELGRGQFGVTYLVTHSETGQRFACKSIATRKLVHRDDIEDVRREVQIMHHLTGHRNIVELRGAYEDRHSVNLVMELCEGGELFDRIIAKGHYTERAAASLCREIVAVVHSCHSMGVFHRDLKPENFLFLNNKEDSPLKATDFGLSVFFKHDVDTFKDLVGSAYYVAPEVLKRKYGAEADIWSAGVILYILLSGVPPFWAENEDGIFDAVLRGHIDFSSDPWPSISNGAKDLVKKMLRQDPKERLTAAEILNHPWIREDGEAPDKPLDITVIGRMKQFRAMNKLKKVALKVVAENLSDEEIMGLKEMFRSLDTDNSGTITLEELRSGLPKLGTKISESEIKQLMEAADVDGNGTIDYAEFISATMHLNRLEKEDHILKAFEYFDKDHSGYITVDELEEALKKYDMGDDKTIKEIIAEVDTDHDGRINYQEFVAMMRNNSPEIVPNRRRMF

SEQ ID NO: 70150 - protein, 94 aa, Glycine max
  misc_feature (54)..(54): Xaa can be any naturally occurring amino acid
MTSVYMNSMVADVHRTLLYGGIFLYPADKKSPNGKLRVLYEVFPMSFLMEHAGXQSFTGKERALDLVPTKLHERSPIFLGSYDDGEENQALYAA

SEQ ID NO: 70151 - protein, 355 aa, Glycine max
MENADIPENANEHCPGPQSESAGKSDACEGCPNQQICATAPKGPDPDLVAIAERMATVKHKILVLSGKGGVGKSTFSAQLAFALAARDFQVGLLDVDICGPSIPKMLGLEGQEIHQSNLGWSPVYVESNLGVMSIGFMLPNPDEAVIWRGPRKNGLIKQFLKDVYWGELDFLIVDAPPGTSDEHISLVQCLDATGIDGAIIVTTPQQISLIDVRKEVNFCKKVGVKVLGVVENMSGLCLPITDFKFMKLTDNGEQKDVTQWVWEYMREKAPEMLNLLACTEVFDSSGGGAVKMCNDMGVTFLGKVPLDPQLCKAAEEGSSCFAKKDCVVSAPALKKIIEQLIETNGWSMLLSNGV

SEQ ID NO: 70152 - protein, 485 aa, Coccidioides immitis RS
MADNAPPATSSSLPPPPQAPAGAPGQQQLDKAQGNGQGNPSHMPPPPLPPVVIPQNTNPIPTAITSPMSGNMMSPTSAGGYVRRAAPEPNKRALYVGGLDPRVTEDILRQIFETTGHVQSVKIIPDKNFQSKGLNYGFVEYDDPGAAERAMQTLNGRRVHQSEIRVNWAYQSNNANKEDTSNHFHIFVGDLSNEVNDEVLLQAFSAFGSVSEARVMWDMKTGRSRGYGFVAFRERADAEKALSSMDGEWLGSRAIRCNWANQKGQPSISQQQAMAAMGMTPTTPFGHHHFPTHGVQSYDMVVQQTPQWQTTCYVGNLTPYTTQNDLVPLFQNFGYVVETRFQADRGFAFVKMDTHENAAMAICQLNGYNVNGRPLKCSWGKDRPPTGQFDYSPQQGANPAFNSGTSPYFPQYGGPGGPMTPQGPNPAGRGWDQSGANFGPGMPGQGYGQVPGGAAGYGRGQNNPGSGWAQPNAGNFGNGFGGYQA

SEQ ID NO: 70153 - protein, 430 aa, Debaryomyces hansenii CBS767
MKILVTSDDTGAVKEVVCSRGTDTSKQDAKQPKSIKNICSEPGASVRTRVLHMVNFKSTFLVASRLGGSVTIYDLNHEEYELVHTYQLAISNEDKPISLIELEEFDVVVVAFESGKVFVINLNNGKFDLDPIEIQLPGKKGISAFINNPHEAGVFACGGKENDARIIRLFEGEITKDVFEAENKQEFFQPDVIFTARNVKNDHLDLRPPIWISSILFFEEKPKDGYKFLTSTRYGQVRIYDTTHGKRPIQDYKVCEKPIVTLNFADSEEEVIVSDTHNLVAKYSLAQIDSKAFKTHSASAGEITKPVSKLLGKFSAGGNTGAIVGVNIFDDEIISTGGLDRYLRTYDISSREILAKVYLGVQISDVLMLDSEDEEEEEPESEMGDKRKKNIEKRRRKALEAEENESDEEELWNQLEENNKTKIEKKKRRI

SEQ ID NO: 70154 - protein, 661 aa, Triticum aestivum
  misc_feature (440)..(440): Xaa can be any naturally occurring amino acid
  misc_feature (449)..(449): Xaa can be any naturally occurring amino acid
  misc_feature (460)..(460): Xaa can be any naturally occurring amino acid
MGGSAAAGKSVDGGGRAAQRMPVPEARPFLDTFRANLKETFFPDDPFRAVVRERGFGRRAAAALRYFFPFLEWAPAYRLGTFKSDLIAGITIASLAIPQGISYAKLANLPPILGLYSSFVPPLVYAMMGSSKDLAVGTVAVASLLIASMLGAEVSATENPALYLHLAFTATFFAGVIQASLGILRLGFIVDFLSHAAIVGFMGGAATVVCLQQLKGMLGLEHFTTSTDLVSVMRSVFSQTHQWRWESVVLGCGFLFFLLVTRFFSKRQPRFFWVSAAAPLTSVILGSLLVYFTHAENHGVQIIGNLKKGLNPISVTNLQFTPPYMMLALKTGLITGVIALAEGIAVGRSFAMFKNYHIDGNKEMIAIGTMNILGSFTSCYLTTGPFSRSAVNYNAGCKTAMSNVVMSLAVMVTLLFLTPLFHYTPLVVLSAIIMSAMLGXLIDFPAAVXHLWHVDKVELXCVCAGAYLGVVFGSVEMGLVVAVAISVLRVLLFVARPRTTVLGNVPDTNVYRRMDQYTTARAVPGVLVLRVDSPIYFANSGYLRERFTRWIDEDDERTSAKGETGVQYVVLDMGAVGSIDTSGTSMLDELKKTLDRRGIQIVLANPGSEIMKKLDSSKVLELIGHEWIFPTVGEAVAECDFVLHSHKPGMVVDGASHENMV

SEQ ID NO: 70155 - protein, 527 aa, Synechococcus sp. RS9917
MIALPMALAFGVASGAGAAAGLWAAVIIGLVAALFGGTPTLISEPTGPMTVVFTSVILSFTATAPDRETALAMAFTVVILAGLFQILFGVFRLGRYVTQMPYTVISGFMSGIGIILVILQLAPFLGQASPKGGVIGTLSQLPQLLSGVRPYELILALITVAILWFTPARLKKVCPPQLLALVIGTLLSLTLFSAAGLRTIPDFQAEFPSLRMPIFAADQWRLMVIDGAVLGMLGCIDALLTSVVADSLTRTEHNSNKELVGQGLANIASGLFGGLPGAGATMGTVVNIQAGGRSALSGVVRAVILMLVILLAAPLVSTIPLAVLAGIALKVGIDIIDWDFLRRAHHLSLKAALITYGVIALTVLVDLIAAVGIGVFVANVLTIDRMSALQSKRVKTISTADDDVELSGEEQQLLDQAGGKVLLFQLAGPMIFGVAKTIAREHNAISNCNAVVFDLSEVTHLGVTASLALENAIKEALEVGRRVHLVLLPGGARNRLEKLKLLERIPQEQISEDRLEALRSAVAGLPA

SEQ ID NO: 70156 - protein, 234 aa, Arabidopsis thaliana
MKNPVYVYYQLENYYQNHRRYVKSRQDGQLRSPKDEHETKSCAPEDTLGGQPIVPCGLVAWSLFNDTYDFTRNNQKLPVNKKDISWKSDRESKFGKNVFPKNFQKGSLIGGKSLDQDIPLSEQEDLIVWMRTAALPTFRKLYGKIDTDLQAGDTIKVLLQNNYNTYSFNGKKKLVLSTTSWLGGRNDFLGIAYLTVGSICLFLAVSFSVLYLAKPRQLGDPSYLSWNRSAGGGR

SEQ ID NO: 70157 - protein, 276 aa, Triticum aestivum
HSRTSLYKKAGCYRSGIPGISSTHASAATQMLESMIKSPRPTRAEATDVANAVLDGTDCVMLSGETAAGAYPELAVQTMAKICLQAESCVDYSAVFKSIMSSAPIPMSPLESLASSAVRTANSAKATLILVLTRGGTTARLVAKYRPSMPILSVVVPELKTVEFDWICSDEGPARQSLIVRGVIPMLSAGTAKAFDSEATEEALRFAMKKRKEMGLCNAGESIVALHRIGDASVIKLLTRVASGSDNATPFLPGDFSFFARLRIPTSFLPARLRQC

SEQ ID NO: 70158 - protein, 319 aa, Yersinia pestis CO92
MSKIVSLGIHVLDVLGRHVNRFPPGGELDIINEIRLTVAGTAAGMSVDLAKLGGDVYAMGAVGLDESGNFIIDTLRRYGVNTDHIVRKSEVQTSCSMLPIRPNGERPVLHVLGANATYRLEDIHWDVIASADILHFGGTYLLPGLDGPPTATILKFAKEHGVTTTLDLLVNAQPDLLAKLEPALPYIDYFMPGLDEARAICGLEKRADVIAFFLNRGVGHTVFKMGAEGSSIASLEMAEILIPAYKAQVVDSTGCGDSYCAAFIMGLTKGWDLATSGRFASAAASLVVSGLGSDAGIIDFEHTLKVMNTAETLPIAQET

SEQ ID NO: 70159 - protein, 480 aa, Novosphingobium aromaticivorans DSM 12444
MANIRPFCMPKWGIEMTEGTIAEWMVKEGEAFNKGQVLCLIETAKITNEVEAEYDAVLKRLLTPASDEAHPVGALLAVFADADTTDAEVDEFIAGFKPAETSVAAKSGGGSAPAPAPAAAAPAPAAPARTPTKIVTNRAISPEALKLAEAEGVDIEPIEGSGRNGRITYQDVVQALRPERALSYKGSAQLVEDSPEAFASPLARRIAAQHGIALAGIKGTGARGRISKADVMALVKPTTAAAPVFGAPFELVANQPQVQPFDKVRKVVARRLTEAKQTIPHFYLRVSASVDALMDLRKTANLVLGTKASINDYLVKAVALALVRHPDVNVQVHGDSVHSFPHADVAIAVASPKGLVTPIVRQADRMHIAQIAATTRALIDKAQAGRLGYEDMDGGTFSVSNLGMFGIEQFDAIINPPQGAILAVGGVNRVAVEAANGDIAFENRIQLTMSVDHRAIDGAAGAKFLQTLKGLLEAPEGLFA

SEQ ID NO: 70160 - protein, 154 aa, Synechococcus sp. WH 8102
MASAPQVRATSDCPPSTAAPTWMLLWPESRPSEQVVQRFPLDLNLPNTMAMAVDTPTRSPGGAAVMEKAPERVRKQSPRYKVLLHNDPVNTMEYVVTTLRQVVPQLSEQDAMAVMIEAHNTGVGLVIVCDLEPAEFYCETLKAKGLTSTIEPET

SEQ ID NO: 70161 - protein, 488 aa, Streptococcus agalactiae 2603V/R
MTNELIMQAFEWYLPSDGNHWKKLEESISDLKKLGISKIWLPPAFKGTSSDDVGYGVYDLFDLGEFDQNGTIRTKYGRKEEYLKLIKSLKANGIKPFADIVLNHKANGDHKEKFQVIKVNPENRQEALSEPYEIEGWTGFDFPGRQGEYNDFKWHWYHFTGLDYDAKNNETDIFMIVGDNKGWADDDLIDDENGNFDYLMYNDIDFKHPEVIKNLQDWAKWFIETTGIEGFRLDAVKHIDSYFIQTFINDIRTKIKPDLEVFGEYWKSDQTSMKDYLEATQFQFSLVDVTLHMNFFDASHQNRDFDMRTIFDDSLVIDNPEYAVTFVENHDTQSGQALESRVEDWFKPLAYGLILLRQQGTPCLFYGDYYGIQGEFGQPSFKEVIDKMAELRQNYVFGKQVDYFTHSNCIGWTCLGDEEHNSCLAVVLTNGDQGWKHMEVGEIYAGKTFVDYLGNCEQEVVIGDDGWGDFLVESASISAWVPKIEEAN

SEQ ID NO: 70162 - protein, 535 aa, Bdellovibrio bacteriovorus HD100
MEILETNIDSSSSDFKLNREAMLGIVNEWRERVNLVKQGGGEDATKKHKSRGKLTARERIEALVDGGTAFLEFSTLAAWDMYEGQAPGAGVVTGIGVIHGTECVIVANDATVKGGTYFPMTVKKHLRAQEIAFENGLPCIYLVDSGGAFLPMQADVFPDRDHFGRIFYNQARMSAANIPQIAVVMGSCTAGGAYVPAMSDETVIVKENGTIFLGGPPLVKAATGEVVDAQELGGAQVHCENSGVTDHFAEDDEHAIEITRSIVAHLNHKRAVQLKTLPVEEPLFDQKELYGIIPKDSRVPFDVREVIARIVDGSRFHEFKPLYGKTLVTGFAHIWGMPVGIIANNGVLFSESSLKAAHFIELCEQREVPLIFLQNITGFMVGKKYENEGIAKHGAKMVMAVSNAHVPKFTVVIGGSYGAGNYGMCGRAFQPRQLWMWPNAKISVMGGEQAANVLLTVKMDQMAAKKQTMSAEEQAEFKRPTLEKYEKESACYYSSARLWDDGIIDPADTRRVLALGISASLNKSWGEKTQGVFRM

SEQ ID NO: 70163 - protein, 520 aa, Geobacter sulfurreducens PCA
MSTDIHTEKILILDFGSQYTQLIARRVREAHVYCELHPFDMGLEAIRAFAPKGIILSGGPKSVYEEGAPAVEEALFDLGVPVLGICYGMQLMSRHFGGEVVPAGKREFGHADLLAAGTPGPLFEGFFVEGKSPVWMSHGDHVSRMPQGFQVVAETANAPVCAIQDTARNLYGVQFHPEVNHTPRGEILIDTFVRKICGCTGQWTPGHIIEDAVNRIRAQVGRERVILGLSGGVDSSVAAALIHRAIGDQLTCVFVDNGLLRLAEGDQVMATFAENLGVKVIRVDAEQRFLTALADEADPEKKRKIIGNLFVEIFEEESSRIEGATWLAQGTIYPDVIESAGAKTGKAHNIKSHHNVGGLPEYMKLKLLEPLRELFKDEVRAIGEELGLPRQMVWRHPFPGPGLGVRILGEVKKEYADILRRADAIYIEELYAAGHYDKISQAFAVFLPVKSVGVMGDGRTYEYVIALRAVETKDFMTAGWYPLPYEDMARISGRIINEVKGVNRVVYDISSKPPATIEWE

SEQ ID NO: 70164 - protein, 232 aa, Sulfobacillus acidophilus
MSHTPLPVLIAPSILSADFGHLADDVRDVVNRGADWIHVDVMDGRFVPNITMGPVVVEGIRPVTDRPLDVHLMIVEPERYLEDFARAGAERISVHAEATPHLHRALEMIHGLGKLAGVALNPSTPVSAIYHVAENLDLVLLMTVNPGFGGQSFIRPMLTKIRETRDWLDRQGLTHVPIEVDGGINPETAKWAIESGATVMVAGSAIFRAPDRTLMIQQIRQAASHPSVPISR

SEQ ID NO: 70165 - protein, 502 aa, Debaryomyces hansenii CBS767
MSVEPFGKHVTIVVFGASGDLAKKKTFPALFGLFREGELPSTIKVIGYARSELSDADFKERISANFKGVNDSNKHKVDEFLNLCSYTQGQYDSAEGFKKLNEEMEKYEKDSGVDKPERLFYLALPPSVFVTVASHIKENAYTKTGEVRLIVEKPFGNDLESSRKLQKSLAPLFTEEELYRIDHYLGKEMVKNLVFLRFSNEFLNASWNKNHIKSIQISFKEAFGTEGRGGYFDDIGIVRDVMQNHLLQVLTLLTMERPVSIDPEAIRDEKVKVLKAFGELETDDILLGQYTKSEDGTKPGYLDDDTVKGDSKCVTYAALGMQIHNERWEGVPIVMRAGKALKESKVEIRIQFKEVAKGMFNDIQRNELVMRIQPNEAVYMKINSKIPGISAVPSVTDLDLTYSSRYSKEFWIPEAYESLIRDCYLGNHANFVRDDELDLSWKLFTPLLQHIESKDGPTPEPYPYGSNGPKNLRPFLSDHGYNFYDEGTYEWPLTTPNVKGKM

SEQ ID NO: 70166 - protein, 336 aa, Sulfobacillus acidophilus
MIRVGINGFGSIGRRFLRIALTRDDMEIVAINDLTDAKTLAHLLKYDSNYGPLPVEVSAGPESTIRVGSRTIQVLSERNPGNIPWKNFGVDLVIESTGLFTKAEKARAHIDEGGARRVIISAPADGEDATLVIGVNHHEYDPGHHYVISNASCTTNCLAPVAKVLHDQFHIEAGLMTTVHSYTNDQRLLDLPHSDLRRARAAGQNIIPSSTGAARALHKVIPALKGRMNGMALRVPTSVVSIVDLTVTTAKPVSVDAVNQALAEAANGSLKGVLQVTDEPLVSSDFRGNPHSSIVDARETMQIGDNMVKVLAWYDNEWGYANRLVELAAYVGQQEG

SEQ ID NO: 70167 - protein, 381 aa, Thermoplasma volcanium GSS1
MLSQRLQYVNESATVSASNYVEKLKKQGIKVYNFGIGEPDFTTPQHIIEYAFEMAKEGKTHYTPSNGIHELREKVSEKLKNRNNINASPDEVLITPTKFGINLAMMVILNPGDEVLIPEPYYVSYPDIVRLAGGKPVTVSTLEDYSLDFDLMRKYVTPKTKAIIFNNPTNPTGKVYDEKEIKSLVDFALEYGLYIVSDEIYEDLIYNGKLISPASYSEMWGKSITLNGFSKGYAMTGWRIGYMAAPREIVEAANVIQQQTITCVSSISQYAALRALDDTESPKKMKDEFKRRRDLILSILDSSDKLNVTEPDGAFYVFPEYNSDISSNKVSEDLLEKYQVVVTPGSAFGRQGEHHFRISFATSEDIIKEGAERIIKFFASV

SEQ ID NO: 70168 - protein, 165 aa, Oryza sativa Japonica Group
MMGSNSAGGGGGGAMVPGGMGGGGPMGAAAAGGGGGGDGRHDDEAVLTEFLSSLMDYTPTIPDELVEHYLGRSGFYCPDLRLTRLVAVATQKFISDIASDSLQHCKARVAAPIKDNKSKQPKDRRLVLTMDDLSKALQEHGVNLKHPEYFADSPSAGMAPAAREE

SEQ ID NO: 70169 - protein, 368 aa, Burkholderia mallei ATCC 23344
MKTKAAIAWKAGEPLTIEEVDLEGPRAGEVLIEVKATGICHTDYYTLSGADPEGIFPAILGHEGAGVVVDVGPGVGTLKKGDHVIPLYTPECRECKFCLSRKTNLCQKIRATQGRGLMPDATSRFSVGGKPIFHYMGTSTFSNYIVVPEIAVAKVREDAPFDKICYIGCGVTTGVGAVVYSAKVEAGANVVVFGLGGIGLNVIQGARMVGADKIIGVDLNPKRVELARKFGMTHFINPNEVENVVDHIVQLTDGGADYSFECIGNVKVMRQALECTHKGWGQSFIIGVAAAGEEISTRPFQLVTGREWKGSAFGGARGRTDVPKIVDWYMEGKINIDDLITHTLPLEKINEGFELMKKGESIRSVVLY

SEQ ID NO: 70170 - protein, 243 aa, Brassica napus
  misc_feature (238)..(238): Xaa can be any naturally occurring amino acid
MSSILSNVLPAPEDPVLSVIFACRDDPCPVKLNLSVGAYRTEEGKPLVLEVVRKAEQQLANDLSCDKGYLPIDGLADFNKLSAKLILGDDSHAVKENRVVTIQCLSGTGSLRVGAEFLAKHHQQRVIFVPNPTWGNHPFIFTLAGLSVEYFRYYDPQTRGLDFEGMLEDLGAAPSGAIVVLQACAHNPTGIDPTLEQWEQIRQIVRSKGLLPFFDNAYQGFASGNLDSDAQSVRMLVXDGGEC

SEQ ID NO: 70171 - protein, 234 aa, Nitrosomonas europaea ATCC 19718
MNEIQEPIRLVLLRHGQSIWNQDRHFTGWGDIVLSPQGEQEALRAGHLLKQAGFTFDACFCSELQRASDTLAIVQSVMGLNHLSTYRTWRLNERHYGALEGMRPWAAIRKFGIWSTMKSQIRFDAAPPLLMPDDPRAPVNQPRYAAVDRTQLPLAESMQQTLERVRPLWQETILPEIRQGKRLLIVSHQNLLKTLVMQLEGLTGAQIMRLSITTGHPLCYELDHSLVPVKRYYL

SEQ ID NO: 70172 - protein, 174 aa, Nitrosomonas europaea ATCC 19718
MSIKSRIRTIPHYPHEGIMFRDITTLLKDPAGLRSTIDGIVQRYQTEKIDKVVGIESRGFIIAAPVAYALSAGFVPVRKQGKLPAETIGCDYQLEYGYDKVEIHVDAIDKGDRVLLIDDLIATGGTMEAAIKLVQEAGGEVIECCFVIDLPDIGGSRRLRQQGHRLFSLCSFED

SEQ ID NO: 70173 - protein, 56 aa, Oryza sativa Japonica Group
KLLHGPLQHLRCDGSDSRTLDETLENMHALNRMFSLDTEKAIIEQKIKAKVEKSQN

SEQ ID NO: 70174 - protein, 373 aa, Nocardia farcinica IFM 10152
MRPPVVSRGRVSSLLPDFPWDTIAAVKAKAAAHPGGIVDLSVGTPVDPVAPVIRTALDSVAEVPGYPTTHGTPELRAAAVDALKRRYGVTGVDPAAVLPVIGTKELIAGLPRLLGVGPADLVVIPEIAYPTYEVGALLAGAQILRADGLTRLGPQSPALIYLNSPSNPTGRVLGVEHLRKVVAFARERGAVVASDECYLGLSWDARALSILDPQVCDGDHTGLLAIHSLSKTSNLASYRAGFVAGDPELVAELLEVRKHSGMMVPFPIQAAMTAALADDTHEAQQRERYRVRREQLRAALTAAGFRIDHSEAGLYLWSTRGENARTTLDWLAERGILAAPGDFYGPASGEHVRIALTATDERIAAAVARLTTN

SEQ ID NO: 70175 - protein, 214 aa, Zea mays
MALRMPCDDGGSQPPYGRKRTALLQRVGRAGKDGTALAQGRSLPPAWTLVTPYCKRTRPGRGANTKAAGSTLPRLSPSGCFSPLRVPPRADPSGLGHAVTIYSSVQGPPGANGHLWCQIQQLGAPDRGIGLSGDPTGLSASSSPPMADWGPVVIATVLFVLLTPGLLFQLPAHGRIVGFGTMHTSGVAILVHAVLYFALITIFLIAIGVHIYAG

SEQ ID NO: 70176 - protein, 537 aa, Gloeobacter violaceus PCC 7421
MAPCRSTFRPRLLCTDCSEIRLIWVNSGCPPHASYSCKHSRCAQECLGWKSDPILEGGLDTDASVHNNPLLQLDYEPAFASLGDDYYDLVAAAPFPEHRLRFRGDGVLRLLGLDPATVGEEHFIEAFGRFAGRGPFLAMRYHGYQFGEYNPYLGDGRGFLYGQVRGLDGELYDFGTKGSGTTPYSRGGDGRLTLKGGVREVLASEALHHLGVRTSRSLSLIETGEALWRGDEPSPTRSAVLVRTSRSHVRFGTFERLHHFKRKDLIQKLLDYVIAVYYPHYGAEPERYALFYRELVGRTAELAAQWMAVGFTHAVLNTDNMSITAESFDYGPYAFIDRFDPGFTAAYFDHYGRYSYGNQPLVCRINLEALQLPLSMVIPIADLEAGLAIFDTHYAAHYTARMLAKLGFGALGPVLGPELVKATLNYLEAAQAGYHGFFQALAASFDRSWQSDQGAIPAPVVGAPEAFELWRESYFRALASLSDSELLRVGERLNRHNPTTVLLRPAIEAVWAAIDQNDDWQPFYDLIGRLRKPYAIA

SEQ ID NO: 70177 - protein, 503 aa, Vitis vinifera
METKIPCRQLFIDGKWVEPITKRRIPVINPATEQTIGLIPAATGEDVELAVDAARRAFARNKGADWAKAPGAVRAKYLRAIAAKITERKTELAKLEALDCGKPLDEAAWDIDDVASCFEYFADHAEALDAQQKAPLSLPMETFKCHILKEPVGVVGLITPWNYPLLMATWKVAPALAAGCTAILKPSELASVTCLELADVCIEVGLPPGVLNILTGLGSEAGAPLSSHPHVDKIAFTGSTVTGSKIMTAAAQLVKPVSLELGGKSPILVFEDVDLDKAAEWTAFGCFWTNGQICSATSRLLVHESIAAEFLDKLVKWTKNIKISDPFEEGCRLGPVVSREQYEKILKLVSTAKSEGATILCGGGRPQHLKMGFYIEPTIISDVTTSMQIWREEVFGPVLCVKTFSSEDEAIELANDTQYGLAGAVISNDLERCERVSKALNAGIVWINCSQPCFCQAPWGGNKRSGFGRELGPRGLDNYLSVKQVTQYLSNEPWGWYQSPSKL

SEQ ID NO: 70178 - protein, 507 aa, Novosphingobium aromaticivorans DSM 12444
MTVAEAETYWTALAGLPRPTLKELFSDAGRLDRYAATLDLPGGPIRFDWSKTHLSAEVEAVFAALASAMDFEGRRAALIEGAKINNTEGRAAEHTAQRGIGNEASVEEAEALHARMRMLVDAIHAGALGEVRSLIHIGIGGSALGPALAIDALTRDGAKVAVHVVSNIDGCALEAAMKACDPATTMIAVASKTFTTTETMTNAASALEWLRENGVADPYGQVVALTAAPEKAVEWGVDETRVLPFSETVGGRYSLWSSIGFPVAMALGWEGFAAFLDGAAAIDRHFIDADLAGNVVVRAAFADLYYTQVRGCQTRAVFAYDERLALLPDYLQQLEMESNGKRVLADGSPLTRPSAPVTWGGVGTDAQHAVFQLLHQGTHLIPVDFLAVKTQGHDLDPAHHQILLSNCFAQGAALMAGKASDDGARAYPGDRPSATILCDDLNPATLGALIAFHEHRTFVSAVMLGINPFDQFGVELGKAIAKQIESGGGEGFDPSTEALLAAVGLAG

SEQ ID NO: 70179 - protein, 191 aa, Listeria monocytogenes EGD-e
MQLIFARHGETDWNVAKKYCGQLDVPLNEHGVQQMKHLREKLEDYSFDLVVTSDLMRVKQSANILSNAKTVRFPALNEMNFGDFEGYTYQEISTKFPKAWNEYCNNWQTALFPNGESFPIFYERVVEVLEVEMEKWQQIDTVLLVGHLGVLRVIALFLQKQTIAQYWDIDFKQGCYSLWDNKSQRFLISNQ

SEQ ID NO: 70180 - protein, 262 aa, Vitis vinifera
MEEEKAAAYYDELTRKGEGAARFKQGLGFSSQSSTSTAPSKTRSFLSNFVRASSPTKASQLEKQAQLESIQNKLKKKPKSCEENSNDKVSRDRDRHSSRRSRSPKIEKNGGVDYARLIDGYDKMTPAERVKAKMKLQLSETAEKDATKGMGSGWERFEFNKDAPLDDEEIEAAEDDAMLVKHVGQSFRFSAVETRREEQIKAAHDEAIFGGSTIPPSNFSDNEPEVENDTKESNESSLGTSLISEKVLAKQQGSWRDRARRV

SEQ ID NO: 70181 - protein, 453 aa, Novosphingobium aromaticivorans DSM 12444
MAEQEFDYDLFVIGAGSGGVRASRIAASHGARVAVAEEYRVGGTCVIRGCVPKKLLVYGSHFAEELQDAANYGWTVEKMSFDWPTLRDAVLKDVDRLNTAYTSTLENNKVERFLERATVTGPNTVRLGGSGREISARYILVATGAWPVMPDFPGNEHCITSNEVFHLENLPKRVVISGAGYIAMEFAGIFNALGCHVTVVNRSETILRGYDESLRDRLLQITMARGIEYKFNCPFEKVEKQADGSLQVFLAGQPDPLAADIVLVATGRLPKTDGLGLETAGIELGAQGEIPVDDHGRTACDSIYAVGDVTNRVQLTPIAIREGHAFADRVFGGKDTSVSYDCIPSAVFSQPPLAGVGLTESQARQAFGGNIKVYSSDFRPMKNIFGHRPERGLYKMIVEATSERVLGIHMIGPEAPEILQAAAIAVKAGLTKADFDATVALHPSMAEELVLMR

SEQ ID NO: 70182 - protein, 353 aa, Vibrio fischeri ES114
MKKNAIAVGMLLSGLCFSSISLADDLPNIKILATGGTIAGAGQSATGSSYTSGKVGVDSLIHAVPQMTEIADISGEQVVSIGSQDMNDEVWLTLSKRVNELLAQDDVDGVVITHGTDTMEETAYFLDLTVKSDKPVILVGAMRPSTAMSADGPVNLYNAVVAATDEDSVGRGVLVAMNDTVFDARDVTKTNTTSVNTFQSPNFGPLGYIHNGDVQYQRSPERKHTTEAEFDVSKLKTLPKVGIVYNYANASALPVTAMVDAKYDGIVSAGVGNGNIYHSVFDELAKASKEGVVVVRSARTGSGSTTLDAEIDDAKYGFVASGTLNPQKARILLMLSLTETENYKEIQKMFQYY

SEQ ID NO: 70183 - protein, 315 aa, Arabidopsis thaliana
SSSFSPHPPLSSNSSGRRNLKTFRYAFRAKASAKIPMPPINPKDPFLSTLASIAANSPEKLLNRPVNADVPPYLDIFDSPQLMSSPAQVERSVAYNEHRPRTPPPDLPSMLLDGRIVYIGMPLVPAVTELVVAELMYLQWLDPKEPIYIYINSTGTTRDDGETVGMESEGFAIYDSLMQLKNEVHTVCVGAAIGQACLLLSAGTKGKRFMMPHAKAMIQQPRVPSSGLMPASDVLIRAKEVITNRDILVELLSKHTGNSVETVANVMRRPYYMDAPKAKEFGVIDRILWRGQEKIIADVVPSEEFDKNAGIKSVV

SEQ ID NO: 70184 - protein, 166 aa, Chlamydomonas reinhardtii
MPTFLLCIRAELDNVDTISIPSTTHWCLDVKESAGSEEKKGVYVTSTEEHELNGSKGTANLVMKFAKGSKKESSVNVLEIKGVTRPCDAELASDDDGKFVPIIAFECRGLEPIAFHPEGDWHVVSSGGTKYDNVDLKENEWSDYCEKAAASVGIYSFESKFELHKG

SEQ ID NO: 70185 - protein, 288 aa, Vitis vinifera
MITDSITSAAASISKEFGKKKRTNRTAKLKQCKLDARREQWLSKVKNNGCRGESEGIPESSMHKRNESNESNRSLENLEVRPRGGENDGSVHHDSDSESPANSPTSHISSILGSTDSGTNYHASSSSSSSSGGCCSGNDECLDDWEAVADALAAVDKQKIPVQEGHSRNLWSNMWEWFLGPQQMDKRGGLMMLSDLRTGIMVMEGVAAIPISCPICYEDLDFTDSSFLPCSCGFRLCLFCHKRILEEDGRCPGCRKPYDCDPVEAEAIVNGGSLTFRLGRSYSMIARS

SEQ ID NO: 70186 - protein, 191 aa, Mycobacterium tuberculosis
MAHHHHHHSGADCDSVTNSPLATATATLHTNRGDIKIALFGNHAPKTVANFVGLAQGTKDYSTQNASGGPSGPFYDGAVFHRVIQGFMIQGGDPTGTGRGGPGYKFADEFHPELQFDKPYLLAMANAGPGTNGSQFFITVGKTPHLNRRHTIFGEVIDAESQRVVEAISKTATDGNDRPTDPVVIESITIS

SEQ ID NO: 70187 - protein, 629 aa, Oryza sativa Japonica Group
MATWRLRRAAAAIAASSAVVAAGAAWPSASASDPSPAALEAARRRVAQPGAAPPPRAAQRAALAGSTPADPLDVLVVGGGATGCGVALDAATRGLRVGLVEREDFSSGTSSRSTKLIHGGVRYLEKAVFNLDYGQLKLVFHALKERKQVIENAPHLCHALPCMTPCFNWFEVVYYWFGLKFYDIVAGRRLLHLSRYYSVDESVELFPTLAKNSHDRSLRGTVVYYDGQMNDSRLNVGLACTAAVVGAAILNYAEVVSLIKDESGERIIGARIRDTLSGKEFDAFAKVVVNAAGPFCDSVRKMANNDVVPMISPSSGVHIVLPDYYSPDGMGLIVPKTKDGRVVFMLPWLGRTVAGTTDSSTAITMLPEPHEDEIQFILDAICDYLNVQVRRSDVLSAWSGIRPLAMDPSAKNTESISRDHVVFEDYPGLITITGGKWTTYRSMAEDAVNAAIRSGNLKPANGCVTDHLHILGGYGWDPASFTVLAQNYKRMKRTYGGKIIPGAMDSAVSKHLSHAYGTLATQVASIAQNEGLGKRLAHGYPFLEAEVAYCARHEYCESAVDFIARRCRLAFLDTDAAGRALPRIIEILALERKWDKARQKLELQKGKDFLETFKSSKNAQFRDGKHNGQ

SEQ ID NO: 70188 - protein, 393 aa, Geobacillus kaustophilus HTA426
MKLAKRVASLTPSATLAITAKAKELKAAGYDVIGLGAGEPDFNTPEHIIAAAIKAMNEGHTKYTPSGGLPALKEEIIKKFARDQGLSYEPAEIIVCVGAKHALYTLFQVLLDEGDEVIIPTPYWVSYPEQVKLAGGVPVYVEGLEENDFKMTSDQLKQAITPKTKAVIINSPSNPTGMIYTAEELKALGEVCLAHGVLIVSDEIYEKLIYGGAKHVSIAELSPELKEQTIIINGVSKSHSMTGWRIGYAAGPKDIIQAMTDLASHSTSNPTSIAQYAAIAAYSGPQEPVEQMRQAFEKRLDIIYDKLVQIPGFTCIKPQGAFYLFPNARKAADMAECRTVDEFVAVLLEEAKVALVPGSGFGAPDYVRLSYATSLEALETAIERIRRFMEARA

SEQ ID NO: 70189 - protein, 628 aa, Chlamydomonas reinhardtii
MDVFQYTTLDKGAGSALFRAPRLTYIGAADVQTRRARMSTGVDYLGHGAVKATEGPPVNPSGRKYPYELDSEGKAKSIPVWRFTNPHMGAFHLSWFAFFISFLATFAPASLLPIIRDDLFLTKAQLGNAGVAAVCGAIAARVLMGVFVDIVGPRYGTAATMLMTAPAVFCMALVTDFASFAAVRFFIGLSLCMFVCCQFWCGTMFNVQIVGTANAIAGGWGNMGGGACHFIMPLIYQGIKDGGVPGYQAWRWAFFVPAVFYIATALATLALGIDHPSGKDYRDLKKEGALKSKGAMWPVIKCGLGNYRSWILALTYGYSFGVELTVDNIIVEYMFDQFGLSLTVAGALGGMFGMMNLFSRASGGMISDLIAKPFGMRGRICALWIIQTLGGIFCVILGRVHNSLTSTIVIMIIFSIFCQQACGLHFGITPFVSRRAYGVVSGLVGAGGNTGAAITQAIWFAGTAPWQLTLTKYQGLEYMGYQTIGLTLALFFIWFPMWGSMLTGPREGATEEDYYIKEWSAEEVADGLHHTSLRFAMESRSQRGTRTSTQTKVMSVGDGAGSNKAEVVVVAAAQQGAVPMASVEEGSSGRSSSSGGHQQQDAHILHCIRTVVQKAPRVGERESERERD

SEQ ID NO: 70190 - protein, 536 aa, Physcomitrella patens subsp. patens
MESRPRQIETHHSLDERSLNDIISSGLSSPRPPRQLETVKSSECLEALLSPSIRSSAGTPREHHAFEPHPMIADAWEALRRSMVFFRSKPVGTIAALDPTEDSLNYNQVFVRDFVPSALAFLMNGEPEIVKNFLLKTLRLQSIEKRIDCFTLGEGVMPASFKVLHDPVRKTDTMIADFGESAIGRVAPVDSGFWWIILLRAYTKSTGDHTLADMPDCQRGMRLILTLCLADGFDTFPTLLCADGCCMVDRRMGIYGYPIEIQSLFFMALRSAKSLIKAEGDGKEFLERIDKRLHALSFHIREYFWLDHQQLNNIYRFKTEEYSHTAVNKFNVIPDSIPDWIFDFLPLKGGFFIGNVSPARMDFRWFAIGNFMAILSSLATSEQASAIMDLLEARWTELVGDMPLKVSYPAMEGHEWRIVTGCDPKNTRWSYHNAGSWPVILWMLTAACIKAGRPQIARRAIEQVETRLAKDGWPEYYDGKLGRYVGKQARKFQTWSIAGYLVAKMMLEDPSHLGMIGLEEDKKMKPSLTRSASWTA

SEQ ID NO: 70191 - protein, 182 aa, Pisum sativum
MSYYHHHHHHDYDYPTTENLYFQGAMDPEAELERTFIAIKPDGVQRGLISEIISRFERKGFKLVGIKVLIPTKQFAQQHYHDLKERPFFNGLCDFLSSGPVIAMVWEGEGVITYGRKLIGATDPQKSAPGTIRGDLAVVVGRNIIHGSDGPETAKDEIKLWFKPEELVSFTSNSEKWIYGDN

SEQ ID NO: 70192 - protein, 397 aa, Arabidopsis thaliana
FVLPLKEKKSSIIFSPTKPLAALNEEEAPSEQKKTLSLVPSPTTNLFLPDDILLSSLSRISRLYYPTFSLVSKSFRSLIASPELYQTRSILGRTESCLYVSLRLLNDSNLRWYTLCRVPDRKLTNFSGGHLLVPILSRYAPPAHWSSVVAVDYNIYAIGGPINDAPSSSVSVLDCQCEKWREAPSMRVARNYPTATVLDGKIYVAGGCEDCTSLDCIEVFDPKTQTWDSVASPGTERCERLVYKSVGIEGKYHLFGGAGHVAYDPKEGRWDSVGMDMEMGRTWVSYCVINNILFYYNDREFKWYDYKGRFWRKLMGLERLIKFLCYSRVNLAAYGEKMAVLWDTFVPSSSKNKMIWCAEITIERHDIYEICGKTEWFDVVLRVPKSYELVHVLAATV

SEQ ID NO: 70193 - protein, 304 aa, Candida parapsilosis
MSLAGKEFKLSNGNKIPAVAFGTGTKYFKRGHNDLDKQLIGTLELALRSGFRHIDGAEIYGTNKEIGIALKNVGLNRKDVFITDKYNSGNHTYDGKHSKHQNPYNALKADLEDLGLEYVDLYLIHFPYISEKSHGFDLVEAWRYLERAKNEGLARNIGVSNFTIENLKSILDANTDSIPVVNQIEFSAYLQDQTPGIVEYSQQQGILIEAYGPLGPITQGRPGPLDKVLSKLSEKYKRNEGQILLRWVLQRGILPITTTSKEERINDVLEIFDFELDKEDEDQITKVGKEKTLRQFSKEYSKYD

SEQ ID NO: 70194 - protein, 382 aa, Thermoplasma volcanium GSS1
MSIRIGLIGEPNVGKSTFFSAATENEAEINNFPFTTIKPNLGMTYFVVKCPEVEISGKCNPREGYCENGNRHIPVQIIDVPGLIEGASEGKGMGNEFLDNIRDVDSILLLFDASAGDIATVRKSIEMVKSELLKWISQRIYSDWDHFSRKSEASGERRDIALKRKLSLFGISEHQISEMMEKDFFPAKLSIWTREDADKLALSIIKYAKPLLLVGNKSDLVSPNTLSEMKNALGDSYFVSAEYELALKRARKSGLVSTTLNDFAILGGNEKQKEVLAKIRDWFNTPGIIRIHDLLQKVVRDYLHYIIVYPVYDESKWTDKSGNVLPDAFVMPYGSTSLDLAYKIHTDIGEGFIRAVNARTRMVLGKDYILKDGDVIKIISKK

SEQ ID NO: 70195 - protein, 307 aa, Candida parapsilosis
MTQSNLLPKTFRTKSGKEISIALGTGTKWKQAQTINDVSTELVDNILLGLKLGFRHIDTAEAYNTQKEVGEALKRTDVPREDIWVTTKYSPGWGSIKAYSKSPSDSIDKALAQLGVDYVDLFLIHSPFFTTEQTHGYTLEQAWEALVEAKKAGKVREIGISNAAIPHLEKLFAASPSPEYYPVVNQIEFHPFLQNQSKNIVRFCQEHGILVEAFSPLAPLARVETNALAETLKRLAEKYKKTEAQVLLRYTLQRGILPVTTSSKESRLKESLNLFDFELTDEEVNEINKIGDANPYRAFFHEQFKDL

SEQ ID NO: 70196 - protein, 404 aa, Escherichia coli
GKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIE

SEQ ID NO: 70197 - protein, 261 aa, Physcomitrella patens
MVEKVVVSSLRRKRGGNLLAPLKRNVSSIAKKSSTPKSGKPVGSPKVYKGVRMRTWGKWVSEIREPNKRSRIWLGSFPTAEMAAKAYDAAAVCLRGRSVKLNFPDSPPRCAARCNSPREVQAAATAAAVACIPSATALTVANFQSPAQTLESSPLHSSPSSSDMSSGDEDSGEDSVQSFVAEGSQISPSEVVPVLEWVKVEFGDKETVAAGDVDFDCDYSFISEFAADSLLACSYNSKGRTEYLPIETHDAALYDSTLWFF

SEQ ID NO: 70198 - protein, 626 aa, Physcomitrella patens subsp. patens
MGTGVADPISILGLLLGLCAAVPAWSKFLVETSSLTITLPESLKGSYDSAIGNFGVPQYGGTMAGTVVYPTKQADGCTPFSESFRGPNTGGRPVFALLDRGGCYFALKTWNAQNAGAAAVLVADDKVETLITMDTPDEGKYSDLIQNITIPSALIDKTLGDSLKKVLASNEMVNINLDWRESLPHPDERVEYEFWTNSNDICGPKCDAQAEFKRDFKGVAQLLEKGGYTSFIPHYITWYCPQAFIESKQCKSQCINKGRYCAPDPEQDFNKGYQGKDVVLENLRQLCVFKVATQAKRPWVWWDYVTDFQIRCPMKNNLYNQDCAEKVITSLSLSTSDVRSCMMDPELDADNPLLKKEQDAQVGTGTRGDVTILPTLIINNRQYRGKLDRAAVMKAICSGFQETTDPPVCLSGGVETNECLEHNGGCWENKKANITACKDTYRGRVCQCPLVDGVQFEGDGYTTCEAMGLGRCKVDNAGCWQEKRGDITFSACHESQSKGCQCPRGFRGDGIKECIDIDECKEKSKCQCPECMCTNKWGDYDCGCSKDLLYIREHDTCISKKSQSSKLGWAVSLIVFLGVASLGVVGYVVYKYRLRSYMDSEIRAIMAQYMPLDSSSEVNHHLTEEA

SEQ ID NO: 70199 - protein, 404 aa, Escherichia coli
GKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGEAIIE

SEQ ID NO: 70200 - protein, 200 aa, Triticum aestivum
TSLYKKAGWYRSGIPGISSTHASAVGANISGGHVNPAVTFGAFVGGNITLFRGLLYWIAQLLGSTAACFLLRFSTGGLPTGTFGLSGIGAWEAVVLEIVMTFGLVYTVYATAVDPKKGSLGTIAPIAIGFIVGANILVGGAFSGASMNPAVSFGPALVSWEWGYQWVYWVGPLIGGGLAGVIYELLFISRTHEQLPTTDY

SEQ ID NO: 70201 - protein, 484 aa, Yersinia pestis CO92
MNCAVWPRRGNCDAPRLSRWLTSLDKFEERISQTTTIRRYGRLTRATGLVLEATGLQLPLGATCLIERHNGGEVQEVESEVVGFNGQHLFLMPLEDVEGIVPGARVYARVTTSGTSASKQSISSKQSIPSKQSFASKQLPLGPELLGRVLDGSAKPLDGLPAPETGYRAPLITPPINPLQRTAIVQVLDVGVRTINALLTVGRGQRMGLFAGSGVGKSVLLGMMARYTQADVIVVGLIGERGREVKDFIENILGAEGRARSVVIAAPADVSPLLRMQGAAYATRIAEDFRDRGQHVLLIMDSLTRYAMAQREIALAIGEPPATKGYPPSVFAKLPALVERAGNGVSGGGSITAFYTVLTEGDDQQDPIADSARAILDGHVVLSRRLAESGHYPAIDIEASISRAMTSLIDDDHYSRVRQFKQLLASYQRNRDLISVGAYAAGSDPLLDKAIALYPQMEAFLQQGMFERSSFDDACQHLKVLFPG

SEQ ID NO: 70202 - protein, 432 aa, Thermoplasma volcanium GSS1
MAGIFPFGEYLDVSLLLVLSAVAIPIARKMSVVEIPILIFIGLIVGPFLRLISPAFSVYLFSSFAGVGIGMIGLVIILYSESHNMNIKVLKSSFYRIASLDTIGVIITALVAAGLFSLFTGAPLIIGFLFGAIISPTDPVTLIPLFRRMKISEDISEVLIGESLFNDPVGIILVSVGIAILAPHSVYVSLFSSIANSISFYPGIVAYFLIQVAVPSVVGVAIGFAIIYLNKEINFENYLTAILLGVVIFEFTIFEGISITPFPAIIATGAIVGNFSDKGIFWQREKNFQENLSYLSTSIIFLLIGSSFTINEIEQYILLGIMLTTILIFVVRPAAVFPSILIADLGKIKMKGYYKIVAFISLVGPRGVVPVVLSTLPYVVGLSYNIPILITWGPVIGVSALFIVLFSIVFQTIYTPIMKNIFIPDQGNGNSK

SEQ ID NO: 70203 - protein, 258 aa, Burkholderia mallei ATCC 23344
MRLQEKVAILTGAASGIGEAVARRYLEEGARCVLVDLKPADGALARLIDAHAGRAIAVSADVTRRDDIARIVATAVERFGGVDILFNNAALFDMSPLLDESWDVFDRLFAVNVKGLFFLMQAVAQRMVEQGRGGKIVNMSSQAGRRGEALVSHYCATKAAVLSYTQSAALALARHGINVNGIAPGVVDTPMWEQVDALFARYENRPLGEKKRLVGEAVPLGRMGVPDDLTGAALFLASADADYITAQTLNVDGGNWMS

SEQ ID NO: 70204 - protein, 553 aa, Physcomitrella patens subsp. patens
MFEPKLESDPIKLWNRYVDWLYQDKVLGLYLDVSRIGFTDEFYEAMLPKFEKAFKDMAELEGGSIANPDEGRMVGHYWLRKPELAPTPFLQKLITDTLDRVQSFADDVISGKIKPPPTPQNRFTQVLSVGIGGSALGPQFVAEALAPDNPPLKIRFIDNTDPAGIDHQIAQLGPELSSTLVLVISKSGGTPETRNGLLEVQKAFRDAGLDFSKQGVAITQENSLLDNTAKIEGWLARFPMFDWVGGRTSEMSAVGLLPAALQGIDIHGMLEGSAAMDESTRNPSVKQNPAALLALCWYWATGGMGSKDMVVLPYKDSLLLFSRYLQQLVMESIGKEFDLDGNKVNQGISVYGNKGSTDQHAYIQQLREGVPNFFATFIEVLRDRPPGHDWELEPGVTCGDYLFGMLQGTRSALYANKRQSITLTVEEVDPKTVGAMVALYERAVGFYASLVNINAYHQPGVEAGKKAAAEVLALQKRVLAVLNDASCRDPVEALTVEEVAKRCQVPQQVEMVYKIISHMAANDRAVFAEGDCGTPRSATVYSGECGVDDLYDD

SEQ ID NO: 70205 - protein, 448 aa, Clostridium perfringens SM101
MEVKKYVDNLMEDLKKNNPGESEFLAAAEEVLYSLVPVLEKNPKYIEEGILERIVEPERVIMFRVPWVDDAGNVRVNRGYRVQFNSAIGPYKGGLRFHPSVNLSIIKFLGFEQIFKNSLTTLPIGGGKGGSNFDPKGKSDREIMRFCQSFMSELYRHIGPNTDVPAGDIGVGGREIGYMFGQYKKLKNSVDAGVLTGKGLTYGGSLARKEATGYGLVYFVDEMLRDNGQTIEGKTVVISGSGNVAIYATEKVQELGGKVVALSDSLGYVYDENGIDLEIVKEIKEVKRGRISEYVNYVKTAKFTEGFSGIWNVKCDIALPCATQNEIDKSSAKTLIDNGVIAVGEGANMPSTLEAQKLFVDNKILFAPAKAANAGGVATSALEMSQNSLRMSWTFEEVDAKLKDIMKNIYYNSKNAASEYGHNGNLIVGANIAGFKKVADAMLDHGII

SEQ ID NO: 70206 - protein, 231 aa, Arabidopsis thaliana
MATSSTQLLLSSSSLFHSQITKKPFLLPATKIGVWRPKKSLSLSCRPSASVSAASSAVDVNESVTSEKPTKTLPFRIGHGFDLHRLEPGYPLIIGGIDIPHDRGCEAHSDGDVLLHCVVDAILGALGLPDIGQIFPDSDPKWKGAASSVFIKEAVRLMDEAGYEIGNLDATLILQRPKISPHKETIRSNLSKLLGADPSVVNLKAKTHEKVDSLGENRSIAAHTVILLMKK

SEQ ID NO: 70207 - protein, 643 aa, Clostridium perfringens SM101
MIILSCRHLTKSFGIDEILRDVTFNINEGDKVGLIGPNGEGKSTLFKILTKQLDYDSGELFLDKNKTLGYLSQNLSLDSENTIYDEMLSVFSSLTELEDKIKTLEEKLNEPYDASKEEYHNKLIKDYTLSQELYENRGGYTFRGEISRVLKGLGFLEEDFNNQIINLSGGQKTRLALCKLLLRKPDLLLLDEPTNHLDLEAIEWLEEYLNGYKGTVFVISHDRFFLDSVTNTTFELIGGKIHCYNASYTKFLELRKKDIEARLKAYNLQQAEIKRQEEIIEKFRSFNREKSVRAAESRQKALDKMDRLEAPEVIKEASKISFETLVKSGNDVLHIENLKKSYDSLLFENVNLDLKRGEKVALIGENGRGKTTLFKIIMGMLKQDSGSVSLGKNVFTGYYDQEQSNLNLHKTIIDEVWDDFPNLTTTEIRNYLASFLFTGDDVFKEISLLSGGEKCKINLLKLMLSKANLLLLDEPTNHLDIMSREALEDAILSYDGTLIVISHDRYFLNKVINKIVELQENGLKTYLGNYNYYMDKKANPNRYEDIDEEINQGKTKTQIKEERKKKKSAEKSARALRAQLRDVEKLIPQKEEELEKLQGMLCAEEVYSNPEESVRVNKEINSVQEEIDSLYATWEELSESLEE

SEQ ID NO: 70208 - protein, 584 aa, Magnaporthe grisea 70-15
MSVGKKHTLSDGDRESEPVTKKAKVDSAADESEEPLKEKKKDKKDKEARKAKKEKKEKKRKEKEAKAQSEEEAADPEPESTTNTEVPSTTETPQPEQETASKPKKEKKEKKDKKDKKEKKEKKEKKSKDADESTQTDTPQENGASDSKYKQVDALSALPESEFKDWMTEQQVVISEPNSLTTHRPILKFTQLPSSPLLAKKPFAGFTAPTPIQSASWPYSLDGRDVVGIAETGSGKTLAFSTHAAISKLAELVGMSAVCLFGGAPKDEQRTLLRKGKGADIIVATPGRLKDFLSDDTVSLSAARFVVLDEADRMLDKGFEDDVKLILGLCPDRGQRQTLMFTATWPASVRGLAESFMVNPVKVTIGGRTRAVDGDDDGNGVVELQANSRISQRVEVVNPWEKETRLVQLLKEAQAGKNKNDRVLVFCLYKKEAVRVENNLQRKGIRVASIHGDLKQEQRTASLEAFKSGKTTVLVATDVAARGLDIPEVKLVINVTFPLTIEDYVHRIGRTGRAGKQGQAITLFTEHDKAHSGSLVNVLKGANQPVPDDLLKFGTTVKKKAHDTYGAFFKDVDMSKKGTKITFD

SEQ ID NO: 70209 - protein, 860 aa, Arabidopsis thaliana
MEAKPLASSSSEPNMISPSSNIKPKLKDEDYMELVCENGQILAKIRRPKNNGSFQKQRRQSLLDLYETEYSEGFKKNIKILGDTQVVPVSQSKPQQDKETNEQMNNNKKKLKSSKIEFERNVSKSNKCVESSTLIDVSAKGPKNVEVTTAPPDEQSAAVGRSTELYFASSSKFSRGTSRDLSCCSLKRKYGDIEEEESTYLSNNSDDESDDAKTQVHARTRKPVTKRKRSTEVHKLYERKRRDEFNKKMRALQDLLPNCYKDDKASLLDEAIKYMRTLQLQVQMMSMGNGLIRPPTMLPMGHYSPMGLGMHMGAAATPTSIPQFLPMNVQATGFPGMNNAPPQMLSFLNHPSGLIPNTPIFSPLENCSQPFVVPSCVSQTQATSFTQFPKSASASNLEDAMQYRGSNGETFLYWNGTEPRICISDPELAKTMLSNKLGFFVKSKARPEAVKLVGSKGLVFIEGADWVRHRRILNPAFSIDRLKIMTTVMVDCTLKMLEEWRKESTKEETEHPKIKKEMNEEFQRLTADIIATSAFGSSYVEGIEVFRSQMELKRCYTTSLNQVSIPGTQYLPTPSNIRVWKLERKMDNSIKRIISSRLQSKSDYGDDLLGILLKAYNTEGKERKMSIEEIIHECRTFFFGGHETTSNLLAWTTMLLSLHQDWQEKLREEIFKECGKEKTPDSETFSKLKLVMFIFFKGSLVRQCFLRLKKPVYFLQMNMVIMESLRLYGPVSALAREASVNIKLGDLEIPKGTTVVIPLLKMHSDKTLWGSDADKFNPMRFANGVSRAANHPNALLAFSVGPRACIGQNFVMIEAKTVLTMILQRFRFISLCDEYKHTPVDNVTIQPQYGLPVMLQPLED

SEQ ID NO: 70210 - protein, 428 aa, Burkholderia sp. 383
MSSQLQSIPSYLHADDLGPWGNYLQQVDRVAPYLGSLSRWLETLKRPKRILIVDCPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQVMAWMMDTYSMNQGQTSTGVVTGKPIALGGSLGRKEATGRGVFVVGSEAAKKKGLEIEGARIAVQGFGNVGGIAAKLFQEAGAKVIAVQDHTGTIYQPAGLDSNKLLDHVARTGGVAGFEGAEPMPNDEFWTVETDILIPAALENQITEKNAGKIRTKIIVEGANGPTTTAADDILTANGVLVIPDVIANAGGVTVSYFEWVQDFSSFFWTEDEINHRLERVMREAFSGVWAVAEEHKVSVRTAAFIVACKRILMAREMRGLYP

SEQ ID NO: 70211 - protein, 311 aa, Robiginitalea biformata HTCC2501
MGELLIDFVGENQGSDLSRAVMFTKKAGGAPANVASAIARLGGRSAFVGCIGEDPFGEFLLDVLRENRVDTQFLQRSETFTTLAFVSIAEDGERDFVFSRGADRELQYMPEVKKSFRGNMIHLGAATALLGGPLEKAYGHYFFDGLTQRAFISFDPNYRHDLWKNKAAVFRKKCIPFIEKSNLCKFSLEEAQLLSGEESLEKACSVLHDIGTEIIVITLGGDGTWLSTRAGQRTIPSIRVEPVDTTGAGDAFIGCLLWQLAAREDLEHIASDVEALAEMVRIANAAGAVTTTRFGAIEALPDQEQLNRALA

SEQ ID NO: 70212 - protein, 527 aa, Glycine max
MPSSHLLLEEPIRMVSILEPSKPSFFSAMTKIVGTLGPKSRSVETISGCLKAGMSVARFDFSWHDPEYHQETLENLKAAIKSTKKLCAVMLDTVGAEMQVVNKSEKAISLEANGQVVLTPDQGQEASSEILPINFDGLAKAVKKGDTIFIGQYLFTGSETTSVWLEVSEVKGQDVVCIIKNTATLAGSLFTLHASQIHIDLPTLTEKDQEVISSWGVKNKIDFLSLSYTRHAEDVRQAREFLSKLGDLSQTQIFAKIENVEGLTHFDEILQEADGIILSRGNLGIDLPPEKVFLFQKSALYKCNMAGKPAVLTRVVDSMTDNLRPTRAEATDVANAVLDGSDAILLGAETLRGLYPIETISTVGRICSEAEKVFNQDLYFKRTVKYVGEPMTHLESIASSAVRAAIKVKASIIICFTSSGRAARLIAKYRPTMPVLSVVIPRLKTNQLKWSFSGAFEARQSLIVRGLFPMLADPRHPAESTSATNESILKFALDHGKALGVIKSHDRVVVCQKLGDASVVKIIELED

SEQ ID NO: 70213 - protein, 342 aa, Bacteroides thetaiotaomicron VPI-5482
MKHIIIAVILTISNVFLGIAKPMKSQAEIYFAGGCFWGTEHFLKQIRGVESTQVGYANSTVANPSYEQVCSGKTNAAETVKVVYDPEEVNLSLLLNLYFQTIDPTSLNRQGNDRGTQYRTGIYYINKADLSTINQAIQALATQYNKPIAVEVEPLTNFYPAEVYHQDYLDKNPGGYCHINLALFEMARKANAPKPPTFQKPDDATLRKKLSAEQYAVTQKNATEPAFHNEFWNEHRPGIYVDITTGEPLFVSTDKFDSGCGWPSFSKPIQKELIAEKKDTTHGMIRTEVRSKTGDAHLGHVFTDGPKDKGGLRYCINSASLRFIPKEKMKEEGYGEYLPLIK

SEQ ID NO: 70214 - protein, 404 aa, Escherichia coli
GKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIK

SEQ ID NO: 70215 - protein, 541 aa, Thermoplasma volcanium GSS1
MKTKIVATVGPASEDPSILKQMVKNGLSLIRINSAHAEISYVAKIVKEMRDINPDVGVMVDLKGPELRTGTFPGGSLRISKGNKYTIGKEITLNNEKAIGNIQTGDKVLMSDGEVEFTVDSTSPIVLIAENDGVLRDRSRVNVPGRYVEIGSITERDKSFVIEGIKQGVDFFALSFVQNAENVNSLRDFIIENGGNQYIIAKIETKSGLDNIESIVQASDGIMVARGDLGVELPLKEVVMAQKKIIKISHEDGDFTIVATQVLESMVNNAFPTRAEISDITNAIIDNADALMLSEESAIGKYPALAVQTLRDVSDYVENLVDFQSSYTFKGNKIAYSVAKAAKVLSDDINSNGIVALTHTGSTVKMISSLRPKALVYAGTVDDSLSRKLNIYFGVVPLHLKRDSESLSFADLTEYILKSAFFKSGDKIVVTSGDPYFTFGGTNDVRVMAIGEFLGRGYPQGKDAFGTATYGKNGNILISNSKDVPDGNFDAYIFTADVKPSEVKKINGKTAVFKTRLARTINEGERIYIDGNTGIILKYEK

SEQ ID NO: 70216 - protein, 493 aa, Thermoplasma volcanium GSS1
MDGKLYIDGQWVDSSNGDTLTKYNPVTGEVIGKFAAASRDDVDRAFDAAEDAFQKWMDLGSVERSKIIYKAKELIEENRKELENIIIQENGKPVKEAAEEVDGVLDQMQYYAEWARKLNGEVVEGTTNHRKIFQYKVPYGTVVALTPWNFPAGMVARKLAPALLTGNTVILKPSSDTPGSAEWIVKKFIQAGVPKGALNYITGRGSVIGDYIVEHKKVALITMTGSTSTGQRIMQKASANMAKLMLELGGKAPFMVWKDADINNALKTLLWAKYWNAGQSCIAAERLYVHEDIYDTFINKFVELSKKIVVGDPSRADMGPLINTTALKGTEEVVEEAKESGARILYGGSKPDLSGPYKNGYFFLPTIIDNVDQKSKIFQEEIFAPVIGARKVSDVEEMYSLANDSKYGLASYLFTKDPNLIFEAAERIRFGELYINMPGPEASQGYHTGFRLTGQAGEGSRYGILEYLKIKNIYVDYSGKPLQINTVRDDLFQ

SEQ ID NO: 70217 - protein, 508 aa, Pseudomonas fluorescens Pf-5
MQRPNPNRLRHPDLQPQRAAPATLHCQNSTTIKSRGFVMTPDTLGAPARPVLQRTLHNRHIQLMAMGGAIGTGLFMGSGKIIAMSGTSIILIYMIIGLFVYLVMRAMGELLLSNLQFKSFADFAGAYLGPRAAFFLGWSYWLSWSVAVVGDAVVVGGFFQYWFPGVPAWMPAVSMMLTLFALNVLTVRLFGEVEFWFAIIKIIAVVTLIGVSLVLIASSFVSPSGVTASLGHLLDRQAAFPHGLLGFFAGFQMAIFSFAGTELIGTAAAETRDPHSTLPKAINAIPLRIILFYVLALACIIAVTSWQQVSPNKSPFVELFLIAGFPAAAGIVNFVVLTSAASSANSGVFSASRMLFGLADQGNAPRLFKRLSGQSVPVISLSFTTLLMLLGVLLLYVVPEVMTAFTLVSTVSAILVIFTWSTILASYIAYRKKHPQLHARSHYKMPGGVPMAWFALAFLLFVLCLLALRPDTRLALCVMPAWFVWLGIAYRLTAGRKGRVHGRAVYPR

SEQ ID NO: 70218 - protein, 414 aa, Desulfovibrio desulfuricans G20
MHDHIRTFFMLYPSVLARRRLHMNVLKMTDLDLRGKRVLIREDLNAPIKDGAVANDNRLRAAAPTIRLAMQAGARVMVMSHLGRPAEGAFDESASMAPVAARLADILGCPVPVVRDWLDGVDVPEGGVVLTENVRFNKGEKKNDEELGRRMAALCDVYVMDAFGTAHRAQASTHAVAAFAPVACAGPLLAAELEALGKALGAPRHPVVGIIGGSKVSTKLTLLETLSSKVDKLIVGGGIANTFIRAAGFAVGKSLYEEDLVAEAARLMQAAAAAGGEIPVPVDVVVATEFAETATPVCKPVDQVADNEMIMDIGPQTAAMYAEVLRGAGTIVWNGPVGVFEFDAFGAGTEALCRAVAQSSAFSIAGGGDTVAAVDKYGVRDGVSYISTGGGAFLEFLEGKELPAVAMLEQRAKA

SEQ ID NO: 70219 - protein, 217 aa, Desulfovibrio desulfuricans G20
MILSPSLLSSDYGRLADELAALEDAGLSWVHWDVMDGMFVPNITLGAPIIKKLRKASGLFFDVHLMVQAPERYIADFADAGADMLVVHAEATNHLERTLSEIRRMGVQCGVALNPHTPLCVLEYVLDQLDMVLIMSVNPGFGGQKFIPFTMRKIEELSAMITARGLKTLIQVDGGVDPENTPELVRRGADVLVSGSAFFGHPPYRQRHDAFQAAAAR

SEQ ID NO: 70220 - protein, 514 aa, Rickettsia akari str. Hartford
MTQSNIISLELLDERKNIARQGGGEARINAQHQKGKLTARERIEVLLDPNSFTETGMFVAHRCDNFGMQDKKFLGDGVVTGHGTINGRLVFIYSQDFTVLGGSLGEYHAKKICDIIDQAIATGAPVIGINDSGGARIQEGVDALAGYGELFQRNVLASGVIPQITLIMGPCAGGAVYSPALTDFIFMVKNSSYMFVTGPDVVKTVTGEAVSQEKLGGARMHTTKSGVADLAFNNDIEALLEIRKFFNFLPSSNRSPLPVRSTIDPADRVDMSLSTLIPNTPNKPYDMKELVERIVDEGEFFELQSDFAKNIIIGFGYMEGYTVGFVANQPLHLAGCLDINASRKAARFIRFCDAFNIPIVSLVDVPGFLPGTSQEHDGIIKHGAKLLYAYAEATVPKITVITRKAYGGAYIVMNSKHLRGDINYAWFNSEIAVMGAEGAAEIIFKEECKDPEAKKQKIDEYRKVVTSPFVAASRGYLDDIIRPQNTRWRICKALNFLRTKKVELPWKKHDNLPL

SEQ ID NO: 70221 - protein, 252 aa, Pseudomonas fluorescens Pf-5
MRLAHKTAIVTGAGSGFGEGIAKTFAQQGARVVIADMNATGGQRVAQEIRDAGGQAHFIEVNVAQDASVAALLRNTLEQYGGLDIVVNNAGTTHRNRPMLEVDEAEFDRVFAVNVKSIFLSAKHFVPHFRGQGGGVFINIASTAAIRPRPGLVWYNGSKGAVVVMSKTMAAELGPDNIRVNCVNPVVGATALLSEFMGVPDTPENRQKFMATIPLGRFSTPQDVANACLYLASDEAAFITGTCLEVDGGRCV

SEQ ID NO: 70222 - protein, 482 aa, Pseudomonas fluorescens Pf-5
MTLEHYIDNQWQASSWAEDIPVQDPSTGISYARIARGTAEDIDLAVQDAQRALGDNFDGPWGSLSALERGRLLARLGQAVLEHHEELAQIEARDTGKALKVARADATALARYFEYYAGAADKLHGETLPYQAGYTVLTVREPHGVTGHIIPWNYPMQIFGRSVGAALAAGNACVVKPAEDASLSLLRLAELAAQVGFPAGSLNVVSGYGHEAGAALCAHPGVAHISFTGSTGTGALVAKAAAERHCPVTLELGGKSPQIVFADADVERALPVLINAIVQNCGQTCSAGSRLLVQRSLYEPLLERLAQCFGQLRAGPSELDLDMGPLINQKQLRQVREFVREAEAAGIRVAARGQVVAEAGSGGYFHEAVLFRDVPPDSRLAREEVFGPVLAVMPFEDEAEAIGLANDSAFGLVAGVWTRDGARQLRMAHKLRCGQVFINNYGAGGGVELPFGGVKASGYGREKGFEALLGFTALKTIAIRHD

SEQ ID NO: 70223 - protein, 565 aa, Zea mays
  misc_feature (486)..(486): Xaa can be any naturally occurring amino acid
MASTAPAASTAVAFGAAATPRGPASASAALCARVPAAAGGMRRSGVAVRCDAGADAQVRAVAKAASVAALEQFKISADRQKISVVWGRKEKGVVVFDNVLTLYPRPGYMKERSSIAVIGLSVHTAPVEMREKLAVAEELWPRAIQELTSLNHIEEAAVLSTCNRMEIYVVALSWNRGIREVVDWMSKKSGIPASELREHLFMLRDSDATRHLFEVSAGLDSLVLGEGQILAQVKQVVRSGQNSGGLGKNIDRMFKDAITAGKRVRSETNISSGAVSVSSAAVELALMKLRKSEALSARMLLIGAGKMGKLVIKHLIAKGCKKVVVVNRSAQRVDAIREEIKAIEIVYRPLSEMYEAAAEADVVFTSTASETPLFTKEHADALPTVSDAMGGVRLFVDISVPRNVSACVSEIGSARVYNVDDLKEVVEANKEDRLRKAMEAQTIITEELKRFEAWRDSLETVPTIKKLRSYADRIRASELEKCLQKXIGDDVLTKKMRRAIEELSTGIVNKLLHGPLQHLRCDGSNSRTLDETLENMHALNRMFSLDTEKAIIEQKIKAKVEKTQN

SEQ ID NO: 70224 - protein, 330 aa, Yersinia pestis CO92
MTLQQKLTQFPRLDLVGNATPLEKLSRLSDYLGREIYIKRDDVTPVALGGNKLRKLEFLAADALRQGADTLVTAGAIQSNHVRQTAAVAAKLGLHCVALLENPIGTEQANYLTNGNRLLLDLFNVDVVMCEALNDPNQQLAELATRVEAQGFRPYVVPIGGSNALGALGYVQCSLEIAAQAAGNVAFSSVVVASGSAGTHAGLAVGLQQLLPDAELIGVTVSRSADEQRPKVAQIQQALATSLGMTDPLAKITLWDSYFAPQYGMPNEEGIAAIKLLARLEGILLDPVYTGKAMAGLLDGIEQQKFCDKGPILFIHTGGAPALFAYHPQV

SEQ ID NO: 70225 - protein, 464 aa, Physcomitrella patens subsp. patens
MHFLGANPHISLWKLADKYGPLMSLRLGNKPYVVATSPETAKEFLKTLDANFGSRHYSSQSQYLLYGGQDVAFQESSPSWRNLKKIFTMELASPARLEASRHIREEEMIVLLRTIHSKGELELKSQLIDMISHVISRMVINKRFDDSVESDFPTLVQTHFRLAGAFVPGDYIPAVKWLDLGGFEAQMKKQKERMDAFIDDILVQHRERRAKGPVPMKEYDMVHVLLDRIETKDDQIQLTETHVKALVLDAFLGASETIILTSEWAMAELLRHPSLMAKAQAELDAVVGRDRMVTESDLRHLTYLNTIIKETFRLHPAAALLLPRESAQPSQAFGYNFPAKTRVLINCYAIHRDPAIWHDPLVFNPDRFLQADLKDVDVKGRHFQLLPFGAGRRVCPGLSMGILTVQFILASLLHSFDWSLPGDMKPEDVDMTEIYGLTLPRAAPLPCAAKLRLPSHLLTTAQKP

SEQ ID NO: 70226 - protein, 235 aa, Zea mays
  misc_feature (50)..(50): Xaa can be any naturally occurring amino acid
  misc_feature (87)..(87): Xaa can be any naturally occurring amino acid
  misc_feature (113)..(113): Xaa can be any naturally occurring amino acid
  misc_feature (126)..(126): Xaa can be any naturally occurring amino acid
  misc_feature (135)..(135): Xaa can be any naturally occurring amino acid
DAVAINKWRFMEPKEHMQGDFVAKNEAYERYTQNVGLLEETLSPMEDADXKPEAEAIFLQRKEGWTCLFRGAKVRLKLDNEIAGAFXILEQKLKKLLESQSADEDDKPSDPNXDDHLNPMKFSTKXRWREKLKLXELLGKLARTRIEDDLKPCREFVILLSSCLERRRVDRSTGMEMKPSDQESAAAAVARLYSILELCTRMEVDEDFAAKIDDEFLVVESGGTAMNLECGPIVM

SEQ ID NO: 70227 - protein, 437 aa, Corynebacterium efficiens YS-314
MTTKKRNTSETTDTAPKAVGADQAARPVRRTTRRIFDQSEKMKDVLYEIRGPVAAEAERMELDGHNILKLNTGNPAVFGFDAPDVIMRDMIAALPTSQGYSTSKGIIPARRAVVTRYEVIPDFPNFDVDDVFLGNGVSELITMTMQALLNDGDEVLIPAPDYPLWTAATSLSGGKPVHYLCDEDNEWNPSIEDIRSKITEKTKAIVVINPNNPTGAVYSRKVLQEIADIAREYDLLVLADEIYDRILYDDAQHINMATLCPDLMCITYNGLSKAYRVAGYRAGWMIITGPKRYAKGFIDGLELLAGTRLCPNVPAQHGIQVALGGRQSIYGLTGEGGRLLNQRNVAWQKLNEIPGVSCYKPMGALYAFPRLDPNVYEIHDDTQLMLDILRSEKILLVQGTGFNWPHHDHFRVVTLPWASQLENAIERLGNFLVSYKQ

SEQ ID NO: 70228 - protein, 561 aa, Exiguobacterium sibiricum 255-15
MAYQALYRVYRPQRFDEVVGQAHITRTIQNALMEERMSHAYLFSGPRGTGKTSLAKIIAKAINCEQAPVNEPCNECPTCRAITEGSSPDVFEIDAASNNGVDEIREIRDKVKYPPSEAAYKVYIIDEVHMLSTGAFNALLKTLEEPPAHAIFILATTEPHKIPATIISRCQRFDVKRHEVDQLMERMQYILSDQTIGYTETALRLIARAADGGMRDALSLLDQAVAFSNGDLTDDAVLEVTGAVEDEALLAVANALQAHQVDQLLQTLEKMQRAGKDLKRFVEDLVFFYRDTLLLKTSPTAVDLLERARPTEAFKTFVETIETEACFHIIEQLHDCQQQMRLTNHPRVLVEIAFIQIAEQGRTTGQIMQSLQQEVRELKEQMHQLKVTGVPAAEGTPAQQPAKRKQARPTVRIAKERIRQMLSRAEKAQLLEIQERWDAILKLILKQDGPIYSLVHESKPVLCSEDTLLIEFDNGKGWHFEQVMTNERTRFVIEEALFEVCGVKRQILAILDNDWKELKAEFVAKRNSSNIEEKEVAVESEEDRLLSETLGRFGDIVEFED

SEQ ID NO: 70229 - protein, 792 aa, Chlamydomonas reinhardtii
MSLNSSTMSRRQAVAGAPAVAPFRHAGLFPRVRLCANRRVARVAPKAAGNGNIAQGEQGFDTLFLSDISLVGQRTPLLLGFFNYFERHLPHVGFFEPIAAEALASSELRIDRHVELVYKVFNLKGDVRAMTGVQDAEAARMIANGQHSELLDKIYSQYASYKEGQDLVLVEGPGPLMGGTELDAQIAAALNAPVLMTMTGQPNATVADYYNRAMVKRQVFLDHHVEVLGLVMNGLPRQSHAILSGQLRDKFAAAGLPFAGAIPTDIMLRNVRLDEVQTAMGAQRLYGDSLLTDVEFDDVVVASQRLEELLEILAERPMGRPLVVTSADRLDIVLGLLAAQLSVSGPGVAGILLTQAGSARSGRNYARDTIDRIFAGLSSSGLYKGSLLPVLVTDMPLRDAIRKLDNLDAAILPSSTRKISQCKRLFEQYVDANAVVARLQNMVRPNRMTPKMFMHTLKSMCNATPQHIVLPESEDKRVLAAAADVVQRGLAKITLLGDPTTILAEAAKLGLDLSGCNIHNPNTSDRFDKYVDMLVEARKKKGMTREVAADTLHGDVNFFATMMIVAGDADGMVSGAVHTTASTVRPALQVLKSPDTPLVSSVFIMCLPDRVVVYGDCAVNVNPSAADLAQIAITSNDTAAAFGIEPRVAMLSYSTLGSGSGPDVQKVSEAVAIVKQRRPDIKVEGPIQYDAAIDPKVAAVKVQGLSEVAGKATVFIFPDLNTGNNTYKAVQQSTGAIAMGPVMQGLLRPVNDLSRGCTVPDIINTICVTSIQASRMSSAARAAAAKAAVAAV

SEQ ID NO: 70230 - protein, 445 aa, Corynebacterium efficiens YS-314
MKGSAHMRMTVIGTGYLGATHAACMAELGHEVIGVDVDEAKIASLRDGEVPFFEPGLPEVLECNLDNGRLSFSTSYGDAAAFAHVHFLAVGTPQKRGSFAADLSYVRQVITSLVPLLEGEHIIFGKSTVPVGTAAELQELADSLSHPGTSVEIAWNPEFLREGYAVKDTITPDRIVVGIREGSTADEVAREVYATAIEGGTPFLVTDLATSELVKVSANAFLATKISFINAVAEICEATGADVVQLADAIGHDDRIGRKFLGAGLGFGGGCLPKDIRAFMARAGELGTDQALTFLREVDSINMRRRDRMVQLAREVCGGSLLGKRVTVLGAAFKPNSDDVRDSPALSVAGSLSLQGAAVSVYDPQAMDNARKVFPTLGYVDSVQEALEDADVVVLATEWQEFRDLDPVASAALVAQPVILDGRNVLDVQAWKDAGWTIHALGRNV

SEQ ID NO: 70231 - protein, 305 aa, Bdellovibrio bacteriovorus HD100
MDMIKNRLEKNYKKLKNWAERAQIEAYRLYDRDIPEYPYIVDIYKDHFLIYDKSDLRDLEKNHLPHVQEALKALFKCDDSKIVIKKRERQEGLKQYEKLDAKEETFVVRESQALLKVNLYDYLDTGLFLDHRPMRQKVFKSVKDKKFLNLFCYTGSVSVFAALGGAITTSVDMSQTYLRWAQENFQLNNLDPAKHNFINADVLEWLRNTKSPNTFDVIFLDPPTFSNSKKMDDTFEVERDQEFLVESCMNMLRPEGILYFSNNKRKFKISPAVLSKYKVKEITAESIPQDFHDKKIHNCFEIRSN

SEQ ID NO: 70232 - protein, 554 aa, Robiginitalea biformata HTCC2501
MKKPNPFTTKSRSSDLRELQASRADLLVIGGGITGAGIALDAASRGLRTVLLEKGDFASGTSSKSTKLIHGGLRYLKQFDFWLVKEVGSERAIVHKLAPHLVLPEKMLLPLIEGGSYGKWLTSIGLKVYDILAQVGGDDKRKMLEKKQALKKEPLLPKKKLKGAGYYAEYRTDDARLTLEIIKSSLEFGTKALNYMRVDDFLYEEGRVDGVVAEDLLGGGKMEVRADHIINAAGPWVDELRGVNRSRQGKRLHLTKGVHLVFPHEKLPVRQSVYFDVPDGRMIFAIPRGKVTYVGTTDTNFNGDKDDVRTDLADAIYLISAVNNMFPSIELEMADIESSWAGLRPLIHEEGKSASELSRKDEIFTSESGLISMAGGKLTGYRKMAERAVNRVAHRLEEAGKELGPCRTEKLPLCGNGFKNSKAVREYIDQIARRLKPHGLDRHVAWQLVTTYGDQTETILSDFEASEGKDPRWRLMQAELQFGVAYEMVQSPMDFFIRRTGRLYFDIDSVREYLEEAVAECARLLGADARKAEAWKETLEREIHLHSTFSLEPV

SEQ ID NO: 70233 - protein, 370 aa, Pseudomonas fluorescens Pf-5
MSRINPAVKPPHRIAVIAGDGIGREVVPEGLRVLEAVSRRFGIALQFDHFNWCSEHYQAHGSMMPDDWAQQIGGHEAIFFGAVGAPDIVPDHIAVWDSLLKIRRQFDQYVNIRPVRLMPGVPCPLAGRAPGDIDFIVVRENTEGEYSSVGGRMWEGTPREIALQESVFSRHGVDRVVNYAFELASRRPRRNLVAATKSNGIAITMPFWDERVEALAQAYPQVATRKFHIDILCAHFVQHPDWFDVVVASNLFGDILSDLGPACTGTIGIAPSANLNPERLYPSLFEPVHGSAPDIAGLGVANPIGQIWSAALMIEHLGQGDELYQRAAAAIVESIETVLAEGPRTREMGGNASTVEVGRAIAECLAGNRS

SEQ ID NO: 70234 - protein, 329 aa, Robiginitalea biformata HTCC2501
MRFAVLGGGSWATAIVKMLCENLDQVTWYMRNPDAIEHIRREGHNPNYLSSVEFNTDQLRLTDTIDEAVRDADLLIFAIPSAFLVRELKQLSVPLGGKTLFSAIKGIVPETGKIVGEHLHETYDIAYDDIGVITGPCHAEEVALERLSYLTIACSDKKKARMVARALSSSYIKTKVTKDIIGTEYAAMLKNIYAIAAGIAHGLGYGDNFQSVLMSNAIREMKRYTKRLYNIDRNINHSAYLGDLLVTGYSTFSRNRMFGNMIGKGYTVKSAMMEMSMVAEGYYAVKSAHAIKEDFPKKVKTPIIDAVYKVLYEQKNAKKTFAALADRMS

SEQ ID NO: 70235 - protein, 223 aa, Thermoplasma volcanium GSS1
MISKHQAVKKIFDQISDKYDLIDTIISLGLDQRWRRSLISNLKLMPGLQCLDCGAGSGKVTELIMESCDSCSVTALDITDSMFNPELTKRCKFVVSPAESLPFSDETFDRVSSAFLTRNLADVDKYFSEVYRVLKPGGIFVNLDIFNPTKPVFSQFFSLYFYRMVPFFGNHATHSRNYSYLANSVKFFYSPFILSKKLESKGFIVEPKDLFFGSVFMHIAQKK

SEQ ID NO: 70236 - protein, 509 aa, Robiginitalea biformata HTCC2501
MKKYLNLFDFSQEVNYRTEILSGLTVALALVPEAIAFALIAGLSPLTGLYAAFVLGLVTSVLGGRPGMISGATGAVAVVIVSLVADYGVEYVFATVILAGLLQVTAGVFRLGKFMRLVPHPVIFGFVNGLAIIIFMSQLAQFKTPEGGWMQGPALWTFSGLVLLTMAIIWGLPRLSKAVPASLVAILVIFGLVLALDIPTRSIGDIASISGGFPPFHIPELPWTLETLRIIFPYAAIVAGVGLIESLLTLNIVDEITETRGRGNKEAVAQGAGNILSGLFSGMGGCAMIGQSLINTSNGARARLSGIVASLMLLVFVVYGSGLIERVPMAALTGLMIMVALGTFEWASLRTFRRMPKSDVLVMVLVTLVTVFLHNLALAVLVGVIISALVFAWDNAKRIRARKHIDSEGVKHYEIYGPLFFGSTTLFNEKFDVMGDPEEIVIDFRESRVVDMSAIEALNKLTERYERVGKKVHLKHLSRDCRRLLKDADDIIEINVLEDPTYKVLTDKI

SEQ ID NO: 70237 - protein, 572 aa, Oryza sativa
MPDWRVGEFEGKLKDGFARSNNSEHENGAGTVSISSKKSKHRVASEKKPHVDISGLIDSDSQKCNSEQIHSANGIVSRDVNHDHIENCKVESNDFPLNTISETRYPTDNWNSSQFALSNDGSPVLNNQSTPQTGHGYGDNDLTYIDWPAIDNFEDVDNLFRRCDSTYGQQQLPNTDELSWIPSSDAMYSSDVAMQPGFESSYSDYGILDDLSAFNCTEDKSLTTADPSSAVCDEQFDDSYLFNEQKPEDVYGEQAYQRDAMELLSSDQICTGQENLDMIGNRYSSENAMEQPEDQKFSIASGSQLSSSQNLLNQKNHLDSTSPSNITSESYPERNCQIIPSGASFAERNLKVQKKVASSASGQLISDNVTGHPGHQTLTRRASYPCENHEIGKRSLGKRGLGHSDVAMGTSMVVDGSFVSSISSDNSVEENSFRQLQDAVSQLDVKTKMCIRDGLYRLARSAQNRQVFPNTMNNNGDSHNVKDMQNAETSGKFVDPGSIETQTNPIDRSIALLLFHQPSEHVTGAVDEAASLKSHNDNHQAAAKNQRVMHASSVHSPRGQGDPMDAKSCRNN

SEQ ID NO: 70238 - protein, 404 aa, Escherichia coli
GKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAGKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIK

SEQ ID NO: 70239 - protein, 472 aa, Oryza sativa Japonica Group
MEYRRVKDQESYDVVSQKDIESPGERSLSSTSATSSLSTAGASKGKNSWKLKSIVTLALTLLTSSQAILIVWSKRAGKYEYSVTTANFSVEALKCLLSLIALYRTWNSQGVTEDNRLSTSFDEVSVYPIPAILYMVKNLLQYYIFAYVDAPAYQILKNLNIISTGVLYRIILKKKLSEIQWAAFILLCAGCTTAQLNPSSDHVLQTPIQGWVMAIVMALLSGFAGVYTEAIIKKRPSRNINVQNFWLYIFGMLFNLVAICVQDFDAVMNKGFFHGYSFITVLMILNHALSGIAVSMVMKYADNIVKVYSTSVAMLLTAVVSVFLFGFHLSLAFFLGSTWHSVLQRAENMVNAIKGLFISCDVPMAQFIVNLNASMPASDKFILHMLDPTHMFVQPHVAEMIRSSPNYQKLYYYQKSRAYEAGKVQIVSEFRNMELKFSGNGRQCKKKTSAAPSAVASWPIVFNAGPFLAFSP

SEQ ID NO: 70240 - protein, 404 aa, Escherichia coli
GKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYELAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLLKCSEFGDAIIK

SEQ ID NO: 70241 - protein, 278 aa, Streptomyces coelicolor A3(2)
MVQIKNPEQIAKMREAGLVVAAIHAATREAAVPGATTKDLDQVARKVLAEHDAKPNFLGYGGFPATICTSVNEVVVHGIPSDDVVLKDGDVISIDCGAIIDGWHGDAAYTAFVGSGHSPELVELSRVTEESMWAGIAAMKQGNRLVDVSRAIETYIRRQPKPGGGKYGIIEDYGGHGIGTEMHMDPHLLNYVDRRRGKGPKLVPGFCLAIEPMVSLGTPRTEVLPDEWTVITTDGTWSSHWEHSVALTEQGPLVLTSPDGGKAKLAELGITAAPDPLA

SEQ ID NO: 70242 - protein, 563 aa, Thermoplasma volcanium GSS1
MGDLNSASTDANISYSENQDRKLRKALSTWDLLMLSVGGIIGSGWLFAAYAASVLSGPASILAWVLGGIIVIFIALVYAELGAMIPRSGAIVRYGHLSHGSFAGFLFGWAYFLSAVSVPAIEAEAVVTYAASYVTKPALIANGIMTVFGTLIAMLLMIAFFFLNYAGIHLMGKTNQGITWIKVIIPVITVIVLIAVHFNPSEIVPPNGFLPYGWAPVFAAISSTGIVFSYFGFRQAIDYGGEAKNPQRSIPIATIGSVLIGILLYSLLQVVFVGGIDWSKMGLEPGQWTLLNAYATAAHASTEHPLAYQLMNAPFATIALSAGLVWLTYTLYASAYIAPSGTLNVYLGTSTRTLYGMAVNGHLPKIFAKVADRNKIPVIPLITTLLVGFLFFLPFPSWYKMVGFISGATVFTYIVGGAALMNLRKQAPELKRPFKLWSANVLAPIAFILASEAVYWTGWPTTLYLAIAIFLGLVLYGALVGLHKIEQTFDKKNVKAGLWVPVFIVILTILSYLGEYGGINVLHFPLDLIVVAIASAIIYVWAIKSGIKTEEIAAMIANEDQYV

SEQ ID NO: 70243 - protein, 613 aa, Mannheimia succiniciproducens MBEL55E
MTETKITFGDLGLPEFILSAVSDMGFETPSPIQQACIPHLLNGRDVLGMAQTGSGKTAAFSLPLLAQIDIEEKHPQMLVMAPTRELAIQVAEACELFTKNAKGVHIATLYGGQRYDIQLRALRQGAQVVVGTPGRILDHIRRGTLNLSELKFIVLDEADEMLRMGFIDDVETVMAELPAQHQTALFSATMPEPIRRITKRFMTDPQEVKIQSTQRTNPDIAQSCWYVRGYRKNEALLRFLEVEDFDGAIIFTRTKTGTLDVTELLEKHGFRAAALNGDMTQQLREQTLDRLRNGSLDILVATDVAARGLDVERISLVVNYDIPLDAESYVHRIGRTGRAGRSGSAILFVEPRERRLLSNIERLMKKPIEEVDVPNHEALQARRREKFKAKITKQLEHHDLEQYRLLLEGLFTPDQDQEDIAAAMLMLLQGKQKLILPPEPPMEKRGRRERDDRRGERGDRRERRPEERRGYGNPQPMDLYRIEVGRADGVDVRHIVGAIANEGDINSRNIGHIKLYDEYSTVELPQGMPKELLQVFGKARVLNKQMRMTFVSEAGETVGRERHEGRRNDRRDNGFRREERRFNDRGNRSFNERAPRREFRERNDRRDRRDRRS

SEQ ID NO: 70244 - protein, 319 aa, Solanum nigrum
MGSKYSKATNSINDASNSSYRVPFESLRVPFVDLQEATNNFDDKFLIGWGVFGKVYMGVLRNGTKVALKKHMPESSQGIEEFRTEIEILSLCSHPHLVSLIGYCDERNEMILIYEYMENGNLRSHLYGSDLPAMSWEQRLEICIGAARGLHYLHTSAVIHRDVKSINILLDDNFVPKITDFGLSKTGTELDQTHVSTAVKGTVGYLDPEYFIRGQLTEKSDVYSFGVVLFEVLCARPAIAHSHSREMISLAEWAVESHNNGQLEQIIAPNIAAKIRPESLKKFGETVVKCLALSSEDRPSMGDVLWKLEYALRLQESVI

SEQ ID NO: 70245 - protein, 605 aa, Mannheimia succiniciproducens MBEL55E
MQVRLFFYRCLSFCSIYIRISMLKKWFITKNVFLAVRPFSALKDSFREGYTTQKLVKDIIAGLTVGVIAIPLSMALAIASGVPPQHGLYTAIVAGIIIALAGGSRFNISGPTAAFVVILYPVTQQFGLSGLLMATLLSGIILVIMALFRLGRLIEYIPLPVTLGFTCGIGITIGTLQIKDFFGLTIDKMPEHYIGKVQAIITALPTINWADAMVGIVTLLVLINWHKLRLPVPGHLPAVIIGTLLSLVLIHFGYHVASIGSAFEYTLPDGSTGHGIPSVLPQFALPWNIPNAQGEVIEWNFAIIQNILPAAFSMAVLGAIESLLCAVVLDNMTDTKHHSNNELLAQGLGNIAAPFLGGITATAAIARSAANVKAGGQSPIASIVHALLVLFALLFFAGALSYLPLSSMAALLLMVAWNMANVPQIIHLARRSGRNEIAVLTTCLVLTVIFDMVIAISVGVLLASLLFIRTIAEMTKSFEIAHPEDLDDVLVYRISGPLFFAAADNLFADLHEKTVHTDHEIRHIVLQCSAVTVLDAGGIHALTRFVQHMLPHQELYMCNMQFQPLRMIVKSNMLTEIQKINFSTDLKETYNKIRLVEAEDKKSEE

SEQ ID NO: 70246 - protein, 460 aa, Nitrosomonas europaea ATCC 19718
MSHQGKIVQCIGAVIDVEFTPGEIPKVYDALVMEGSELTLEVQQQLGDGVVRTIALGSSDGLRRGMMVTNTQKQISVPVGTKTLGRIMDVLGRPIDEMGEIGANSLMPIHRAAPAFDELSASTELLETGIKVIDLVCPFAKGGKIGLFGGAGVGKTVNMMELIRNIAIEHSGYSVFAGVGERTREGNDFYHEMKDSNVLDKVALVYGQMNEPPGNRLRVALTGLTMAEAFRDEGRDVLFFVDNIYRYTLAGTEVSALLGRMPSAVGYQPTLAEEMGRLQERITSSKTGSITSIQAVYVPADDLTDPSPATTFGHLDATVVLSRDIASLGIYPAVDPLDSTSRQLDPLIIGEDHYNTAREVQQTLQRYKELRDIIAILGMDELSPEDKLSVSRARKIQRFLSQPFFVAEVFTGSPGKYVPLKETIKGFKGIVSGEYDDIPEQAFYMVGGIEEVLEKAKSIQ

SEQ ID NO: 70247 - protein, 105 aa, Medicago sativa
MADVEDRCFVGGLAWATDNDALEKAFSQYGEIVDSKIINDRETGRSRGFGFVTFANEKSMNDVIEAMNGQDLDGRNITVNQAQSRGSGGGGGGRGGGGYGGGGGG

SEQ ID NO: 70248 - protein, 531 aa, Magnaporthe grisea 70-15
MATPSSLPYHEPSITTIIILSGFLILLNAINYGLDKLVYCGLIGQVFLGIAWGTPGAGWLSEEMEHSIVQLGYLGLILVVYEGGLSTDFRSLKANLLLSTAVAITGIALPMAFSFALASMLGASPLQAFTAGAALCSTSLGTTFTVLGTSGLVTTRMGVVLTSAAMMDDVVGLIMVQVVSNLSGSAGNFEPVTVIRPVFVSLGLTVLLPLLCRFLIRPGTLHLNAARIKSPGSSLDRLLRLPQTSLTIHTGCLLGLVIVGTYAGTSGLLSAYVAGASISWWDSEVPHVPTHTAQEKQHEPPTKQTNEPKSNQATESGVLAGPPASGQRQLPDESVRNSGTEIYEHYYSKAVSIILSPFFFRLVRTLSRSGHEVSIVTPGAQCTQDVPRPSNEQAASGTQPTDPSHNTPERAAMAETQSTDSPTNNASPDPEMPISTYPACILGCAMVARGEIGFLISALAESTGIFSGQAGAPERPSELFLIVTWAITLCTIIGPLCVGLLVNRVKRLERKSRGGKHNVLGAWGVQQSKCA

SEQ ID NO: 70249 - protein, 359 aa, Nocardia farcinica IFM 10152
MSLTLGIVGLPNVGKSTLFNALTKNDVLAANYPFATIEPNVGVVPLPDPRLEKLAEIFGSERIVPATVSFVDIAGIVKGASEGAGLGNKFLANIREADAICQVVRVFADDDVVHVDGRVDPAADIEVIETELILADLQTLEKAVVRLDKEAKVKKDRKPVADAAKAAREILNSGKTLFAARNEVDTDLLKELSLLTIKPFLYVFNADESVLTDEARKESLKASVAPADAVFLDAKVEAELLELDAESAAELLESIGQTEPGLHALARAGFHTLGLQTYLTAGPKEARAWTIHQGDTAPKAAGVIHTDFERGFIKAEIVAFDDLVEAGSMAAAKAAGKVRMEGKDYVMADGDVVEFRFNV

SEQ ID NO: 70250 - protein, 414 aa, Candida glycerinogenes
GDLAKKKTFPALFGLFREGQLSETTKIIGFARSKLSNDDLRNRIKPYLKLNKRTDAERQSLEKFLQILEYHQSNYDDSEGFEKLEKLINKYDDEANVKESHRLYYLALPPSVFTTVATMLKKHCHPGDSGIARLIVEKPFGHDLSSSRELQKSLAPLWNEDELFRIDHYLGKEMVKNLIPLRFSNTFLSSSWNNQFIDTIQITFKENFGTEGRGGYFDSIGIIRDVIQNHLLQVLTIVLMERPVSQSEKVKVLKAIEQIDFNNVLVGQYDKSEDGSKPGYLDDDTVNPDSKTVTYAALVLNVATKDGNNVPIILKAGKALNQSKVEIRIQFKPVENGIFKNSARNELVIRIQPNEAMYLKMNIKVPGVSNQVSISEMDLTYKNRYSSEFYIPEAYESLIKDALMDDHSNFVRDD

SEQ ID NO: 70251 - protein, 562 aa, Vibrio fischeri ES114
MNNNKRPLYIPYAGPALLSTPLLNKGSAFSTTERKYFNLEGLLPEAIESIEEQTGRAYKQYQNFENDMDKHIYLRNIQDTNETLFYRLVQNHISEMMPIIYTPTVGAACENFSNIYRRGRGLFISYENKNRIDDLLNNAANQNVKVIVVTDGERILGLGDQGIGGMGIPIGKLALYTACGGISPAHTLPIVLDVGTNNPQRLADPMYMGWRHPRVTGDEYADFVEDFIQAVQRRWPEALVQFEDFAQKNAMPLLERYKNRICCFNDDIQGTAAVTVGSLLAACKAAGSSLSEQRVTFLGAGSAGCGIAEAIIAQMVSEGISDAQARSQVYMVDRWGLLQEGMPNLLDFQQRLVQKAENTKDWVSEEPNFSLVDVMRNAKPTVLIGVSGAPGLFSKEVIQEMHKHCERPIVFPLSNPTSRVEATPNDIIRWTDGQALVATGSPFDPVAHNGQTYPIAQCNNSFIFPGIGLGVLAIKATRVTDEMLMESSRALAECSPLAIHGTGALLPPLEEIHSVSKRIAFAVAKKAIEQGHALEITDEALQQKIESYFWKPVYRRYKRTAF

SEQ ID NO: 70252 - protein, 391 aa, Pseudomonas fluorescens Pf-5
MTAACLMSTYQPLALSFCKGLGSRLWDQAGREYLDAIAGVAVTGIGHSHPRLVGAISEQAGLLLHSSNLYDIHWQQQLAAKLTQLSGMDRAFFNNSGAEANETALKLARLHAWHKGIEQPLVVVMENAFHGRTLATLAASDGPAVRLGYGQLPGGFLKVRFGDLAALESAVAEHAPRICGVLMEPIQGESGIQLAPPGYLKAVRELCTRRNWLLMLDEIQSGIGRTGRWFACQHEDVVPDVMTLAKGLGNGIPIGACLARGKAAQLFTPGSHGSTFGGNPLACRAACTVLDVIEDQQLLANAEQRGAQLLRRLREELAAHPAVREIRGLGLMVGIELRQPARELVQVAARDHGLLINVTRGTTIRLLPPLVIDGQEVEMIVDGLRQTLEAL

SEQ ID NO: 70253 - protein, 450 aa, Robiginitalea biformata HTCC2501
MADYKDKIDAFMEEVTSRNGHEPEFIQAVQEVAETVIPYIAEQEIYSGKNILLRMVEPERLISFRVAWVDDDGEIHVNRGYRIQMNSAIGPYKGGLRFHPSVNASILKFLAFEQVFKNSLTTLPMGGGKGGSDFDPKGKSDDEVMRFCHAFMTELCRHIGPNTDVPAGDIGVGAREIGFLFGMYKKIRNEFTGVLTGKGLSWGGSKIRPEATGYGTVYFAQNMLETRNDSIEGKTVAVSGSGNVAQYAAEKVLQLGGKVVTLSDSGGHIHDPDGIDAEKLAWVMDLKNNRRGRISEYVKQYPGASYHKGKAPWHVACQVALPCATQNELNGEDAKTLIKNGCICVAEGANMPSTPEAIHAFHDARILFAPGKASNAGGVATSGLEMSQNSLRISWTREEVDQRLKGIMSDIHDSCIEYGREDDGYCNYVKGANIAGFVKVADAMLAQGVI

SEQ ID NO: 70254 - protein, 393 aa, Mycobacterium tuberculosis CDC1551
  misc_feature (91)..(91): Xaa can be any naturally occurring amino acid
MSGEDSIRSFPVPDLGEGLQEVTVTCWSVAVGDDVEINQTLCSVETAKAEVEIPSPYAGRIVELGGAEGDVLKVGAELVRIDTGPTAVAQXNGEGAVPTLVGYGADAAIETSRRTSRPLAAPVVRKLAKELAVDLAALQRGSGAGGVITRADVLAAARGGVGAGPDVRPVHGVHARMAEKMTLSHKEIPTAKASVEVICAELLRLRDRFVSAAPEITPFALTLRLLVIALKHNVILNSTWVDSGEGPQVHVHRGVHLGFGAATERGLLVPVVTDAQDKNTRELASRVAELITGAREGTLTPAELRGSTFTVSNFGALGVDDGVPVINHPEAAILGLGAIKPRPVVVGGEVVARPTMTLTCVFDHRVVDGAQVAQFMCELRDLIESPETALLDL

SEQ ID NO: 70255 - protein, 571 aa, Physcomitrella patens subsp. patens
GEALLSFKRSLLNANRTLSSWNESHPNPCLWLGVTCLPKSDRVYILNISRRNLRGIISSKIGKLDQLRRIGLHHNNLFGSIPKDIGNCVNLKALYLQGNFLIGNIPDEFGKLQRLKILDISNNGLMGSIPQAIGRLSQLSFLNLSANFLTGKIPAVGVLAKFGSLSFSSNPGLCGSQVKVLCQSVPPRMANASTGSHSTDLRSILLMSAVGIVGVSLLLAVLCVGAFIVHKKNSSNLYQGNNIEVDHDVCFAGSKLVMFHTDLPYNRDDVFKSIENLGDSDIIGSGGFGTVYRLVMDDGCTFAVKKIGKQGISSQQLFEKELGILGSFKHQNLVNLRGYCNAPLASLLIYDFLPKGNLDENLHGRLSWNIRMNVAVGSARGIAYLHHDCVPRIIHRGIKSSNVLLDEKLEPHVSDFGLAKLLEGESSHVTTVVAGTFGYLAPGTYMQSGRATEKGDVYSFGVMLLELISGKRPTDALLVENNLNLVIWATSCVKNNVIEEIVDKSCLEDTSIEHIEPILQVALQCISPNPEERPTMDRVVQLLEAETLSSVPSELTNFYSSPVSDLENRER

SEQ ID NO: 70256 - protein, 355 aa, Zea mays
MSAYCGKYKDELIKNAAYIGTPGKGILAADESTGTIGKRLSSINVENVEENRRALRELLFCCPGALQYISGVILFEETLYQKTKDGKPFVDVLKEGGVLPGIKVDKGTIEVVGTDKETTTQGHDDLGKRCAKYYEAGARFAKWRAVLKIGPNEPSQLAIDLNAQGLARYAIICQENGLVPIVEPEILVDGPHDIDRCAYVTETVLAACYKALNEHHVLLEGTLLKPNMVTPGSDSKKVTPEVIAEYTVRTLQRTVPAAVPAVVFLSGGQSEEEATRNLNAMNKLSTKKPWSLSFSFGRALQASTLKAWAGKVENLEKARAAFLARCKANSEATLGTYKGDAAADTESLHVKDYKY

SEQ ID NO: 70257 - protein, 459 aa, Desulfovibrio desulfuricans G20
MNALQPDTERLRALDTAHVWHPFTQMATWHEDAPLIIEKARGNWLVDTDGNRYLDGVSSLWTNVHGHRHPHIDAAIRAQLDNVAHSTLLGLSSRPAIELAAMLARVAPQGLNRVFYSDSGSTAVEVALKIAYQYQKQRGPAGEGRSKFLCLRGAYHGDTVGAVSLGGIDLFHAVYGGLLFKTVRAEAPYCYRCPFGRQKESCRHECFTHLEETATRHAPELAAMVIEPLVQGAAGQITHPDGYLAHARALCDRLGILLIADEVAVGFGKTGTMFACEQEKVTPDLLCLAKGISGGYLPLAATMVTDAVYEAFLGDHAQCRTFFHGHTYTGNALACAAGIASLQLFRTEGTLERLQHIITIYDALLRQLETLPHVGDIRRRGIMTGIELVEDRATRRPYPFALRTAHKVVLAARRRGVIIRPLGDVLVLMPPLSITAQECGLLVEATAEAIQEVTGGPRV

SEQ ID NO: 70258 - protein, 265 aa, Oceanobacillus iheyensis HTE831
MTTVVFKVGGSVLNQLSPKFYQVLLQLKETGTCNPIIVHGGGPEINEALSKMNIKTEFVDGLRVTSEEVLSIAEMVMSGTINKRIVSSIQSIGGNALGLSGVDGKLLRAKQMHDGKLGLVGEVVEVNTEWLSIIMNSGGIPVISPIAIGDADKRYNVNGDMAAGAVAEAFQSKLILVSNIPGVIESVNGEEIIHHHLTKQQVESKIDSGVIYGGMIPKVRSALASLKSGVAESVILNGLNPIEIKNYLEGKTVGTVLTEREVEHV

SEQ ID NO: 70259 - protein, 399 aa, Oceanobacillus iheyensis HTE831
MSSTTKVSSAVMQTYNRFPITATKGKGSFLWDDNGEKYLDYTSGIATCNLGHVPDNVQHAISNQLKDLWHCSNLYHIPSQEKLAALLTEYSCLDQVFFCNSGAEANEAAIKIAKKYAKDKGYDDRTEIITFEQSFHGRTGSTMAATAQEKIHQGFTPLTEGFRYLPFNNKESLSEIDNGKTSAVLLEVIQGEGGIHTAEKDWLKQLAAICKQADILLMIDEIQTGIGRTGSLFAYQPYGIEPDVITVAKGLGSGFPIGAMLAKQHIAASFSPGTHGSTFGGNPVAAAAGIATLKEILSDGFLENCKEGQEELFNQLKSIKEISPLIKDIRGKGYLMGIEVMNQASAWIEKLREKQILVLPAGEKVVRILPPLTTTKEELQICIQALKEVALELGGNTNG

SEQ ID NO: 70260 - protein, 362 aa, Oceanobacillus iheyensis HTE831
MDKGFLVLETGEVFEGILIGDKQAIEGELVFNTGMTGYQEMMTDPSYKGQILTFCYPIIGNYGINDIDDESKEIAVSAVIASDICDEPSHYQLTRSFSKQLEQAGIPGLFEIDTRQLVMIIREHGSLRAKIVTDEWETKNITWQTRSLLSLVNSVSVKQSETYGTGDTHIAIMDYGYKKSIRNALLQQGCKVTVVSYQTPLHHIKELNPDGIVLSNGPGDPMELQAYFPVIKQITQDYPTLGICLGHQLIALAYGAMTKKMHFGHRGGNHPVKDLFTGKVWITSQNHGYVVEEDTIDYMQFDVLFKNVNDRSLEGLKHCHYPVTTVQFHPEAHPGPSDTNYIFEDFLNEVREKKGALTHAKA

SEQ ID NO: 70261 - protein, 338 aa, Clostridium perfringens SM101
MNILLTGGIGYIGSHTIVELLRDDNNSVVVIDNLVNSRKEVKDIVEKITGKSIKFYEGDLVNFEDIDKVFKNEKIDAVIHFASLKAVGESVEKPLEYYNNNIIGTLNLLTSMRNHNVKKFIFSSSATVYGESEIVPVHEGLQAGFATNPYGRCKAMIEDILRDLYISDNSWDIVLLRYFNPVGAHESGLIGELPNGIPNNLMPYVSKVADGELDYVRVFGDDYNTQDGTGVRDYIHVVDLARGHVAAMKKLKDGSGISTYNLGTGQGYSVLDIIKAFSKASGKEIPYKIVDRRAGDIAISFADPSKAEKELGWKAEKNLEDMCKDFWKWQCVGMKNFK

SEQ ID NO: 70262 - protein, 116 aa, Zea mays
MSMTVSRASLDQKLALAKRCSREATLAGAKAAAVATIASAIPTLASVRMLPWAKANINPTGQALIVSTVAGMAYFIAADKKILSLARRHSFEQAPEHLKNTSFQGTGRPHPAFFRP

SEQ ID NO: 70263 - protein, 888 aa, Oryza sativa Japonica Group
MAVGLPIVFGCHDYSGFTNIDCGFVDGESYTDSTTNLTYVPDHEFVEGGTHHEVVPKLISGSTDEQEKTLRSFPDGQRNCYTIPSTSGKKYLIRTTFTYGNYDGLRSSENGSLFLFGLHIGVNFWTTVNLTKQDSSDTIWKEVLTVAPDEFIYVCLVNFGSGTPFISALELRQLDDPMYPFLNLFVSVSYFTRMRFGAVDDFITRYPTDLFDRFWEAAQCYSYPWLNLTTNQTVNKLPGNDNFQVPTLIVQKASTINSGFSWLNISITAGDNLNGQSLELLPIFHFAEIEKNRPNRTFQIYSDGNELHQAFSPSYLQVDSVYLRDRYLHESGTTFTLCKTNSSELPPLINAFEAYSLVRMENLTTDTIDVSSMKQVKTQYNVQRRSWNGDPCSPKEYTWEGVKCNYYDGKQNPRIILVNLSASRLSGWINPSFRNMSLEILDLSHNNLSGTIPYNQVNSLKSLNLSYNQLIGSVPDYLFKRYKAGLLELRLEGNPMCSNISESYCAMQADKAKKNTATLLIAVIVPVVAITLMLFLWMLCCKGKPKEHDDYDMYEEENPLHSDTRRFTYTELRTITNNFQSIIGNGGFGTVYHGILGNGEEVAVKVLRETSRALSKDFLPEVQTLSKVHHKNLVTFLGYCLNKKCLALVYDFMSRGNLQEVLRGGLEYLHESCTPAIVHRDVKTANILLDENLVAMISDFGLSRSYTPAHTHISTIAAGTVGYLDPEYHATFQLTVKADVYSFGIVLLEIITGQPSVLVDPEPVHLPNWVRQKIARGSIHDAVDSRLMHQYDATSVQSVIDLAMNCVGNVSIDRPSMTEIVIKLKECLLAGTGKKQLVSGSYKQKDAMDAGIARQFQLLISGVPIDGDGCACATHREEMINHCNGKMK

SEQ ID NO: 70264 - protein, 149 aa, Geobacillus kaustophilus HTA426
MAERTFIMVKPDGVQRNLIGEIVARFEKKGFQLVGAKLMQVSRELAEQHYAEHKERPFFGELVDFITSGPVFAMVWEGENVIAAARQMMGKTNPQEAAPGTIRGDFGLTVGKNVIHGSDSPQSAKREISLFFKEEELVSYSKQINAWLY

SEQ ID NO: 70265 - protein, 234 aa, Geobacillus kaustophilus HTA426
MHQSKEERVHRVFEKISAHYDRMNSVISFRRHLKWREDVMRRMNVQKGKRALDVCCGTADWAIALAEAVGPEGEVYGLDFSENMLKVGEQKVKARGLGNVKLIHGNAMQLPFPDNSFDYVTIGFGLRNVPDYMTVLKEMHRVTKPGGMTVCLETSQPTLFGFRQLYYFYFRFIMPLFGKLLAKSYEEYSWLQESAREFPGRDELAEMFREAGFVDVEVKPYTFGVAAMHLGYKR

SEQ ID NO: 70266 - protein, 93 aa, Triticum aestivum
MASGQQERSQLDRKAREGETVVPGGTGGTNLQAQENLAEGRSRGGQTRKEQMGEEGYREMGRKGGLSTNDESGGERAAREGIDIDESKFKTKS

SEQ ID NO: 70267 - protein, 161 aa, Arabidopsis thaliana
MATSSTQLLLSSSSLFHSQITKKPFLLPATKIGVWRPKKSLSLSCRPSASVSAASSAVDVNESVTSEKPTKTLPFRIGHGFDLHRLEPGYPLIIGGIVIPHDRGCEAHSDGDVLLHCVVDAILGALGLPDIGQIFPDSDPKWKGAASSVFIKEAVRFRRLP

SEQ ID NO: 70268 - protein, 322 aa, Yersinia pseudotuberculosis IP 32953
MSKIYEDNSLTIGHTPLVRLNRIGNGRILAKVESRNPSFSVKCRIGANMIWDAEKRGILTAGKELVEPTSGNTGVALAFVAAARGYKLTLTMPETMSIERRKLLKALGANLVLTEGAKGMKGAIAKAEEIQATDPERYLILQQFSNPANPEIHEKTTGPEIWEDTDGDVDVFVSGVGTGGTLTGVSRYIKNTKGKAITTVAVEPTDSPVITQALAGQEIKPGPHKIQGIGAGFIPGNLDLSLVDRVALVTNEEAISMARRLMDEEGILAGISSGAAVAAAVKLSEEEGFTDKTIVVILPSSGERYLSTALFADLFTEQELQQ

SEQ ID NO: 70269 - protein, 176 aa, Rickettsia akari str. Hartford
MSKVKKNEDTLSEVLVDVNRVTKVVKGGRRFAFSAYVVVGDKAGRVGAGHGKAKEVNEARGKAKQAAKKRMMKVPLYQNRTIHHDVVGKSGAAKVILRRAKAGTGVIAGGSMRAIFDSLGVHDIVAKSIGSTNVYAMISATFDALNKLASPKSIAMRRDKKVNEISIKSSDIQVNE

SEQ ID NO: 70270 - protein, 514 aa, Thermoplasma volcanium GSS1
MHMAAVLEEDALSILGLERVNSGIYDGEWKKPAGKMLTVYSPIDGSEIAKISMATREDYDEMVKKAQEEFKKWRMIPAPKRGLIIKDIGDELRKEKRNLGRIVTIEAGKTPSEGEGEIQEMIDISDLALGLSRQLYGLTIASERPYHRMYEQWVPLGPIAVITSFNFPASVWSWNSFIAAVTGDVVIWKPSSKAALTAVAVMKVIERVLKRNNVPNIFYLMVSSGSEGGDWITNDPRIPLVSFTGSVPVGRKISENVAKRLGKSILELGGNNGAIVSDKADIDLALRGVVFGALATAGQRCTTTRRVIVSEKIYDEFVKKLVNAYSKVKVGDPREKGVLVGPLIDEDAVRDYEGAISEAVKQGGKVLYGGKKISLKGYEKGHYVEPTIIEANPNMPIVKEETFAPILYVMKYKTIEEALEIHNSVPQGLSSSIFTTDLREEEAFLSPYGSDCGLANVNTSTAGAEIGGAFGGEKDTGGGRESGSDAWKFYMRRQTVTKNWGQTLPLAQDVVFDF

SEQ ID NO: 70271 - protein, 670 aa, Xylella fastidiosa 9a5c
MRIRSVINVIFMLHRIACSGPLWGGQWCFRCNAKTMIDSTCYPRLSRIQIPEDLRTFQESELRAVADELRNYLIESVGLSGGHFAAGLGVVELTIALHYLYCTPIDHLVWDVGHQTYPHKILTGRRDKISTVKHQGGLAPFPKREESIYDTFGVGHSSTSISAALGMAIVAQRHGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEGFVTIEDNVVAGGAGSGVAELLNAEGIVLPIVHLGLPDAFQQHASREDLLAEAGIDAAGVYAALLSRWPDLAVQNHPLSAVS

SEQ ID NO: 70272 - protein, 125 aa, Saccharomyces cerevisiae
MFRSVCRISSRVAPSAYRTIMGRSVMSNTILAQRFYSANLSKDQVSQRVIDVIKAFDKNSPNIANKQISSDTQFHKDLGLDSLDTVELLVAIEEEFDIEIPDKVADELRSVGETVDYIASNPDAN

SEQ ID NO: 70273 - protein, 175 aa, Saccharomyces cerevisiae
MGAAPSKIVDGLLEDTNFDRDEIERLRKRFMKLDRDSSGSIDKNEFMSIPGVSSNPLAGRIMEVFDADNSGDVDFQEFITGLSIFSGRGSKDEKLRFAFKIYDIDKDGFISNGELFIVLKIMVGSNLDDEQLQQIVDRTIVENDSDGDGRLSFEEFKNAIETTEVAKSLTLQYDV

SEQ ID NO: 70274 - protein, 235 aa, Zea mays
  misc_feature (223)..(223): Xaa can be any naturally occurring amino acid
MASSFLSLRLPTPSPPTATSSPFFPNPLVRSGRCSPLSSTLVARVAGPAAGAPSPLFNPRGDPFLSTLAAASPEQLAAAAGGERRGEDHLPFLEIFQNAKLMSSPAQVERSSSSYSQHSPRRPPPDLPSLLLHGRIVYIGMPLVPAVTELIVAQLMYLDWMNSSEPAYIYINSTGTARDDGEPVGMETEGFAIYDAMMRMKTEVHTLCIGAAAGHACLVLAAXKEGKRYMFPHAK

SEQ ID NO: 70275 - protein, 654 aa, Idiomarina baltica OS145
MYGTFASLLMLLAVAVVLVWAFRRIKLPAILAYLTAGVIAGPDVMGWIADPNEYHLIAELGIVLLLFSLGLEFSLPKMLAMRRWVFGLGSAQVLVSLALFMGLGLWLLDSPTAALAVAGALALSSTAVVIKQLSESSQTATRRGQMTVAVLLFQDIAVVPLLIAIPLLAGQGGENIAYSLLLALLKGAAVITVLLLIGKWVLPFLFREIARQRTDELFVLATLLVALVAGGLTHLFGLSMALGAFLAGMMLGESKYKHQLEADIRPFRDILMGLFFTTVGMQLSLHAVVFEFHWIVATLLVMALIKVLLIQGVARMMGEHRRDAWAAAVSLFQMGEFGFVLVSLAASYGLLEPRISSILIGVGVLSMAITPLVIQKLQPLVAFLAHDEGDSSGIHSDQAEEEQAAPALICGFGRVGQTVSRFLEAEGIKHVAIDNDPMRVQEAVAGGAKVYFGDSAKRDILRAVGAQHAPLIVISYADDTYAIKTLKEIRAMNEDAFILVRSRDDSRLTALQEAGASQVVPDTLEASLMLISHVLNRSGVPIRRILTRLEQERRNHYGDMHGFFPGSHTDMDPERLEKLQFLHAVPLPQHAWAVGKSVEDLDWSKRNVELKAIRRDDVEVTDLTDQIELAVDDVVLLSGKPAAVEAAERWLLEG

SEQ ID NO: 70276 - protein, 448 aa, Sulfolobus tokodaii str. 7
MTIAGRIERLPWTSFHTKLLALLSLGEFFELYDLFVGGFVVQPISSFYKIPSAEAIYYTIAIFFLGAFVGAIIFTYIGDVMGRRTALILNMFIASVGLLLTPFSPNIYLLGLLRFITGLGVGPEALIVLDVMITEFFPSRIRGRALAIGYTASWTAPIVVAILAYLLIPHSYILQGWQWLYIIGGLGILTIIPFRFLIPESPRWLETKGRIDEAEKIVNMMEEVAIREKGHLSEPLQVEVVTSQKVKISELFSPLYRKRTIMLWIFEFLQTGVYYGFASLAPSVLYAKGFSLVHTLEYSMLIYTSYFISSLASIFIIDSQKFDRKWQVSIVMLLMGIVGLAFGFSTTALEVITTGFLFGFLSNIFSNAFHQYGAELYPTRIRSFADGVQYSLSRLGNYVWLSILPILLYSKGPAFMYAVVFVMALIVTLDVGILGPKASQIELEQLSK

SEQ ID NO: 70277 - protein, 933 aa, Oryza sativa Indica Group
MSQWEPAFVVTLSLLFCIHGQLDNLGFISIDCGYITRPSYPDFKTNLTYVADVGFTNTGFIHTVDVGNLQRDLAQRYTTVRYFPNGTRNCYTLKQLTRGGKYLVRATFGYGNYDAFNSPPAFDLYLGANYWVKVNITNSSRAYVHETIAVSPSEFLQVCLVNTGSGTPFISGLDLRSLPANFYPEANVAQSLVLLSFFRETVSFGFNRFHFGTDEHHIRYPVDRYDRFWQRYEDIPGWEDVPDKINGTVKSPQNDTYGAPSDLMRSASTAVNASRMDLPWSSDASMDVGIGPEYIVVLYFAEVQAISDNLLRQFLVSVDNTPLAAAFSPRHMLADVFSGTVLGSDQHSISLITTIISDLPPLISAMEIFLGRTLNESSTGSSDDKYSVKRNWEGDPCAPEAFVWDGLSCIHTSIGDIQYNPRGLHRITALNLSFSELIGDIDASFGQLLLLRHLDLSYNNLSGSIPDFLGQMPLLTFLTGNNPNLCGNHTCDPISNKNKRNKFIGFVIAAAIVATVFALSLSALFIWYRRRKTNPDVLPEADPYKSRRFKYKELQVITNDWRNVIGEGGFGHVYAGQLEDVTDVAVKVESQTSLRGNHKQFLAEVQHLTRVHHKNLVSLIGYCNDKKHRCLVYEYMDGGTLEGRLRGREDPPEPPLTWLQRVNIALGSANGLNYLHTMCSPRLIHRDVKAGNILLTANLEAKISDFGLTRPSIHGTVETRTITQLAGTPGYMDPESLQASHPSESNDVYSFGVVLMVVITGRTAIVTINGTEKNLAQCVRDWLSSGRGIEAIADPMIRDDCNLSSVEMVAQLALDCTEPAGQDRPTMADVVTTLTESLQLEMSWSSPHSMRSSTTISSSAGFTGSGRADHDAAADSIAVLQVEQAVVETSTRGFTILDRAPRSQTLDELMNTGSEFSIHGHKFGVQFGSASEL

SEQ ID NO: 70278 - protein, 569 aa, Oryza sativa Japonica Group
MDFFSEYGDANRYKIQEVIGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFTKYSPAIDIWSIGCIFAEILTGKPLFPGKNVVHQLDLMTDLLGTPSMDTVTRIRNEKARRYLSSMRKKQPVPFSERFPKADPAALKLLQRLLAFDPKDRPTAEEALADPYFKGLAKAEREPSCQPITKMEFEFERRKVTKEDVKELIFREILEYHPQLLKDYMNGTEKTNFLYPSALDNFRRQFANLEENGGKNGDAVPSDRKHVSLPRTTTVHSAPIPPKDHQNITSQVPQRIPGRTGRGACPVIPFENLSAMGPYNQRRVVRNPVLPPATTNLSAYAYHRKSDSSERELQQELEKDRMRYQPSEHFMDAKVVSHMSHDLRASSYYVSKAKSDVADRAALQSNMMQGIGPFNGIAAVGGNYNKVSTVQYGVSRMY

SEQ ID NO: 70279 - protein, 333 aa, Mannheimia succiniciproducens MBEL55E
MRALKKISQLLAKNTALVIILTALFTFIVPEAFTWVKGDAQVLVLGIIMLSMGMTLGAKDYQILAKRPLDILIGTVAQYTIMPFVAISIAQAFNLSPGLTLGLVLVGTCPGGVASNIMSFLCKGDVAFSVGMTTVSTIIAPVMTPLLLNYLVGETIDMDGWGMFKFMLLVTILPVGLGSLFNMGCHKQKWFNDVRSVMPGVAVIAFACIVGGVVAFQGERFLESGLIMLMAIGCHNITGYILGFAAGRVFGMNTAKKRTLSIEVGVQNAGLATGLSAKFFPTNAESVVACAVACVWHSVSGSVLANIYQWWDKKHGEPVTEIHEIKKPVTESV

SEQ ID NO: 70280 - protein, 84 aa, Brassica napus
MVGSGAPQRGSAAAAASMRRRKPSGSGSGGGASGGGGAAGSMLQFYTDDAPGLKISPNVVLVMSIGFIAFVAVLHVMGKLYFVK

SEQ ID NO: 70281 - protein, 422 aa, Oceanobacillus iheyensis HTE831
MQEIKIPELAESITEGTIAEWLVKKGDKVEKGDPVVELETDKVNVEVNAEFSGVITEIISEEGDDVTVGDTIAKLDENGEAGSNSDESEPKEEPKQEEKQEDDKKKASETETSKGAETKSESNGEVIASPAARKRARELNIDLSSVQSRDPLGRVRTEDVEAQAQANKQPAEKKQEKKDAPKSEKTEFDKPVERVKMTRRRQTIAKNLVEVQHNTAMLTTFNEVDMTAVMELRKQRKDKFLDKNGVKLGFMSFFTKAVVGALKEFPLLNAEIQGNELVIKKFYDIGIAVSTDDGLVVPVVRDADRKDFAGIEQDINDLGIKARDNKLTLKDLQGGSFTITNGGTFGSMMSTPILNAPQVGILGMHNIVKRAMVMPDDSIEVRPMMYLALSYDHRIVDGKEAVQFLVRIKQMLEDPYDLLLEG

SEQ ID NO: 70282 - protein, 230 aa, Oryza sativa Japonica Group
MMVCGSVLHPDFQSSSQAHDFVGVKMQRAIQAIGSHGSLLKSAVLRHISAPKPSILPAVYSRSMSVSSAQIEESGFETATVADILKSKGKSADGSWLWCTTDDSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 70283 - protein, 554 aa, Bdellovibrio bacteriovorus HD100
MGKGLRFPPETRKKTAFQRTHPMISTNNVSLRFGGKKLFEDVNVKFTPGNCYGLIGANGAGKSTFLKVLSKEIEPNTGEVIIGSDQRLSILKQDHYAYDEFPVLKTVLMGNDRLYKVMEEKDALYAKPDFSEADGVRASELETEFAELNGWEAESEAAVMLAGLAIPEELHGKLMKELNGGEKVKVLLAQALFGRPDILLLDEPTNHLDIYAIQWLEEFLLNFENTVIVISHDRHFLNKVCTHIADIDFGKVTTYTGNYDFWRQASELNQRLREDQNKKSSDKAEELKAFIARFSANASKSRQASSRQKQLEKLEFVDLPASSRKKPFIGFDIKRELGNDVLVVDKLTKTWEGETLLKNLSFTLKKGDKVALLGRNDLAKTLLMEIIAGEMQADSGTYNWGITTSIGYFPTDNSRYFNGDEETLVDWLRPYSTEKDETFLRGFLGKMLFGGTDALKQPKVLSGGEKVRCMFSKLMLSGANILILDGPTSHLDLESITAVNEGLSRFKGTVIFTSHDHELIQTVANRIIEIDQGVVYDNHITYEEYLASKALVTH

SEQ ID NO: 70284 - protein, 344 aa, Geobacillus kaustophilus HTA426
MENIAVLGAGSWGTALALVLADNGHHVRLWGHRTEQISEINEKRTNEKYLPGVRLPDAIIGYDDLCAALDGVAIVVLAVPTKAIRSVLADVRACLAKPITIVAVSKGIEPGTHKRVSEMVAEEMGEWLADVVVLSGPSHAEEVVLRHPTTVAVSSPNMEAARRIQDIFMNHHYFRVYTNPDLIGVEVGGALKNIIALAAGISDGLGYGDNAKAALITRGLAEIARLGCALGANPLTFAGLTGVGDLIVTCTSVHSRNWRAGYMLGQGKKLDEVLESMGMVVEGVRTTKAAYELAKELGVKMPITEALYDVLFAGKDPKEAVDSLMARGKKEEMDDLNNIFAEQE

SEQ ID NO: 70285 - protein, 545 aa, Robiginitalea biformata HTCC2501
MPFPKINPSTTQAWNQLRAHYERTHNRHIKDLFASDPERASRMSLRWNGFFVDYSKNRVDDETLELLLSLAEACDLETAMDAYFDGEAINQTEGRAVLHTALRNGSDSGLEIDGEPVEKEVGRVREHMRAFCEAVISGDKKGYTGKPFTDVVNVGIGGSDLGPVMVTEALQFYSNHLRTHFVSNVDGDHVHETLRKLNPETTLFVIVSKSFTTQETLSNALTIKKWFLEHATQADIAKHFAAVSTNTAKIEEFGIADANVFPMWDWVGGRFSLWSAVGLSIALSIGFDQFEALLSGARSMDRHFREAPWKENIPVILGLLSIWYNNFHGAETEAVIPYSQYLHRLPAYLQQGIMESNGKSVDRNGVPVAYQTGTIIWGEPGTNSQHAFFQLIHQGTKLIPADFIGFRHSLHGDREHHLKLMANFFAQTEALMNGKTPEAVRDELSGQGLGDDALENLLPFKVFEGNKPTNTILIERLSPESLGALVALYEHKIFVQGVIWNIFSYDQWGVELGKQLASTILSELTSGQVGNHDTSTLQLLQYFKS

SEQ ID NO: 70286 - protein, 560 aa, Oryza sativa Japonica Group
MPDARSAAENASRHHHHHHRAHAIADRSERGLPEEHSRGSVDERFVFPWMGILVNVPTEWKNGRQVGESGNRLKEGFARFCPHKVIPLWNHRGHTGNAIVEFAKDWTGFENALAFEVHFEQQGYGRRAWMGNKYRGSQMFGWVARADDHNSPGPIGVYLRKNGDLKTVADLENEGTRKTDKLVANLASQVEVKKRHVEELESQYNETTASLERVMEQREQQLQAYNEEIRKMQDLALRHSQRIMDENKKLRSDLESKMQLLDSRSKELDKLAVQSNSDRMNLEKEKEKNDIKTKHLKMATLEQQKADESVLKLVEEHKREKQAALDKILKLEQQLNAKQKLELEIQQLQGKLEVMKHMPGKEDSEAKSKIHELSEELKDKYAEMESIESLNQALVIKERQSNDELQHARKVLIEGFQDIIVGRTNIGIKRMGVIDFKAFTNAYKQRSLEEDADVSAAELCSLWENEIKNSDWHPFRVVMVDGKEMEILSEDDGKLCELKEEHGEEICAMVTKALLELNEYNPSGRYPVPELWNFKENRKATLKEVVQYVLNQWKKNKRKR

SEQ ID NO: 70287 - protein, 178 aa, Zea mays
AAYFDLDFMNQPNDGAHILSAQHLGDLYRDFVKDFPIVSIEDPFDQDDWSSWASLQSSVDIQIVGDDLLVTNPKRIADAIDKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 70288 - protein, 218 aa, Zea mays
HASAPLGKAGTGLVVLSAALAEVIVALGGGLLVGANNLNGALVDLDAREDASLLEDIDRCAYVTETVLAACYKALNEHHVLLEGTLLKPNMVTPGSDSKKVTPEVIAQYTVRTLQRTVPAAVPAVVFLSGGQSEEEATLNLNAMNKLSTKKPWALSFSFGRALQASTLKAWAGKVENVEKARAAFLARCKANSEATLGTYKGDAAADTESLHVKDYKY

SEQ ID NO: 70289 - protein, 304 aa, Oryza sativa Indica Group
MAAPSSLASSHLYRLADLRRAGVAAAAPAHPQQLRLGCSRRRAQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 70290 - protein, 48 aa, Triticum aestivum
  misc_feature (16)..(16): Xaa can be any naturally occurring amino acid
RPGSVSLADLLKKRLXEEGRKPYVIPVGGSNSLGTWGYIEAVREQDQQ

SEQ ID NO: 70291 - protein, 220 aa, Gossypium hirsutum
MDADTWSVRLSSASKRYQSSLESRSNMLMGFEEIDEEDDIREEFPCPFCSEYFDIVGLCCHIDDEHPVEAKNGVCPVCALRVGVDMVAHITLQHGHIVKMQRKRKSRKGGSHSTLSLLKEELREGNLQTLLGGSSCIVSSSNSAPDPLLSLFILPMVDDFVSDQPPFRTETSRNNKSSDMNKSERTTQSSPLSVKDQEEKAKRCACVQGLLLSTIVDDIL

SEQ ID NO: 70292 - protein, 427 aa, Saccharomyces cerevisiae
MRKCKIFVGNSHPELGNMVCQRLGIEPAPCTLKKFANGETSVQIGVSVRDEDVYVIQSGSPSINDDIMELLILVSACRGGSARKITAVIPQFPYSKQCKMKRHRGAITARMLANLLVMAGADHVVSMDLHASQMQGFFTKPVDNLYGGPSLAKWIRENVEDYEDAVVVSKNPGGTKRVTALADSLKINFAMIHTDRRRSKDLYSQNKDLQQLKLRKQSMLRKNRPIIRQGDHPNEEENIILSNGIQTARIRNGHVIGDDEADDDEDAILESDSELHSIDGLDSHGLGGTYDAVDSEDEEEIPVLYREQLITLVGNVRGRSAIILDDMIDRPGSFISAAEHLVQNCGAKKVYVVATHGIFTGDCLEELEKSDAIDTIVVTNTYPISGERIAGSKKLVTIDVSPIFAECIRRDHYGESISVLFDSLAAL

SEQ ID NO: 70293 - protein, 245 aa, Neisseria meningitidis FAM18
MALQDRTGQKVPSVVFRTRVGDTWKDVSTDDLFKGKKVVVFSLPGAFTPTCSSSHLPRYNELFGAFKENGVDAIYCVSVNDTFVMNAWAAEEESDNIYMIPDGNGEFTEGMGMLVGKEDLGFGKRSWRYSMLVNDGVVEKMFIEPEEPGDPFKVSDADTMLKFVAPDWKAQESVAIFTKPGCQFCAKAKQALQDKGLSYEEIVLGKDATVTSVRAITGKMTAPQVFIGGKYIGGSEDLEAYLAKN

SEQ ID NO: 70294 - protein, 250 aa, Physcomitrella patens subsp. patens
MEAINCSRYGWMYFAMLLSILSVGARANTNKVYSPCMDATVHKNDGFTFGLAFASNKSFFYNKIQLSPCDSRLAEKLREHKISLFRPQVDEVTLLLVNHTEINPENVEGGGFAVAYAGKKHAVVSAPHFLANSSYRITSLSLVLNFEQGRLQNILWKNDGCKSCLGNSSFACVRGECAIQSTACIEAGGRVDCSLSIQLTWSGTDQRQEVLNSWYQMSNLNQYSLYGLYSNLKSTLTDRFSNMIRFAKSP

SEQ ID NO: 70295 - protein, 335 aa, Mannheimia succiniciproducens MBEL55E
MMRSLVCKEPFHLILEERAKPQPKDEEVQLKVAAIGICGTDIHAYAGNQPFFEYPRVLGHEASGVITELGKNVDKFKVGQRVALIPYVSCGKCGACLSGKTNCCENISVIGVHQDGAFSEYLTAPAKNILPIADSVDFTTAALIEPFAISAHAVRRAQITKGDDVLIVGAGPIGLGAAAIAHADGANVVIADTSEERRKHIQANIPVPTVNPINEKVEDYFNGRLPQIVIDATGNQKAMNNAVNLIRHGGRIVFVGLHKGTIEFSDPDFHKKETTLMGSRNATLEDFEKVQHLMSERKISANMMLTHTFKYDELAEIYEEKITKNQSLIKSVVLY

SEQ ID NO: 70296 - protein, 297 aa, Yersinia pseudotuberculosis IP 32953
MTTLEHCIGHTPLVKLQRLSQGLNAEIWVKLEGNNPAGSVKDRAALAMIQQAELRGDIAPGDVLIEATSGNTGIALAMIAAMKGYHLKLLMPENMSQERQAAMRAYGAELILVSREQGMEGARDLALTMQENGEGNVLDQFNNADNPYAHFTGTGPEIWQQTAGKVSHFVSSMGTTGTITGVSQYLKSQNPQVKVIGLQPAEGSSIPGIRRWSAEYIPGIFRPELVDQVLDITQSVAEQTMRRLAKEEGIFCGVSSGGAVAGALRIAVDNPDAVIVAIICDRGDRYLSTGVFLSKGG

SEQ ID NO: 70297 - protein, 248 aa, Nocardia farcinica IFM 10152
MGVLDGKVALITGGARGMGAEHARQFVAEGARVVFGDVRDEEGEALAAELGDDAHYVHHDVTSESEWSEVVAATIDRFGKLDILVNNAGINRFAPICEQSLDEFRLILDTNLTSTWLGIRAAAPVMSDGGSIVNMSSVEGYAGAAGLSAYAASKFGIRGLTKVAARELGSRNIRVNSVHPGGIATPMNTEFAPNLDPDKPFVPSLPIARWGRAAEVTHVVVFLASDAASYCTGSEVLVDGGLLAGPGY

SEQ ID NO: 70298 - protein, 135 aa, Brassica napus
TSLRDESWYVGKLRHNRLANLIGYCCDGDERLLVAEFMPNDTLAKHLFHWENQTIEWAMRLRVGYYIAEALDYCSTEGLPLYHDLNAYRVLFDEDGDPRLSCFGLMKNSRDGKSYSTNLAYTPPEYLRNGRVTPE

SEQ ID NO: 70299 - protein, 306 aa, Triticum aestivum
  misc_feature (68)..(68): Xaa can be any naturally occurring amino acid
MGKKAIRYAVVDAFAAEPFKGNPAAVCLLEEEGASATVDDRWMQSVAAEFNLSETAFLARDSSGAAGXQAPRFHLRWFTPVTEVDLCGHATLASAHFLFTTVLPEHGKLEFMTRSGILTAKKVPAPGSTGVPGEEQGKLFIELDFPMIGFLECNEMLSIPETLNGAPIVSVHKSATDGDLIVGLSSGKEVADILASIDEIKNLACTGLPTATSLGLIFTGPAPAGSGYDFFTRFFCPKFGIDEDPVTGGTHCVLAPYWGRKLGKQKMTAFQASPRGGTLYLQLDDANQRVQIQGEALTVMDGTLLA

SEQ ID NO: 70300 - protein, 461 aa, Salmonella typhimurium
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWEGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 70301 - protein, 397 aa, Shewanella sp. MR-4
MIFSQVVLAPADPILGLTDTFKADPRQDKVNLGVGIYKDEAGQTPVLQSVKKAEALLLEQEKTKNYLGIEGVQTYNRVVQELLFGEGSTLVTSGRAATAQAPGGTGALRIAAEFLLRNTPSRTVWVSNPTWANHQNIFETAGLTVKEYGYYNASAHDIDFDGMMTDLANAQAGDIVLLHGCCHNPTGIDLTLAQWELVANLCADKQLVPLFDFAYQGFGAGIEEDAAGLRLVAAKVPELLVANSFSKNFGLYNERIGAVTVVAQNADEAVRAFSQVKRTIRANYSNPPAHGALIVSTILSDAALKALWVQELTEMRERIAEMRTLFVQSLKDEGVTQDFSFISRQNGMFSFSGLNKAQVARLKDEFGIYIVGSGRISVAGMTKTNMPVICKAIAQVL

SEQ ID NO: 70302 - protein, 323 aa, Geobacillus kaustophilus HTA426
MTKRKVVLLTTGGTIASKRNERSGRLRAGALSGEELAAMCHLPKEIEIIVESVFQLPSMHLTFSHWLELKKRIEAHFTDPSVDGIVVTHGTDALEETAYFLDLTIDDPRTIVVTGSQRAPSDLGSDVYINIRHAIYAACAESLRGAGAVVVFNERIFAAKYVKKEHASNIQGFNAFGFGYLGIIDNDEVYVYQKPIRREYYKLVRPLPPVDIVKCYLEADGKFIKAARESGVAGIVLEGVGRGQVAPKMVDEIVKAIEAGIKVVVTTSAEEGAVYTTYDYPGSAYDLHKKGVILGSDYDAKKARIKLAVALAADAAVDGLFAY

SEQ ID NO: 70303 - protein, 176 aa, Gossypium hirsutum
LFSFILILTHFLLKSSIRIQVLGWICVAISVSVFAAPLNIMARVVRTKSVEFMPFTLSFFLTLSAVMWFAYGLFIKDLCVALPNVLGFILGMLQMLLYAIHRHSEKVNIEEKKLPAEQMKSINVVLTTLGASEVHPVVLDIHTDDTKEEDNKNNEPTGEPDKQTDVKMEDANESPV

SEQ ID NO: 70304 - protein, 367 aa, Pseudomonas fluorescens Pf-5
MNQIAPRRFSGLRIVLLVLLAVLAFLLLMPTRVQPVAWNPAPAPSLSQGPFAENQKLKAVQPVGARDIDGPEALLLEHEQLLSGLHDGRVIQSSLDGSALKVLVNTGGRPLGLARHPDGRLIIADAIKGLLALDSQGQLQTLSTEANGLKFGFTDDVAVDAAGRYAYFSDATSRWGYGHDGEAVIEHGADGRLLRYDFQSGTTEVLLDRLEFANGIALGPDEAYVLVNETGAYRISRYWLKGDKAGSHDLFIDNLPGLPDNLSFNGAGRFWVALYAPRNPLLDATAPYPFVRKMLVRAMTVLPKPVEKRGFVLGLDTQGRVIANLQDGSSGNYSPITTVREYGDALYLGSLTARHMARLSLKEALAP

SEQ ID NO: 70305 - protein, 450 aa, Mesorhizobium sp. BNC1
MAQRHYEDGIVSGRFSPEDYAQNFSDLHPALDTHEARVEADRCYFCYDAPCMRACPTTIDIPLFIRQISTGNPLGAARTIFDQNIFGGMCARVCPTETLCEEACVREHAEGKPVQIGRLQRFATDAAMARGKRFYTRAAASGKKVAVVGAGPAGLACAHRLAMYGHEVTVYEARPKPGGLNEYGIAAYKTPGGFAQAEVDYILSIGGITIEHGKALGRDFTLAGLAAGSDAVFLAMGLAGVNALRCEGEEADGVENAVDYIATLRQADDLSKLPIGGRVVVIGGGMTAIDAAIQSRLLGAEEVTICYRRGKEHMNASEWEQELAAAKGVTIRHWMQPRRVIAEANRVSGIEMEYTAIVDGRLIGTGDTLILKADQIFKAIGQSFDPAVLNGGGDAIVFEKDRIRVDGEGRTSMPKVWAGGDCILGGDDLTVSAVAQGRDAAESIHRSLIA

SEQ ID NO: 70306 - protein, 333 aa, Marinobacter sp. ELB17
MKLSLLESKTWLITGVAGFIGSNLLEHLLKLNQNVVGLDNFATGHKHNLDEVQSLVTLEQWSRFSFTEGDIRNEKDCAKACGGVDYVLHQAALGSVPRSINDPVTTSAVNITGFLNMLVAARAAGVKSFTYAASSSTYGDHPALPKVEDNIGKPLSPYAVTKYVNELYADVFAITYGFKTIGLRYFNVFGKRQDPKGAYAAVIPKWTEAMLCGDNVFINGDGETSRDFCFIENAVQANLLAATADEAVKNEVYNVAVGDRTTLNILFDSLKEALAENGVVYEKAPVYRDFRPGDVRHSQADISKAASKLGYAPEYRIVEGISKAMPWYLAYRL

SEQ ID NO: 70307 - protein, 237 aa, Physcomitrella patens subsp. patens
MSMVFAPRLAESAPTSHVGASWSPYDNNGGTCVAIAGADYCVIAADTRMSTGFSILTRDYSKIHHITEKCVLASSGFQADVRSLQKNLDARHQIYQHQHSKQMSCPAMAQLLSNTLYYKRFFPYYSFNVLGGLDNEGKGCVYTYDAVGSYERSGYSSQGSGQTLIMPVLDNQLKSASPLVLPPRESSTPLTESEAVDLIKDTFASAAERDIYTGDGVEIVIINKEGIRRETMALKRD

SEQ ID NO: 70308 - protein, 413 aa, Neisseria meningitidis FAM18
MIIDVKVPMLSESVSEGTLLEWKKKVGEAVARDEILIDIETDKVVLEVPSPQAGVLVEIVAQDGETVVADQVLARIDTAATAAAEAPAAATAAAEAPAAATAAAEAPAAAPAEAAPAAAPAAAQNNAAMPAAAKLAAESGVDVNALQGSGRDGRVLKEDVQNAAAKPAAAAAPAVALPAGARPEERVPMSRLRARVAERLLASQQENAILTTFNEVNMKPIMDLRAKYKEKFEKEHGVKLGFMSFFVKAAVAALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPARLLLDL

SEQ ID NO: 70309 - protein, 135 aa, Zea mays
  misc_feature (16)..(16): Xaa can be any naturally occurring amino acid
  misc_feature (63)..(63): Xaa can be any naturally occurring amino acid
  misc_feature (74)..(74): Xaa can be any naturally occurring amino acid
MLAYCGIYPDEVINNXAPHIGTPDKGILAANVSTDTIDKSLSTITAHNVEENRRALRELLFCXPGALQYISVCXILFQHTLYQNTRDGTPFVDVLKEGGDLPDIKVDKGTIVVVDTDKETTTQGHDDLDKRCAKD

SEQ ID NO: 70310 - protein, 477 aa, Neisseria meningitidis FAM18
MSQYDVVVIGAGPGGYVAAIRAAQLGFKTACVDAGVNKAGNAPALGGTCLNVGCIPSKALLQSSEHFHAAQHEFAEHGITVGDVKFDVAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALEFFASSEDIARIIHAHPTLSEVVHEAALAADKRALHG

SEQ ID NO: 70311 - protein, 234 aa, Physcomitrella patens subsp. patens
MESTLTRAWAATSFSALKTASVSASPRMLSSTAFFLGTSVKLNGGLSSWQAGSQCRGIPCPKRLNQRLQVSAAIKEVTGSLMKGEGLKFGVVVGRFNEVITRPLLAGALDAFHRYQVREEDIDVIWVPGSFEIPVVAQQLALSKKYHSILCIGAVVRGATTHYDAVANSAASGIMSASLKSNVPCIFGVLTTENMEQAIDRAGGKAGNKGAEAAITALEMASLFQHHLGGGISD

SEQ ID NO: 70312 - protein, 420 aa, Marinobacter sp. ELB17
MKKIAVIGLGYVGLPLAVAFGKKRQVVGFDINTKRIAELKNGKDYTREVSLAELAAAPQLSFTDSLDDIADCTVFIVTVPTPIDDFKTPDLTPLVKASESVGKVLKAGDIVIYESTVYPGATEEVCVPVLERVSGLRFNADFYAGYSPERINPGDKEHRVTTIMKVTSGSTPAIAEEVDALYADIITAGTHKASSIKVAEAAKVIENTQRDLNIALMNELAMIFARLGIDTHEVLAAAGTKWNFMPFKPGLVGGHCIGVDPYYLTHKAQAVGYHPEIILAGRRVNDGMGAYVASGLVKSMIKAGHTVANARVLIMGFAFKENCPDLRNTRVIDVVKELKEFGCQVDITDCWADSAQAEHEYGISLTEQPRKSCYDGVILAVPHREYAEMSASDLRGYLTEGGVLYDLKGVLPLGEADLRL

SEQ ID NO: 70313 - protein, 309 aa, Triticum aestivum
MAEAPAASRRAEEAGSRRRADDEAEAAAAADGDGDSSVYTSEDEGTEDYRRGGYHAVRPGDTFKQGAYVVQSKLGWGHFSTVWLAWDTAHSTYVALKVQKSAQHYTEAAMDEIKILRQIADGDPEDSRCVVKLLDHFKHSGPNGSHVCMVFEFLGDNLLTLIKYTDYRGIPLPMVKEICRHVLIGLDYLHRELSIIHTDLKPENILLVSTIDPSKDPRKSGVPLVPPAARAIEPPPRAPAAPSASSGLTRNQKKKIRKKAKRVAASTSEGNGAVAAVDTDESDDKGDLSTANEGSPSEDGDRKRGGGHR

SEQ ID NO: 70314 - protein, 381 aa, Shewanella sp. ANA-3
MSNPAQRATKLFVQTFGTKADDLYQAPGRVNLIGEYTDYNDGFVLPAAINFHTVIAVKRREDNKFRAVADAFPGQIKEWSFGKDTEINPEDGWVNYLKGLTVAMANTGLIAKGLDLAVVGDVPLAAGLSSSGALVVAFGTAISDSSQLHLSPMAVAQLAQRGEYRYVSSACSIMDHMVCAMGEPDHALLIDCLDLDSEPIAIPENLSLIIIDAHIEKQRLAAINQQRREECAQAADFFGLDALRHLDQRQLESAKDQLDDTLYRRAKHVVTENKRTQSAARALEQNNLSKFSLLMAQSHQSLRDDFEVTLPEFDTLVDIVSQVIGERGGIRMTDGCVVALVDHELTDAVVSAVEHAFYEQTGIDATVYLCSASAGAGRIDS

SEQ ID NO: 70315 - protein, 350 aa, Coccidioides immitis RS
MTALPEPFASIPRKALLLEPSPIHLLPNMTADLGGAVKIYAKRDDLNSGLAYGGNKTRKLEYLVADALATKCDTLISIGGIQSNHTRQVAAAAAHAGLKAKLVQEKWVEWSDPGYESVGNIQLSRLMGADVRIERMAGFGIEHKDSLKNLLKECEDKGEKPYYIPAGASDHPLGGLGFARWAFEVREQEQQMGITFDNIVVCAVTGSTMAGMVAGFKLIEKLYPDEPKKKVIGIDASATPAETRAQVLRIAKNTGEKIGLEPEDITASDIMIDERYHAGTYGVPDKQTWDAIEYGARMEAFITDPVYEGKSLAGLIDMVRKGEISGGNVLYAHLGGQLALNAYSQIGTVA

SEQ ID NO: 70316 - protein, 309 aa, Oceanobacillus iheyensis HTE831
MAIYESIQQLIGNTPLLRINEMDIPNNVHLYAKLEFLNPGGSVKDRLGQYLIDKAWEQGFLREGSTIIEPTAGNTGIGLALAARTKKLSVIFCVPEQFSVEKQQIMRALGATIIHTPKEKGMMGAIEKAEQLVEEIPNSYSPQQFSNKFNPMTYYETMAPEIWSDLQGDIDIFVAGAGSGGTFTGCASYFKERKNSIHNVIVEPVGSILGGGEAGPHLTEGIGMEFIPEYMNQSFMDEVQTISDKEAFSMVEELARKEGLLVGSSSGSAMVAALNKAREARSGTTIVTILPDGSDRYLSKQIYNVSKQL

SEQ ID NO: 70317 - protein, 332 aa, Shewanella sp. ANA-3
MSELPHDYTHIYLEQPGEPEVMQLTRSPLPVPSAGQVLIRNRAAGVNGPDIKQRMGVYPPPPGASPIIGLEVAGEICALGEGVTQWQLGDKVCALVPGGGYGEYSLTYAEHCLPIPKGFSEVQAAALPETFFTVWGNLFMRAGLKAGETVLVHGGSGGIGSTAISLAKHLGATVIATTGQDAKRDYCAGLGAHLVVNYNTQNFVEEVMAFTQGKGVNVVFDIAGGDFINLNLQALALDGRMVSVSTQRSGKAEVSILQLMAKRIVWTGSTLRPQSVAAKAEIAKQLRERVWPLLDSQQIVPHICATFPLAEAAKAHALMQSGEHRGKVVLTL

SEQ ID NO: 70318 - protein, 336 aa, Shewanella sp. MR-4
MTIRVAINGYGRIGRNVLRALYESEKAYPIKIVAINDLGDASINAHLTKYDSVHGRFNAKVEHDAEAIYVNGDKILTFQERDPGKLPWGDLQVDVVFECTGIFTSKESVQPHLAAGAKKVIISAPGKNVDATVVYGVNNNVLTADMTVISNASCTTNCLAPFAKPLNDEIGIESGLMTTIHAYTNDQRLSDVYHTDLRRARAAALSMIPTKTGAAAAVGLVVPELQGKFDGLAVRVPTVNVSLVDLSFIAARDTTVEEVNAIIERAAAVAPLSEVLAVNKEPLVSIDFNHNAFSSNFDATQTRVNGRLVKVMAWYDNEWGFSNRMLDNAVALMNAK

SEQ ID NO: 70319 - protein, 531 aa, Shewanella sp. MR-4
MIKDFILPDIGEGVVECELVEWLVQEGDTIAEDQPIADVMTDKALVQIPAPFAGVVTKLYYAKGDIAKVHAPLYAVQIESDEAAPVAASQPEVQASTQTPASQSSAVGTSVEEFLLPDIGEGIVECELVEWLVQEGDTVVEDQPIADVMTDKALVQIPAIKAGKIVKLHYRKGQLAKVHAPLFAIEVEGGVSAPVSHAQEASAAAVNTAAPAACAAVSSEPARQGKALASPAVRRMARALDIDLSRVPGSGKHGRVYKEDITRFQAQGGAVPAAALVVAAPTVAQSTVSTAVASAARGDIVEPIRGVKAVMAKMMVESVSTIPHFTYCEEFDLTDLVALRESMKAKYSSDEVKLTMMPFFMKAMSLALTQFPVLNSQVNADCTEITYKARHNIGMAVDSKVGLLVPNVKDVQDKSILEVAAEITRLTNAARSGRVAPADLKEGTISISNIGALGGTVATPIINKPEVAIVALGKLQTLPRFNAKGEVEARQIMQVSWSGDHRVIDGGTIARFCNLWKQYLEQPQDMLLAMR

SEQ ID NO: 70320 - protein, 335 aa, Novosphingobium aromaticivorans DSM 12444
MRAAVMQGLHKPLAIDTIPDPTPGEGDVVVKVGRCGICGSDLHMTEDPAYGQGAGSVLGHEFAGEVVALGKGVEGLRTGDLVSVIPLQSCGQCHSCRTGEVQWCERFGLQGGGYAEFALTRPNQCVRLPASASMADGAIVEPLAVALHGLALSRMKIGDKVLVLGAGPIGLAVAFWARRFGAGRVVVQDLAEWQRDRALQMGAHDFVVDAADPVGSAGRALGGKADIVFECVGVPGLIAQAVEQVRNDGTITLLGLCTRPDTFNSFAMLSKQVKLVTSAFFTRQEYEAALDALVRGAVEPRLLVTDTISLDATPDVFESLRKRTHQCKVLINPGE

SEQ ID NO: 70321 - protein, 607 aa, Pseudomonas fluorescens Pf-5
MPHEGNLLQAAVVFLCAAVLIVPLAKRLQLGAVLGYLLAGVLIGPSVLGLVGNPQSVSHISELGVVLLLFIIGLELSPKRLWVMRKAVFGVGLAQVLLTGMLIGVVALFLFGQSLNSAIVLGLGLALSSTALGLQSLAERKELNSPHGRMAFAILLFQDIAAIPLIAMVPVLAGGDHHTSSAEDLRHGLQVLGSIAVVVVGGRYLLRPVFRIVAKTRLPEVSTATALLVVIGTAWLMDLVGVSMALGAFLAGLLLADSEYRHELEAQIEPFKGLLLGLFFISVGMGANISLLLSAPIAVLGLTLLLIALKLPLLFVVGRLAGGLGRESAVRLGVVLAAGGEFAFVVFKIGRDQGLFEPRLYDLLVLTITLSMALTPLLLLACTRWLKPKAKPVEMPAEYRRIDSDGPRVVIAGMGRMGQIVARILRAQKVPFVALDTSVETIELIRSFGGMPVFYGDPLRPEILSAAKVGEAEYFVIATDDPETNIKTAEQVSRLYPHLKIIARARNRQHVHRLVDLGAQAVRETYYSSLEMSRRTLVGLGLSQAQADSRIQRFTQHDEQLLAAQHAVYDDAAKVLQSAQEARAELARLFEADEQDEQIESPLPPMR

SEQ ID NO: 70322 - protein, 423 aa, Geobacillus kaustophilus HTA426
MAADKHTEEKEQQYDVLASTQIVIHRALEKLGYPEEVYELLKEPIRVLTVRIPVRMDDGSVKIFTGYRAQHNDAVGPTKGGVRFHPDVTEREVKALSIWMSLKCGIVDLPYGGGKGGIVCDPRTMSFRELERLSRGYVRAISQIVGPTKDIPAPDVFTNSQIMAWMMDEYSRIREFDSPGFITGKPLVLGGSHGRETATAKGVTICIREAAKKRGLSLKGARVVVQGFGNAGSYLAKFMHDAGAKVVGISDVYGALYDPNGLDIDYLLERRDSFGTVTKLFKNTISNQELLELDCDILVPAAIENQITAENAPRIKASIVVEAANGPTTLEATEILTQRGILLVPDVLASAGGVTVSYFEWVQNNQGYYWTEEEVEQRLEKVMVKAFNNVYEMAQTRRVDMRLAAYMVGVRKMAEACRFRGWV

SEQ ID NO: 70323 - protein, 458 aa, Novosphingobium aromaticivorans DSM 12444
MNGINANRPHLPLARILEMNLGFLGLQFSFGLQQGNMGPIYSYLGADESQLPMLQLAGPITGLLVQPIIGAMSDRTASRWGRRTPYFLIGAVLCAFGLFFMPLSSSILMAMSLLWILDAGNNITMEPYRAYVSDRLNPEQRQAGFLSQSAFTGLAQMLAFLTPSLLVGLGMNQDWVDSHGIPYTVRIVFMIGAVLSLSTILWSVLRVPELPLTPQERAHIQAQPKGAWATLREIGEAIADMPVAMRKLGLMSLFQWVGMSGYWTYAVYSISRTVYGTSDVHSSAFHTAVLTNGEVAAFYNAISFVTAFAMVPLVRRLGPGPLHALCLFAGGVGMFLLPNVTDKALLFLPAIGIGLAWGSIMGNPYAILTNSIPPQRTGVYMGIFNMMIVIPMLIFAVVMSRLDLGFVSLGFDAYKQVLGGDPRNMLMFCGASLVLAGFSVLWVREGRAGAMPQSAVPA

SEQ ID NO: 70324 - protein, 159 aa, Shewanella oneidensis MR-1
MKIRIGHGFDVHKFGEPRPLILCGVEVPYETGLVAHSDGDVVLHAISDAILGAMALGDIGKHFPDTDAAYKGADSRVLLRHCYALAKAKGFELGNLDVTIIAQAPKMAPHIEDMRQVLAADLNADVADINVKATTTEKLGFTGRKEGIAVEAVVLLSRQ

SEQ ID NO: 70325 - protein, 164 aa, Suaeda salsa
MAVFNGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAGQSRAD

SEQ ID NO: 70326 - protein, 270 aa, Burkholderia sp. 383
MKIAFIGGGNMAAALIGGLIKRGVAADGLYAIDVNEEVRARAAQQFGVHTGAAIDATLADYDAVVLAVKPQVLKDVAQALAPHLKSQLVISIAAGIRGTDLARWLGGYDRIVRTMPNTPALVGMGVTGLTALPGVDAAGRELASNVLGAVGEIVWFDDESKLDAVTAISGSGPAYVFYFIEALQEAARQLGMNDEQGRALAVATFTGAAQLAAQSGEPASVLRERVTSKGGTTAAALASFDAQGVKDAIVRGALAAEARAKEMGDELGRA

SEQ ID NO: 70327 - protein, 257 aa, Burkholderia sp. 383
MGGSMRRVPRRIHTMPASVPASVPVMSDLAARLESVHQRIADAARAAGRDPATVSLLAVSKTFPADDVRAAHAAGQRAFGENYVQESIDKIDALADLRADLEWHFIGPLQSNKTRPVAERFDWVHSVDRLKIAQRLSEQRPAHLPPLNVCVQVNISGEASKSGVAPGDVAEVARAVAALPSLRLRGLMAIPEPAGDTEAQRAPHRALRALFDTLRADGLPLDTLSMGMSADLDAAVLEGATIVRVGTAIFGARDYSH

SEQ ID NO: 70328 - protein, 486 aa, Yersinia pestis KIM
MALRLVTGVILQTGVFLMSKQQIGVVGMAVMGRNLALNIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEDGNYLVDVILDEAANKGTGKWTSQSSLDLGEPLTLITESVFARYLSSLKDQRVAASKVLTGPKVQPFTGDKAEFIEKIRRALYLGKIVSYAQGFSQLKAASNENNWDLNYGEIAKIFRAGCIIRAQFLQKITDAYAENADIANLLLAPYFKQIADEYQQALRDVVSYAVQNGIPTPTFSAAINYYDSYRSAVLPANLIQAQRDYFGAHTYKRTDKEGVFHTEWMA

SEQ ID NO: 70329 - protein, 594 aa, Triticum aestivum
  misc_feature (226)..(226): Xaa can be any naturally occurring amino acid
  misc_feature (473)..(473): Xaa can be any naturally occurring amino acid
  misc_feature (506)..(506): Xaa can be any naturally occurring amino acid
MVSDASKKKAAQKKAAAAAKRGAKSSAAASSSSASSAADKAANGIAALNLSDRTCTGVLASHPLSRDIHIESLSLTFHGHDLIVDSELELNYGRRYGLLGLNGCGKSTLLTAIGCRELPIPEHMDIHHLTREIEASDMSALQAVICCDEERVKLEKEAEILAAQDDGGGEALDLVYERLEAMDASTAEKRAAEILFGLGFDKQMQAKPTRDFSGGWRMRIALARAXLFMNPTILLLDEPTNHLDLEACVWLEEKLKNFERILVVISHSQDFLNGVCTNIIHMQNKTLKLYTGNYDQYVQTRSELEENQMKQYKWEQEQIANMKEYIARFGHGSAKLARQAQSKEKTLAKMERGGLAEKVVNDRILVFRFTDVGKLPPPVLQFADVTFGYTPDNLIYKNLDFGVDLDSRVALVGPNGAGKSTLLKLMTGDLSPLDGMVRRHNHLRIAQFHQHLTEKLDLDMPALQYMMREYPGXNEEEKMRAAIGNLGLSGKAQVMPMKNLSDGQKXRVIFAWLAFRQPQMLLLDEPTNHLDIETIDSLAEALKEWDGGLVLVSHDFRLINQVAQEIWVCENQAVTRWEGDIMDFKQHLKKRAGL

SEQ ID NO: 70330 - protein, 388 aa, Neisseria meningitidis FAM18
MNLHEYQAKELLAGYGLPVQGGILAHNGEEAAAAYDKLGGKFAVVKAQVHAGGRGKAGGVKVVKSREEAKEVAESLIGTNLVTYQTDANGQPVNSVLVCEDMYPVQTELYLGAVVDRSTRRITFMASTEGGVEIEKVAAETPEKIFKVTVDPLVGLQPCQAREVAFQLGLKDKQINEFVKLMTGAYKAFVENDFALFEVNPLAVRENGALACVDGKIGIDSNALYRLPKIAELRDKSQENERELKASEFDLNYVALEGNIGCMVNGAGLAMATMDIIKLKGGQPANFLDVGGGATKDRVVEAFKLILEDKSVQGVLINIFGGIVRCDMIAEAIVAAVKEINVDVPVVVRLEGNNAELGAKILNESGLKLTSADGLNDAAEKIVAAVNA

SEQ ID NO: 70331 - protein, 600 aa, Polaromonas sp. JS666
MTFSVHGLAVSRGIAIGRAVLVASSRADVAHYFVDPARVVEEITRARVARNAVAEEITRLQQELPPDAPHELAALLDVHLMLLQDEQLISGVKHWITERHYNAEWALATQYEIIARQFDDMEDEYLRERKADLEQVVERILRYMKGVASPVQPVGPAGAGRKLSQGLLLDDTMDVPLVLIAHDISPADMLQFKKSLFAGFATDVGGKTSHTAIVARSMDIPAVVGARSASQLIEQDDWVIIDGDAGVLIVDPSPIILAEYGFKQRQGELERERLNRLKHTPAVTIDGQRVELLANIEMPEDTVGAVNAGAVGVGLFRSEFLFMGRSGDLPDEEEQYQAYRKAVEGMHGLPVTIRTVDVGSDKPLDRIDKAQDSHLNPALGLRAIRWSLADPPMFLTQLRAILRAAAHGQVNLLVPMLAHGTEIRQTMAMIDHARATLDNKGTPYGPVRLGAMIEIPAAALSLKLFLKYFDFLSIGTNDLIQYTLAIDRADESVAHLYDPCHPAVLRLVADTIAECNAQGKGVSVCGEMAGDVSMTRLLLGLGLRSFSMHPSRILAVKQQILRADAGKLSVWAAQVLDAEDPAALINPASAPMPSPVPANA

SEQ ID NO: 70332 - protein, 308 aa, Rhizobium leguminosarum bv. trifolii
MILCCGEALIDMLPRDTTLGEKGFAPYAGGAIFNTAIALGRLGIPTAFFTGIADDMMGEILLETLKASNVDYSPCAITPRPSTIAFVKLVNGQATYAFYDEGTAGRMITTADLPVLGDDCEALHFGAISLIPSPCGETYEALLDREAASRVISLDPNIRPGFIKDKSSHMARIKRMAAKADIVKFSDEDLEWFGLQGDHDALAAHWLNHGAKLVVITKGAEGASGYTKDRKVTVPSQRVTVVDTVGAGDTFDAGILASLKMDGLLTKPQVASLDEKALQNALTLGAKAAAVTVSRAGANPPWAREIGL

SEQ ID NO: 70333 - protein, 471 aa, Zea mays
  misc_feature (265)..(265): Xaa can be any naturally occurring amino acid
YLTILVGTWNQLLEDPAGKKESPCARWLRRQQATWARRRWRYPWRWRTATTTRRRGTMWTASAHIITAVIGAGVLSLAWAMAQLGWAAGTAMMLLFAGISYYTSTLLAECYRCGEPGTGKRNYTYTEAVRAILGGAKFKLCGVIQYANLVGIAVGYTIAASISMLAIKRADCFHDRGHRNPCRSSSNPYMILFGAVEIVFSQIPDFDQIWWLSIVAAAMSFTYATIGLALGIAQTVANGGFKGSLTGVNVGDGITPMQKDTIKAXPPPSEVTVMKKATMVSVATTTVFYMLCGCMGYAAFGDDAPDNLLTGFGFYEPFWLLDVANAAIVVHLVGAYQVFCQPLFAFVEKRAAARWPDSRFMTRELRLGPFVLGVFRLTWRTAFVCLTTVVAMMLPFFGDVVGLLGAVSFWPLSVYFPVEMYKAQRRVRRWSTRWLCLQTLSAVCLLVSIAGAVGSTAGVINAVNLHRPFSG

SEQ ID NO: 70334 - protein, 526 aa, Chlamydomonas reinhardtii
MARSTYDDFIIKEKIGSGSYGVVFKVVRKVDKHVYAMKEIDLQGMSRKEQEECIRETRVLSSLDSDFIIRYYDSFLEKGKLYIITEYAANGNLHDYIKKQKSRLTEDLIWKLYIQILLGLNHMHSKKILHRDIKTLNVFLDEDLNVKLGDMGVAKILSTNTVFAKTIVGTPYYLSPELCEDKPYNEKSDVWALGVVLYECCTQRHPFDADNQGALILKILRGKFPPVSGYSPDICDLIKRCLTQNANRRPNTYKLLLLPSIRQKGEELGISLPDQASLALMADKNMANAGAAGKAARPKTPQGDMNAPPEVAGTSAGDDKAFVFGSTIRADGAGARPVDVSVSAVEATSGEGAAPGAAPVPVQAAWAVDDAKPKVNRPPAWGLAQQMEELAVDDGEDEDEGKNPYLGVGGDDDEDDDGEGDDDDDYDDNGEYGDEPGEGEPGWSADPTRIAHMKSAMMIQRAACLDLVGEKPSTSCEYALLKSNQVDEASMTDLSRLVFKIIPYDKSEVIQMMYKLLYLESQLEGQ

SEQ ID NO: 70335 - protein, 190 aa, Rickettsia akari str. Hartford
MFIQTEDTPNPDAIKFFPGQEISSDQPVFFSELAEVKGRSKLAESLFHINNVKSIFFGSDFITVTKQAEGNWQIIKPEVLMIIMDHFVAGFPVFEESTKADTVNHNIDGFSEIEKQIIEIIETRVRPSVAQDGGDIIYKGFENGVVKLALRGACRGCPSSTITLKNGIESMLKHFVPEVQEVEAVEEDFE

SEQ ID NO: 70336 - protein, 420 aa, Arabidopsis thaliana
MAASVQPACLDLHFSGKHPPLLKHNAIIVRCVSSPNVIPEADSISGPPDIINTNRDQRKVVRIAWEKLVRWSRSLRAKAKTDVLERTRKVVVLGGGSFGTAMAAHVARRKEGLEVNMLVRDSFVCQSINENHHNCKYFPEHKLPENVIATTDAKAALLDADYCLHAVPVQFSSSFLEGIADYVDPGLPFISLSKGLELNTLRMMSQIIPIALKNPRQPFVALSGPSFALELMNNLPTAMVVASKDKKLANAVQQLLASSYLRINTSSDVTGVEIAGALKNVLAIAAGIVDGMNLGNNSMAALVSQGCSEIRWLATKMGAKPTTITGLSGTGDIMLTCFVNLSRNRTVGVRLGSGETLDDILTSMNQVAEGVATAGAVIALAQKYNVKLPVLTAVAKIIDNELTPTKAVLELMNLPQIEEV

SEQ ID NO: 70337 - protein, 447 aa, Gluconacetobacter xylinus
MRIAMIGGGYVGLVSGTCFAEFGTDVAIVETNPDRLAALREGRIPIYEPGLDRLVAENVEAGRLTFGDDMAAAVKGADAVFVAVGTPSRRGDGQADTSYVYAAVEQVARVAEGYTLIVTKSTVPVGTGREIAKIVHATRPDLDFDVASNPEFLREGNAIVDFMKPDRVIIGTDQSKPGGTERAQNILRKLYRPLYLLERPIVFTGLETAELIKYAANSFLAMKITFINEISDLCEKVGADVNDVARSIGLDGRIGKKFLHPSPGFGGSCFPKDTRALTAIGRNAGSPVRLIETTVAVNELRMKAMGERVIALAGGDVKGLTIGVLGLTFKPETDDMREAASIVVLDQLDKAGAQIRAFDPAGMETARPVLPQGVTYCKDALDAATGADILVVLTEWNEFRSLSPEKLKTRMTGRKVADLRNIWDPESLKEAGFDYISLGRPDMVHTA

SEQ ID NO: 70338 - protein, 492 aa, Gluconacetobacter xylinus
MTFMTATDVTVPNPETALPPITPIVLSGGTGTRLWPVSRASHPKQFWALASKQTMIGETLQRAMGEAFAPPIVVCNQAHRFLVAEQLRENGCENGRIILEPAVRNTAAAIAAAALVAAQDNPETLLWIMAADAAFRYPERLPAVLEKAAKVAREGYIVTFGMKPDVAETGYGYIRTGAPLHPDQPDEGVYRVTQFIEKPDHLRATEMLREGGYLWNSGMFMAPASVMLDELARHEPEVLENVRTALARSQHDLTFRRLEAESFLRCPNVSIDYAVMERTDRAMVIPADLGWSDVGNWNALWELGDKDAGGNVVVGDVVLEQSHNCYVRSEGMLTAVAGLTDIVLVVTTDAVLAIHRDYAQDVSALVAQLKKASRTEAEIHNRCYRPWGFYEGLIQGERFQVKRIVVYPGQKLSLQKHFHRAEHWVVVSGTALVTRDDENLLIQENESVYLPLGCMHRLENPGRIPLTLIEVQSGPYLGEDDIVRFEDTYGRQ

SEQ ID NO: 70339 - protein, 568 aa, Streptomyces coelicolor A3(2)
MRTATLGPAQRAESLAAMAERELDVLVVGAGVVGAGTALDAVTRGLSVGLVEARDWASGTSSRSSKLIHGGLRYLEMLDFVLVREALKERGLLLERLAPHLVKPVPFLYPLQHKGWERLYAGSGVALYDAMSMARGHGRGLPLHRHLSRRHALRVAPALKKDALVGALQYYDAQMDDARFVATLVRTAAAYGAKVANRARVTSFLREGERVVGARVQDVEAGGEYEVRAKQVVNATGVWTDDTQAMVGERGQFHVRASKGIHLVVPKDRIHSSTGLILRTEKSVLFVIPWGRHWIIGTTDTDWDLDKAHPAASSADIDYLLEHVNSVLSVPLTRDDVEGVYAGLRPLLAGESDATSKLSREHTVAHPVPGLVVVAGGKYTTYRVMAKDAVDEAVHGLDLRVADCVTEETPLLGAEGYHAQWNARARIAARTGLHVVRVEHLLNRYGSLTEELLELVAADPSLGEPLTGADDYLRAEVVYAASHEGARHLDDVLTRRTRISIETFDRGTRCAREAAELMAPVLGWDKGQVEREIEHYEKRVEAERESQRQPDDLTADAARLGAPDIAAR

SEQ ID NO: 70340 - protein, 196 aa, Neisseria meningitidis FAM18
MLLFIDNYDSFTYNIVQYFTELGQEVAVRRNDDITLEEIEALNPQYLVIGPGPCSPKEAGISVAAMRHFAGRLPIMGVCLGHQTIGEAFGGRIVRAKTLMHGKVSPVYHSGKGMFKGLPNPVTCTRYHSLVIERGTLPECLEITAWTEDGEIMGVRHKEYAVEGVQFHPEALLTEYGHDMLNNFFIEFQNFKPQKI

SEQ ID NO: 70341 - protein, 433 aa, Saccharomyces cerevisiae
MATDTERCIFRAFGQDFILNKHFHLTGKIGRGSHSLICSSTYTESNEETHVAIRKIPNAFGNKLSCKRTLRELKLLRHLRGHPNIVWLFDTDIVFYPNGALNGVYLYEELMECDLSQIIRSEQRLEDAHFQSFIYQILCALKYIHSANVLHCDLKPKNLLVNSDCQLKICNFGLSCSYSENHKVNDGFIKGYITSIWYKAPEILLNYQECTKAVDIWSTGCILAELLGRKPMFEGKDYVDHLNHILQILGTPPEETLQEIASQKVYNYIFQFGNIPGRSFESILPGANPEALELLKKMLEFDPKKRITVEDALEHPYLSMWHDIDEEFSCQKTFRFEFEHIESMAELGNEVIKEVFDFRKVVRKHPISGDSPSSSLSLEDAIPQEVVQVHPSRKVLPSYSPEFSYVSQLPSLTTTQPYQNLMGISSNSFQGVN

SEQ ID NO: 70342 - protein, 317 aa, Oryza sativa Japonica Group
MAAAASAPPAPADALPKGADSFFRTVISNMEKVYLSRNPTAKTILELVRSYDGDHICYDHFAFRTFGVDGYGIKSLAEFFTDFGYVPREELRFPAKKLRALWFSPPTNDGYTGTGVYGPLPRIFISELLVDELSPQSQDIIQKYIRTSGKGNKHATLASTSGELTWEKPIYSDFQVLSRESEYAAWTLVNGYALNHTTISTHRLISDIRSINKFNKFVEDNGFKLNSEGGILKVSPDGLLQQSSTVADSALFTFADGITESIPRSYIEFAERLVLPQFKDLPNDEVNEHHRRDGFEVGNADKIFESTSNDQLTRRSA

SEQ ID NO: 70343 - protein, 250 aa, Oceanobacillus iheyensis HTE831
MISRKSKREVEQMQAAADVLVACHKEIAKMIKPGISTIEIDNFVEGFLEKHGATPEQKGYNGYPYAICASLNDEICHGFPTEKPLKDGDIVTIDMVVNLNGGLADSAWTYAVGNVDEKGKRLIDVTKEALYKGLEQAQPGNRIGDIGHAIQTFAEAEGFSVVRDFTGHGIGPTIHEDPHIPHYGLPNKGLRLKEGMVITIEPMINEGAWQSKMDDNGWTARTIDKGRSAQFEHQIFITENGPLIFTEQDK

SEQ ID NO: 70344 - protein, 258 aa, Arabidopsis thaliana
MATAVGSGSDVEVGFAKLQGEDFEYYMQSYSIILGRNSKKSTVDVDLSSLGGGMNISRNHARIFYDFTRRRFSLEVLGKNGCFVEGVLHLPGNPNVKLDSQDLLQIGDKEFYFLLPVWSILGGPLGPRHHVLGKATVVPYHNYHSGPGSGSGKNGVRSRELYEYDDEDDDEEEDIRGSGKKTWRDGHEGILKEYGNVWHHSRVRRYLSQEDWAIPEAKGKPWYGLLMLLRKYPEHFVINTRSKGRVTLEFVSLVTLLS

SEQ ID NO: 70345 - protein, 166 aa, Idiomarina baltica OS145
MANVEAQNGELIEKLITVNRVAKVVKGGRIFSFTALTVVGDGKGKVGFGYGKAREVPAAIQKAMEKARRNMVTVQLKGETLQHPVKGRHSGSQVYMQPASEGTGIIAGGAMRAVLEVAGVHNVLSKAYGSTNPINVVRATIKALNDMKSPEQVAAKRGLRVDEILG

SEQ ID NO: 70346 - protein, 398 aa, Shewanella oneidensis MR-1
MAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 70347 - protein, 1049 aa, Magnaporthe grisea 70-15
MSTPKEVGPLPVVSPTDGSEDNSSDKQASHDKEKTAGADDPTPEDEHDVNKDVELQHGVAKIQAITKAWTFKYLMLTYVLIYLSSYCHSMQQNMNSNLGPYVTSAFSRHGLLATVGIVARLSSGIAQIPMAKIGDIWGRMEIYILVHGLTSFGLMLMAVSNSIETYAAANVFWSVGSAGVGFVHTVLISDLTSLRNRMIIYSINSTAYIGNAFAGPIGQEAGARAGAAEQRQDDVCVMIEPRLLTGRLSASVVGMILLCGGLSIFLLPFSIVSYSPYGWTSAYIIFMIIFGFFLVIAFAFWERNYAVTPLVPWKSLNDRTILGAALTAGILFASAGTWDSYFSSYLQVVHQQSISQAGFISNIYTIASCTWGPIVGYLIRLTNHYKWIAMSAVPVALLSTGLLIHFRTPDTYIGYVIMCQVLKACANGTIIICEQLAVMSVVSHNQVAVMLALIGLATSVGSSVGRAISGGIWTNQLLPLLIEKLPEDARANATVIYGSLPVQLSYPFGSPARNAIVAAYGDVQRKMVIAGACLMPLALGAVFLWRNVNVKKTKQTAGQTWLNIWVSPHATILVLVLDLVYSMPNFLVWCSHVRNAIDHIITNKGRKRSQSRSNLNRTFYAVERQSLKAHRKSQTPTSNREREPTGARNRSVANTQPRAAHVFGKRQIPKVAVQSIWKSALGPRWFSTLEGTGKSSLAQIVVRDLQTDQKNVVLSFGFDASNGPRPNTPAKLLQSILGELMLHPKVTIGTEAKLAISNLLGQKDEVESCTRDQLYSGSTWHALEALICSQESCFLVIDALDECTPSPSDKDAQAAGADLMRKLTELTERSGLKLACFSRDDPTLNPLLQKSACITLRPDLVMSDVLAVFLKEYDRDPALPPGSRERAKRRVLKTADGSFLWAKLFLQYAKSVDDAEAIDMRLEACPAKPHDVYERMLLETSRLGGFGEEDTRLRRTVFVFLLGAQTPVTVPMLVDVLKIPERGAAARIQQLCKPLVHVSESRVEICHPSARGFLLGLHPRVTDTLPPFTLVECRELLEKCPGRFWRDDL

SEQ ID NO: 70348 - protein, 375 aa, Streptococcus suis 89/1591
MAQNKMLAMILAGGRGTRLEGLTKKVAKPAVAFGGKYRIIDFPLSNCANSGIDIVGVLTQYEPVLLNSYVAQSQRWGLDVQGSGVFVLPPSEKIEGFGLYKGTADAITQNIDFIDLHDPEYVLILSGDHIYKMNYDKLLDTHIQKKADATIAVIEVPIKEASRFGIMNTDEDYRIEEFEEKPENPKSNLASMGIYIFTWKTLKKYLQEDDKLDTSSHDFGHDIIPKYLEDGRTLIAHPFRGYWKDVGTVNSLWESNMDLIDHAGDLDLSDRSWRIYSEDKGSPAQVIGATATVKSAYIDKGAVIDGTVEHSVISTDVQVNQNAVVKNSVVLPGAIIGEGVELDYVIVAENIKIADGVKLTGDIDHILLIDKNVTK

SEQ ID NO: 70349 - protein, 371 aa, Streptococcus suis 89/1591
MLRNTLGIVNIEGNNVHFGDVMKHRGVQAFGFLGRYRLIDFALSNMSNSGITEFQVYMPAEMRSTIQHVGTGKHYNINSKRGTLRLLNSATDPNSVYRHDINAFTENIHYIEKSTKDYVLVAPSYFIYSQDFSKVMDDHIATDADITVLYKNVSDAKENFIGCQTLKFGEDRRVVAFEENHGKYKNRPVSLEAYIMKRTTFIDLIKRANKVSSLYWLKDILRDTVDQYKIMGYAHRDYVACINTTASYFNTQIELIDQDTRKLLFKHDWPIHTQTSDSSPCLYGPLAEVKRSLISNGANINGQVENSVIDRDVIIEEGVVIKNSIILNGVTIKSGANIENAIIDKATKIIHPIDIKGSETSPSYLKPHQII

SEQ ID NO: 70350 - protein, 167 aa, Geobacillus kaustophilus HTA426
MAFENKIVEAFIEIPTGSQNKYEFDKERGIFKLDRVLYSPMFYPAEYGYLQNTLALDGDPLDILVITTNPTFPGCVIDTRVIGYLNMVDSGEEDAKLIGVPVEDPRFDEVRSIEDLPQHKLKEIAHFFERYKDLQGKRTEIGTWEGPEAAAKLIDECIARYNEQKNK

SEQ ID NO: 70351 - protein, 404 aa, Shewanella sp. MR-4
MRPIIKSNKLDTVCYDIRGPVHKEARRLEDEGHRILKLNIGNPAPFGFEAPEEIVRDVILNLPSAQGYCESKGLFSARKAIVQHYQAQGIKGVDIEDVYIGNGVSELIMMAMQGLLNTDDEVLIPSPDYPLWTAAANLAGGKAVHYRCDEEADWFPDLDDIKSKISSRTRGIVLINPNNPTGAVYSKELLLQVIELCREHNLILFADEIYDKILYDEAKHIPAASLSDDILTVTFNGLSKAYRAAGFRVGWMMLSGNLKAAKSYIEGLEMLSSMRLCANVPNQHAIQTALGGYQSINELILPSGRLTVQRDTCYELLNQIPGVSVKKPKGALYAFPKLDMKKFNLRDDERLVLDLLRDKKILLVHGSAFNWPEPDHLRVVFLPYKEDLTKALTEFGNFLETYKQ

SEQ ID NO: 70352 - protein, 424 aa, Robiginitalea biformata HTCC2501
MGQNLSLRDARHIWHPLTQHKTHGMAHGIARAQGVYLYDTQGKAYLDAISSWYTAVYGHCNPQITRRVAAQMEELDQVVFSGFTHEPAVSLSEKLLGHLPGNQEKVFFSENGSTAVEVALKIALQYHFNLGAPRKILLAFESGFHGDTFGALSVSGLSVYNGPFEGMALEVRRIPVPDDPDAAQSLATLEAILAEAPVAGFVYEPLVQGAAAMKTHDAAGLDKILARLRETGALLIADEVMTGFGKTGTNFASAQLETQPDLICLSKALTAGLLPMGITSCSAQVYNAFLSDSVEKGFFHGHTYTANPLACTAALAALELLETAEMQSNISRIAGAHRDFETRVQSHHKVLATRRIGVIFAMDLDVETDRYGSLRDILYGFFMERGIYLRPLGNTVYILPPYITTDDELARIYQAMEEVLEFIS

SEQ ID NO: 70353 - protein, 534 aa, Populus tremula x Populus tremuloides
MESGVRKENNPPSSSFSLQQQPPATNPSPLRKIIVVASIAAGVQFGWALQLPLLTPYVQLLGIPHTWAAFIWLCGPISGMLVQPTVGYYSDRCTSRFGRRRPFIAAGAGFVAISVFLIGYAADIGHLSGDSLTKTAKPRAIAVFVVGFWILDVANNMLQGPCRAFLADLSGKDHKKTRTANAFYSFFMAVGNVLGFASGSYTHLYRIFPFSRTKACDVYCANLKSCFFISIALLLTLTILALSYVREKPWSPEGSSGEGGNEEEKEEEGGEAKESTPAPFFGEIVAALKNLQRPMRILLLVTCLNWIAWFPFLLFDTDWMGREVYGGDSSRNTDQLKMYDRGVRAGALGLLLNSVVLGFTSLGVEVLARGVGGVKRLWGIVNFILAICLAMTILITKVAQSNRRYTTVNGGTHLLPPPSGVKAGALALFAVMGIPQAITYSIPFALASIFSNTSGAGQGLSLGVLNLSIVISQMEVSVAAGSWDALFGGGNLPAFVVRAVAAAASGILAFTMLPSPAPDIPSNKRAATSTLAFI

SEQ ID NO: 70354 - protein, 759 aa, Yersinia pseudotuberculosis IP 32953
MDEQLKQSALDFHQFPVPGKIQVSPTKPLATQRDLALAYSPGVAAPCLEIAADPLAAYKYTARGNLVAVISNGTAVLGLGNIGALAGKPVMEGKGVLFKKFSGIDVFDIEVDELDPDKLIDIIASLEPTFGGINLEDIKAPECFYIEKKLRERMKIPVFHDDQHGTAIICTAAVLNGLRVVKKDISDVKLVVSGAGAASIACLNLLVALGLKQHNIIACDSKGVIYKGREANMAETKAAYAIDDNGQRTLGDVMPGSDIFLGCSGPGVLTPEMVKTMAPNPLILALANPEPEILPPLAKAVRPDAIICTGRSDYPNQVNNVLCFPFIFRGALDVGATTINEEMKLACVHAIADLALAEQSDVVASAYGEQDLSFGPEYIIPKPFDPRLIVKIAPAVAKAAMASGVATRPITDFNAYVEKLSEFVYKTNLFMKPIFSQAKKEMKRVVLAEGEEERVLHATQELISQGLAYPILIGRPSVIETRLKKLGLQISAGKDFEVVNNESDPRFNEYWHEYYQIMKRRGVSQEQARRAVIGNPTLIGSIMVHRGEADAMICGTIGTYHEHYDVVEKVFGFREGAHVAGAMNALLLPSGNTFIADTYVNNDPTAEQLAEITLMAAETVRRFGIEPKVALLSHSSFGTSDCPAARKMRQTLALVNQMAPELEIDGEMHGDAALVESIRHNLMPDSPLKGSANILIMPNMEAARISYNLLRVTSSEGVTVGPVLMGITKPVHILTPIASVRRIVNMVALAVVEAITLRP

SEQ ID NO: 70355 - protein, 489 aa, Gluconobacter oxydans 621H
MEHFQQVEPFDYVIFGATGDLTMRKLLPALYNRLRMGQIPDDACIIGAARTELDREAYVARARDALERFLPSDILGPGLVERFLARLDYVTLDSSREGPQWDALKSLLAKAQPDRVRVYYFATAPQLYGSICENLNRYELITPTSRVVLEKPIGTNMATATAINDGVGQYFPEKQIYRIDHYLGKETVQNVLALRFANPLMNAAWSGEHIESVQITAVETVGVEGRAAYYDTSGALRDMIQNHLLQVLCLVAMEAPDSLEADAVRNAKLAVLNALRPITDATAATETVRAQYTAGVVDGENVPGYLEELGKPSATETYAAIRAWVDTPRWKNVPFYIRTAKRSGKKVSEIVVTFRPAATTMFGATPASNRLVLRIQPNEGVDLRLNVKNPALDVFNLRTADLDTSIRMEGGLPFPDSYERLLLDAVRGDPVLFIRRDEVEAAWRWVEPILEAWKHDKAPMQTYSAGSYGPEQATQLLASHGDTWHEASE

SEQ ID NO: 70356 - protein, 169 aa, Glycine max
MEKLDLATESSSSYPSNLWDCGSTLYDSFELNSFKRQLDSAIANSPIISRTLSMPHLPERSLHAPPEQPPTVMSRKSFKFSRSFHKLLRSVFKSNSKSSTTTTSLSFQVPEKYSKERFYVVYDKSGPVLSTIPEVPEFEIAALSPEISSFVGRSASERFTPTVIGISCA

SEQ ID NO: 70357 - protein, 303 aa, Oryza sativa Japonica Group
ENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATGQIKTGAPCRSERLAKYNQARLRRSLVRLLSTLVPSSAHPWSPTKLDVVPGTCDLLYREALVWNRMPIYVMGHGANTNNLLTFHRMPIYVMGIWGQGPIPGDAVQMPYLFELEVFPSGQRRATTSL

SEQ ID NO: 70358 - protein, 999 aa, Oryza sativa Japonica Group
MASALFLWLSWLVLSLLSIYLLDLLAHSRRRLPPGPRPLPLIGSLHLLGDQPHRSLAGLAKTYGPLMSLRLGAVTTVVVSSPDVAREFLQKHDAVFATRSAPDAAGDHTRNSVPWLPPGPRWRELRKIMATELLATHRLDALHELRQEKVSELVDHVARLARDGAAVDVGRVAFTTSLNLLSRTIFSRDLTSLDDRGASKEFQQVVTDIMGAAGSPNLSDFFPALAAADLQGWRRRLAGLFERLHRVFDAEIEHRRRVAGEEHGKVKDDFLRVLLRLAARDDDTAGLDDDTLRSVFTRVRAAADDRPSPESSRGRCPTPRSGGDGRPPPGSEGGGGLSGMRAAATESGGFSGACAQRRRWWRAGRLGRWGGTGSGYRDGDGDDDDDGDRDGDDDGDREEGPGPKVVTPVGPMVDQAQCDLDGPRLYCNGGFVSLAFMACALSLLSVYLLDLLAQSRRRLPPGPHPLPLIGSLHLLGDQPHRSLAGLAKTYGPLMSLRLGAVTTVVVSSPDVAREFLQKHDAVFATRSAPDASGDHARNSVALLPNSPRWRELRKIMATELFSTSRLDALHELRQEKVVELVDHVARLAREGAAVDVGRVAFTTSLNLLSHTIFSRDLTSLDDHGASKEFQQVVTDIMGAAGSPNLSDFFPALAAADLQGWRRRLAGLFERLRRVFDAEIEHRRRVVGKEHGKVKDDFLRVLLRLAARDDDTAGLHDDALQSIFTDLFAAGSDTSSSTVEWAMAELLRNPLPMAKACDELQRVIGSTRRIEESDIGRLPYLQAVIKETFRLHPPVPFLLPRQATTTIQILGYTIPKGAKVFINVWAMGRDKDIWPEAEKFMPERFLERATDFKGADFELIPFGAGRRICPGLPLAVRMVHVVLASLLINFKWRLPVKVERDGVNMTEKFGLLQSKEKDRSDLAYVINAVKDLMGAAAATTATNLTILPSPRVRKSKCEEAHVMPTTAKLHTPATTKHGLTDYVASCDNEAHIQDNKWPPS

SEQ ID NO: 70359 - protein, 247 aa, Saccharomyces cerevisiae
MPKLVLVRHGQSEWNEKNLFTGWVDVKLSAKGQQEAARAGELLKEKKVYPDVLYTSKLSRAIQTANIALEKADRLWIPVNRSWRLNERHYGDLQGKDKAETLKKFGEEKFNTYRRSFDVPPPPIDASSPFSQKGDERYKYVDPNVLPETESLALVIDRLLPYWQDVIAKDLLSGKTVMIAAHGNSLRGLVKHLEGISDADIAKLNIPTGIPLVFELDENLKPSKPSYYLDPEAAAAGAAAVANQGKK

SEQ ID NO: 70360 - protein, 526 aa, Streptomyces coelicolor A3(2)
MSSATPAAAAPDTVLVVDFGAQYAQLIARRVREARVYSEIVPSSMPVEEILAKNPAAIILSGGPSSVYEAGAPTLDRSLFEAGVPVFGMCYGFQLMAQTLGGTVDNSGAREYGRTELAVSKPSSTLFEGTPAEQSVWMSHGDACSAAPEGFTVTGSTDVVPVAAFENDEKKLYGVQYHPEVMHSTHGQQVLEHFLYRGAGLSPDWTTGNVIEEQVAAIRAQVGDRRAICGLSGGVDSAVAAALVQKAIGSQLTCVYVDHGLMRKGETEQVEKDFVAATGVQLKVVDASERFLGALAGVSDPEQKRKIIGREFIRVFEQAQLEIMREDGPEVAFLVQGTLYPDVVESGGGTGTANIKSHHNVGGLPDDIEFELVEPLRQLFKDEVRMVGQELGLPDEIVQRQPFPGPGLGIRIVGEVTKERLDLLREADAIAREELTAAGLDRDIWQCPVVLLADVRSVGVQGDGRTYGHPIVLRPVSSEDAMTADWSRLPYEVLSKISTRITNEVTDVNRVVLDVTSKPPGTIEWE

SEQ ID NO: 70361 - protein, 338 aa, Synechococcus sp. RS9916
MGEPAVQRPALLLLSTGGTIAGSGATSTQVNTYAAGALSGDALLAAVPELQQLATIRVEAIASVDSADLQFAHWRLLVARIREAFQTQPDLAGVVITHGTNTLEETAWLLQLLIDDPRPVVLVGAMRPATALSADGPLNLYQAVEVAIDPQARGRGVLAVLDGEIHGARAVTKVATQGVGAFRSTGAGPLGWVDDAGVHWPAAAGAPMVPFAALPLSSMWPQVAILHGCVEPPAALIPALLQAGVQGLVFTGTGAGQLSAVERTAIDQWNGPLPLMLRANRCGSGPVHRCADHARLGLLPAGTLSPQKARVLLLLALIAGYTRADLEGELQRLGLMAV

SEQ ID NO: 70362 - protein, 280 aa, Shewanella sp. ANA-3
MTQTNATTSNQAPLTAMPMLGTGTFRLKDNAAFDAVLMALEEGSRHIDTAQIYGNEQAVGDAINTSGIPREELFITTKVWTENLTKERFETSVIDSLTALQTKYLDLLLIHWPLNSDEPSMVEYLSELKAVLDKGLTRRIGVSNFTNAQLAQAIAILGEGVIYTNQVEVHPYLINRKVTDFCRQHNVLVTGYMPFAYGAVLQDETIVNLASVHQATPAQIVLAWLRQLGFATIPSSTKRDNVRSNLAAASINLTPAEIEQINQLDRNHRVANPDFAPHWD

SEQ ID NO: 70363 - protein, 272 aa, Nitrosomonas europaea ATCC 19718
MQAGAGVVIHIKTAPEIETMRIAGRLASEVLDYIEPYVVPGVTTGELDELCHRYMVDVQKTIPAPLNYAPPGYSPYPKSICTSVNHQVCHGVPGDKKLKDGDVVNLDITVIYEGYHGDTSRMYYVGEPSIQAKRLCELTYEAMWRGIEEIRPGKHLGDIGHAIQRLAEGAGYSVVREFCGHGIGAKFHEDPQVLHYGRAGTGIELKPGMIFTVEPMINAGKAAIKQLPDGWTVITKDHSLSAQWEHTILVTDESYEVLTVSSGSPARPAYRF

SEQ ID NO: 70364 - protein, 576 aa, Synechococcus sp. RS9916
MHDRAEPLAMTGEQTPSTTGAIQSFSALAERADYSLLDTLRADPDASVDGNDHRARQVYSGHYVPVTPTPLAEAEYVAHSPDLFSELGLSDALVHDEAFRRWFSGDSSMATGPLRPFGWATGYALSIYGTEYTQQCPFGTGNGYGDGRALSVFEGVFKDKRWEMQLKGGGPTPYCRGADGRAVLRSSVREFLAQEFMHALGVPTSRSLTLYVSRSETVRRPWYLEHSRSLDPDVMVDNAAAITTRVAPSFLRVGQLELFARRARSNAHPDAMEELRMIVTHLISRNYREVIDRSLDFSDQVVQLAQLFRGRLTSLVADWMRVGYCQGNFNSDNCAAGGYTLDYGPFGFCELFDPRFQPWTGGGEHFCFFNQPAAAEANFQMFCSALRPLLQDQPDAMAQLDQISAGFAEAMETTLDAMWARKLGLPGSNPPLVRELLALMAQSRADYTLFFRGLSACPSTLEPLAGSFYFPCSPELETQWHSWLERWQEQTMGNGDNAERSTAMKRVNPAITWREWLIAPAYQQAEHGDTNLIQELQAAFRNPYDDPSEAMQAHYCRLKPREYFNAGGISHYSCSS

SEQ ID NO: 70365 - protein, 339 aa, Mycobacterium sp. MCS
MSEPVADFSPLRVKRVVRETSDAVSLVLDVPRHCSGRFRYQAGQFLTLRVNLDGQELRRCYSMSSAPVEEELRITVKRDPGGLVSNWLNDTVSEGAEIHAAPPEGRFLLRDTDSEIVAFAGGSGITPIMSLIRTALATSARSIRLFYANRNRGSVIFADDLARLVEHNADRLVLTHHYDDDSGVVTPAAIESFVAGAGDADFYICGPGPFMDTVEGALATRGAPRDRVHLERFQVAQVPAGADASEAQATEEIVIELDRKTTTVPYRSGNTLLQTARTAGLRAPSSCETGSCGTCMAQVVSGSARMLNNDALDDDEVADGWVLTCQSLPTSRSVHVVYE

SEQ ID NO: 70366 - protein, 410 aa, Arabidopsis thaliana
  misc_feature (280)..(280): Xaa can be any naturally occurring amino acid
MAAFLQTNISLNAIKIVPGKYSSLTDHQFRAPYRIRCAAASPGKKRYNIALLPGDGIGPEVISVAKNVLQKAGSLEGLEFDFKEMPVGGAALDLVGVPLPEETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVTALASEYPDVELSHMYVDNAAMQLIRDPKXGFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNKLVGCKEMGEEVLKSVESKVPATV

SEQ ID NO: 70367 - protein, 490 aa, Shewanella sp. MR-4
MGKTTSGAKACDFVLFGTKGDLARRKLLPSLYQLDKAELLDKNTKVIGVAKDEFSQDEFRELVILALKTFVKEPLCEETVERFLSRCHYVGTNFTESAGYSAFHELLKPEERVMVSYFATPPAIFGDICRCLHEQNLIHSDSRVVLEKPIGSDLASSRVINDQVSAYFKENQVYRIDHYLGKETVQNLIALRFANSLFASKWDNRTIDHVQITVAEEVGIEGRWGYFDKAGQMRDMIQNHLLQVLTLVAMDPPVNLDADSIRDEKVKVLKSLRPINADNVYENTVRGQYSAGFLKGSPVPGYLEEEGANLQSHTETFVALRVDIDNWRWAGVPFYLRSGKRMPFKSSEIVVYFKNPPHNLYRSSYRNLPPNKLTIRLQPHEGVEIQMMNKVPGLEQKQRLQTTKLDLSFSDTFKNERIADAYERLLLEAMLGNQALFVRRDEVEQAWTWVDGIIQSWEQSNEKPKPYPAGTWGPVASVALITKDGRSWDE

SEQ ID NO: 70368 - protein, 613 aa, Nitrosomonas europaea ATCC 19718
MNDPISRRAFLKRSGALGTFAALDWMLPIYARSDSLSVVTPTTQLSGDVINLTIARTPFRIDDHIATATTINGTVPGPLLHLREGQDITLNVTNHLDETSSIHWHGILLPPEMDGVPGISFPGIEPGATFSYRFTIRQYGTYWFHSHSGGQEQAGVYAPMIIDPIEPDPVKYDREYVIMLSDWSFSSVDSMIEKLKKQPGYFNFQKRTLGDFIQDAMRDGWRPALDDYLMWARMRMDPTDLADVTGHAYTYLMNGLTPAANWTGLFHPGERIRLRFIQVGVMTFQDIRIPGLGMTVVQADGQNVQPVEVDEFRIGPAETYDVIVEPKEERAYTIFAETLDRSGFARGTLAPRPGMAAEVPSRRPRSLRTMADMGMQHMSGVDHGNHAPGNATMGEPEEGTQHDTPDRHGEHAKEGIHGRHDRHAQPGFPDSRPVRHGTDDHGSGNQFIPDFTQSRMDEPGIGLGNDGRRVLVYTDLKSLKPYPDQREPERELEIHLTGHMERFIWSFDGEKYSDAKESILFRHGERLRWIFVNDTMMEHTMHLHGTWMYLENGAGAYLPRKHTVLVKPAERVSVAITADAPGPWAFHCHLLLHMETGMFRVVEILDAAPGTES

SEQ ID NO: 70369 - protein, 479 aa, Shewanella sp. MR-4
MFRRTKIVTTLGPATDRDDNLRRIIAAGANVVRLNFSHGSPEDHLKRATQAREIAKELGVHVAILGDLQGPKIRVSTFKDNKKVQLNLGQAYILDAELGKGEGDENQVGIDYKQLPDDVKIGDILMLDDGRVQLRVERVEGRKVHTTVTVAGPLSNNKGINKQGGGLSAAALTEKDKADILTAAMIQVDYLAVSFPRSGADLEYARSLAQQAGSNALIVAKVERAEAVASEEAMDDVILASDVVMVARGDLGVEIGDAALVAVQKKLIARSRQLNKIVITATQMMESMISSPMPTRAEVMDVANAVLDGTDAVMLSAETAAGDFPEETVKAMANVCIGAESHPSVKVSKHRLDARFTSVEETIALSTMYAANHLEGVKAIIALTESGATPKLMSRISSSLPILGLSRHETTLAKMALYRGVLPIYFDSTIYPADELAQKALESLTTAGYLQSGDLVLMTKGDAMETIGGTNTCKVLIVA

SEQ ID NO: 70370 - protein, 481 aa, Bacteroides thetaiotaomicron VPI-5482
MEDLNFRKGDAKTDVFGSDRMLQPSPVERIPDGPTTPEVAYQMVKDETFAQTQPRLNLATFVTTYMDDYATKLMNEAININYIDETEYPRIAVMNGKCINIVANLWNSPEKDTWKTGALAIGSSEACMLGGVAAWLRWRKKRQAQGKPFDKPNFVISTGFQVVWEKFAQLWQIEMREVPLTLEKTTLDPEEALKMCDENTICVVPIQGVTWTGLNDDVEALDKALDAYNAKTGYDIPIHVDAASGGFILPFLYPDTKWDFRLKWVLSISVSGHKFGLVYPGLGWVCWKGKEYLPEEMSFSVNYLGANITQVGLNFSRPAAQILGQYYQFIRLGFQGYKEVQYNSLQIAKYIHGEIAKMAPFVNYSENVVNPLFIWYLKPEYAKSAKWTLYDLQDKLSQHGWMVPAYTLPSKLEDYVVMRVVVRQGFSRDMADMLLGDIKNAIAELEKLDFPTPTRMAQEKNLPVEAKMFNHGGRRHKTVKK

SEQ ID NO: 70371 - protein, 321 aa, Bacteroides thetaiotaomicron VPI-5482
MDKKVTLAQLKEVVQEAYDQVKTNTGGKNADYIPYLANVNKDLFGISVCLLNGQTIHVGDTDYRFGIESVSKVHTAILALRQYGAKEILDKIGADATGLPFNSIIAILLENDHPSTPLVNAGAISACSMVQPIGDSAKKWDAIVENVTDLCGSAPQLIDELYKSESDTNFNNRSIAWLLKNYNRIYDDPDMALDLYTRQCSLGVTALQLSVAAGTIANGGVNPVTKKEVFDASLAPKITAMIAAVGFYEHTGDWMYTSGIPAKTGVGGGVMGVLPGQFGIAAFAPPLDGAGNSVKAQLAIQYVMNKLGLNVFSDNHLIVVD

SEQ ID NO: 70372 - protein, 256 aa, Mycobacterium sp. MCS
MTEFVKRNPDAPPGFFACEAAGLRWLAAAAGAPCVPVIDCDATSLTLEHLDSAAPSRSAAAAFGARLAVTHDAGASGFGAGPDGWGGPGFFGPLQKPLPMSLTAHPTWGEFYADERLGPMGEHAAPRLTAAGREALAAVRDLCRAGRFDDGDPPARLHGDLWSGNLMWTPDGVVLIDPAAHGGHRETDLAMLALFGCPHFDEVIAGYQSVRPLRGGWRERIALHQLYPLLAHVVLFGGGYIRQTESALRSVLSDFA

SEQ ID NO: 70373 - protein, 318 aa, Corynebacterium efficiens YS-314
MSSEATTPTVVSYLGPAGTFTEAALIRFAERGEFGDGEITQLPVNSPQQAVDAVREGAADFAVVAIENFVDGFVTPTYDALDQGSDVQIFAEEAIEVSFTIMARPGTELADIRTLATHPVAHQQIKNWMAATVPDARFVSASSNAAAAQLVAENGADAAAAPERAADLFGLSKLVDDVADIRGARTRFVAVRRRIAPPPRTGHDHTAVVFALPNVPGSLVRALNEFALRGVDLARIESRPTRKTFGTYRFHLDFIGHIEDLPVREALRALHMQAEDLVFLGSWPAPRDSDDENTWADDIARLEKADDWVRAVLEGREY

SEQ ID NO: 70374 - protein, 337 aa, Zea mays
MSTPSDPAASAQPPSTAATSSSGLTFKLHPLVIVNVSDHYTRVKAQASFTAEAPSPGKAQASCSAEGSSAPAEPPRVFGCVIGVQRGRTVEIFNSFELVLDPVTGTLERAFLEKKLELYKKVFPEFYVLGWYSTGSDVQDTDILIHKALMDINESPVYLLLNPAINHSQKDLPVTIYESELHVIDGGPQLIFVKSNYTIETVEAERISVDHVAHLKPSDGGSAATQLAAHLTGIHSAIKMLNSRVRVIHQYLVAMQKGDIPLDNSLLRQVSSLVRRLPAMESQKFQDDFLMEYNDTLLMTYLAMVTKCSSTMNELVEKINTSYERTTSRRGGRGAFM

SEQ ID NO: 70375 - protein, 365 aa, Zea mays
MSLAVPVTLKTTQSGENERLEYAVSAMQGYRLNMEDAHAIVLNLDAATGTSFFGVYDGHGGPAVSKYCARHLHAELRRHESFRDNLQTAIERTFLRMDEMMRDRRAGRELSGYGGNDNWKAYRKAINMSLFLPFCQKPAYQGPVMDGCTACVVLIRDNRIIVGNAGDSRCVLSRNNQAIDLSTDFKPNLPDERQRIEAAGHVVTFSERGNVHRIDDGIAVSRSLGDLMYKDNNDLGPVQQAITAFPEVRTEEITQDDQFLIIACDGIWDCLTSQQAVDFIRIYSFADVGLASICEALLAHCVAQPRGRDNMTVILVRFKTPGACQVRASNVPPPPIRQDAAASQAAGSQAAAASQAAGSQAAAGH

SEQ ID NO: 70376 - protein, 414 aa, Vibrio sp. Ex25
AIGINHNTASVDLREKVAFGPDKLGPALEQLREHEAVNGSVIVSTCNRTELYCDVKQGARNKLIDWLAQFHQVSREDLMPSLYVHEEQAAIKHLMRVSCGLDSLVLGEPQILGQVKQAFSDSRDHQAVDASIDKLFQKTFSVAKRVRTETDIGGNAVSVAYAACTLAKHIFESLSDSTVLLVGAGETIELVAKHLASNGCTKMIVANRTKERAQGLADQFGAEVISLNEIPEHLAKADIVISSTASPLPIIGKGMVETALKQRRHQPILLVDIAVPRDVESEVGELNDAYLYSVDDLQSIIDSNIEQRKVEAIQAEAIVSEESAAFMTWLRSLQAVDSIRDYRKSANEIREELLSKSLQSLAAGADPEKVLRELSNKLTNKLIHAPTRALQSAAEQGEPAKLTIIRQTLGLDDL

SEQ ID NO: 70377 - protein, 203 aa, Picrophilus torridus DSM 9790
MSFENIIYLIKIQNEMKIYIIDNGGQWTHREWRTVRDLGVDSTIVPNTVDADVLADADGIILSGGPASIESEISKLGNIKEYMHRYNYPVLGICVGAQFIAIDSGGRVSKALHAEYGKKIVNFTSKDGIFYNIPDSINAWENHNDEIKSISDDYIICAYSDTCRVQAFYHKNRDIFGVQFHPEVNNTEHGTTIFKNFIEKCRR

SEQ ID NO: 70378 - protein, 399 aa, Mesorhizobium sp. BNC1
MASTAPWSETRPTALLVLADGTVIEGRGLGAAGSAVGEVCFNTALTGYQEILTDPSYAGQIVTFTFPHIGNVGTNDEDIEDLNPAARAGAVGAIFKADVTDPSNYRAGEHLDRWLKRRGIVALAGIDTRALTSLLREKGAANAVIAHAPDGRFDVEALKKEASEWGGLVGLDLAKVVTSGQSSTWTETPWVWSEGYAEARETPYHIVTVDYGVKRNILRMLSSLGAKVTVVPATASAEDILAMRPDGVFLSNGPGDPAATGAYAVPMIRELLKTETPVFGICLGHQMLALALGARTVKMHQGHHGANHPVKDFTTGKVEIVSMNHGFAVDSDSLPEGVEETHVSLFDGSNCGISLAGRPVFSVQHHPEASPGPQDSHYLFRRFINLVREKKGEPALAER

SEQ ID NO: 70379 - protein, 248 aa, Rickettsia akari str. Hartford
MNHIDFGFKKVDYTKKQGLVNSVFSNVADKYDLMNDLMSFGLHRLWKDEFIRRIPNLNSHILDVASGSGDIALKLAKKARDRGNNIALTLSDINEEMLKNAKKKTIDLNLFQNLKFTVASAEELPYPDNSFDYYTIAFGIRNVPDINKALKEAYRVLKPMGKFICLEFSKVKESYFKDFYKFYSFSIIPTIGQVITGNKEAYEYLVESIELFPSQDEFRIMIKEAGFEEVGYKNLSGGIVAIHSGYKI

SEQ ID NO: 70380 - protein, 501 aa, Oryza sativa
METRELWVLAAALAVSLLYYLAALMRYAGGGCSRSSRPPLPPGPTPLPLIGNLLSLRGVLHHRLASLARVHGPVMALRLGLTTAVVVSSRDAAAEAFTKHDRRLAARVVPDSNRAHGFSDRSIIWLPSSDPRWKALRGIQATHLFSPRGLAAVRSVRESKVRDIVAYFRSRAGEEVVFGEAIYSGVLNLVSSSFFSVNMAGVGSEEAHGLRELVEDLVEAIAKPNVSDLFPFLRQLDLQGLRRRTEERMARAFGILDGIIDRRLANRTHGDRHGDFLDALLDLVSEGKMARDHVTTMLFEVFVGTRDTMSVSLEWAMAELLRNPGAMRKARAELEDAAAVVEESDAARLPYLQAVVKEAMRLHPVGPILLPHRAVEDGVEIGGYAVPRGAMVIFNAWAIMRDPAAWERPDEFVPERFMETTTAIDFRGKEYEYLPFGSGRRLCPGLPLAERVVPFVLASLLRAFEWRLPDGVSAEDLDVSERFNTANVLAVPLKVVPVIVN

SEQ ID NO: 70381 - protein, 356 aa, Aspergillus oryzae
MQALWRRGTSLFSTPSGSPKDSGAAEEFRTASTPDKLFTKVDPAVDGEECLHDCATCTVRYPAKFDVDQEDTLYGNVNGWSTHLLVATGKTDWVRDVADEEGSVMEAIEKGGLEPSNGKLKLSASNMPVPDEYHHHDTGKQPTTVLLLPSFTIVDHVTPALAPDLIKYIVNSAPTTTTPLGAIPEPVSIPESEDQTQQPPISDLLSQTPLRSRPCPHAAVILLCSQRTRDARCGQSAPLLRKEFERHLRPLGLYRDLDDERPGGVGIYFISHVGGHKYSANVIVYRRRDLEWYRKQDSKEETSAEGEEGAAQGIWLARVRPEDCENIIRYTVLKGKVVKPEQIRGGFDRERGVMSW

SEQ ID NO: 70382 - protein, 324 aa, Robiginitalea biformata HTCC2501
MTETPHTPEDHYTPESLKEAHELIVPYIHRTPVMQSRQLNELAGAELFFKAENFQRGGSYKIRGATHALIRLRQSRDAGGVVTHSSGNFAQALSLAARSLGMQAHIVMPENAPKVKREAVSSYGGQVVLCAPTLEAREAEAARIERETGAAFIHPSNDPMVLLGQGTACLELLETHPELDRVVAPVGGGGLLAGTSLACAFFGRDCEPVGAEPLAVDDAYRSLKSGRIEKNESTDTVADGLRTVLGNHTFPVLQRHVRTIIRVEEDEIIRAMRLVWERMKLVVEPSSAVALAAVLRDPGLFRGTRTGIVISGGNVDLDNLPFSR

SEQ ID NO: 70383 - protein, 245 aa, Chlamydomonas reinhardtii
MASTASPYQLGNPLSKVQADAADGQRQHAAWSPYDDNGGTVVAVAGEDYCIVAASTRMSTGFSILTREATMMLQLGPQSRQVGRGREGLMHVRRLAGVVCGRRLKKGWDQDKEAELWGAGRLLSNTLYYKRFFPFYTFNLCAGLDEQGRGAVYNYDAIGSYERSGYFCQGFGRSRRFLGYCDLRLEARANTPPPSHTPTSSTALDLVKDAFVSAGERDIYTGDQVEILIITREGVRRDSLQLKLD

SEQ ID NO: 70384 - protein, 416 aa, uncultured archaeon GZfos31B6
MWKGVDRRRSCCKYRSCQGAAGHCHRTWHRTCQLRPTGRYHERNCDEYRYSSGAPSRHPYNLNIPARNPQIMEQVIWTEKYRPHTFEDIVGHEHIVANLKHLVESNNLPHLVLYGAKNTGKMSAVFVLARALYGEQWENNLAIFDASNFFDRGKKYLVSDPRFARLIGTDDPKKIQKTVISVFKQVINEYAGMAALDSDFRMIFIDSAEALSMDAQHALRRIMEKHSRTCRFILSTTHLPRLIPALRSRGLNLFFDRASDATVAAHIRCIAEAERAPITDDGVQAIVYEADGDLAFAIMVLQIASMKRREITANTVYEVDLERIPEGILELLHASLAGDFKTARKRIDDLLMEESGADITHRLRRVIENKSFDSALSAELAILLADTDMNLISGSNERVQLEAWVTQVGMLMERQS

SEQ ID NO: 70385 - protein, 462 aa, Nostoc sp. PCC 7120
MHLPKGPQTPVFVQVLRWVFSPMSFLEDCAKRYGDIFSVKLAKDVPAIVFLSNPKDIQQILTNDNNQLDSPGDWNDLFEPLLGKRSVITLSGAEHQRQRQLLMPPFHGERMRGYSQVITDVTEKVISQHQIGQPFQVRSVTQAITLRVIMQAVFGLYEGSRAEKLQHLLSDLLEKSSSPFSVALLYFPSLRRDFGPIKFWGEQVQIQQQADELIYQEIQERRENPDPSRTDILSLLMDARDADGQPMTDVELRDELMTLLVAGHETTATALAWAMYWIHKLPPVKARLLEELDSLGDNPDSTTIFKLPYLNAVYSETLRIYPVAMLTFARRVIETMALGGYELPPGTPVLGSIYLTHHREDLYPEPKKFKPERFLERQFSPYEYLPFGGGTRRCLGLAFAQWEMKLALAKILTSYELELVNNSVEVRPKRRGLVTGPHRPIEMVIKSQRQITSRILETTTVS

SEQ ID NO: 70386 - protein, 467 aa, Polaromonas sp. JS666
MAQAQGKIVQCIGAVVDVEFARDQMPKIYDALKMEGSALTLEVQQQLGDGIVRTIALGTSDGLRRGNTVYNTGANITVPVGKATLGRIMDVLGAPIDERGPVDQTLTAPIHRKAPAYDELSPSQELLETGIKVIDLVCPFAKGGKVGLFGGAGVGKTVNMMELINNIAKAHSGLSVFAGVGERTREGNDFYHEMADSGVVNLENLGESKVAMVYGQMNEPPGNRLRVALTGLTIAESFRDEGRDVLFFVDNIYRYTLAGTEVSALLGRMPSAVGYQPTLAEEMGRLQERITSTKVGSITSIQAVYVPADDLTDPSPATTFAHLDSTVVLSRDIASLGIYPAVDPLDSTSRQLDPNVVGEDHYATARAVQGTLQRYKELRDIIAILGMDELAPEDKLAVARARKIQRFLSQPFHVAEVFTGSPGKYVSLAETIRGFKMIVAGECDHLPEQAFYMVGTIDEAFEKAKKV

SEQ ID NO: 70387 - protein, 427 aa, Oryza sativa Japonica Group
MEADSGKLFVGGISWETDEDRLREYFSRFGEVEAKKAVPRDDQSITSKNNGSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPAARSPAGGQNYAMSRVHSFLNGFNQGYNPNPIGGYGMRVDGRYGLLTGARNGFSSFGPGYGMGMNSESGMNANFGANSSFVNNSNGRQIGSFYNGSSNRLGSPIGYVGLNDDSGSLLSSMSRNVWGNENLNYPNNPTNMSSFAPSGTGGQMGITSDGINWGGPTPGHGMGNISSLGLANLGRGAGDSFGLPSGSYGRSNATGTIGEPFSAPPNAYEVNNADTYGSSSIYGDSTWRFTSSEIDMPPFGNDLGNVDPDIKSNIPASYMGNYTVNNNQTSRGQ

SEQ ID NO: 70388 - protein, 196 aa, Staphylococcus aureus subsp. aureus MW2
MKVNPNNIELIISAVKEEQYPKTELSEVALSGRSNVGKSTFINSMIGRKNMARTSQQPGKTQTLNFYNIDEQLIFVDVPGYGYAKVSKTQREKFGKMIEEYITKRENLQLVIQLVDLRHDPTQDDILMYNYLKHFDIPTLVICTKEDKIPKGKVQKHIKNIKTQLDMDPDDTIVSYSSIQNNKQQQIWNLIEPYIS

SEQ ID NO: 70389 - protein, 190 aa, Mycobacterium avium 104
MVGRANIANLANTLTLLRLVLVPVFLLALFAGDGHETGFRILAFLIFAFACITDRLDGLLARNYGMATEFGAFVDPIADKTLVGSALIGLSMLGELPWWITVLILAREFGVTVLRLAVIRRGVIPASWGGKLKTVVQVFAIGLFVLPWAGTPGPFRVGAAVVMGAAIVLTVITGIDYVVSTVREVRRTAA

SEQ ID NO: 70390 - protein, 416 aa, Sulfolobus tokodaii str. 7 [sequence omitted]

SEQ ID NO: 70391 - protein, 386 aa, Cicer arietinum
IIETLGAGHGGRVSLTRSYHHALEASIARNFADNGCIACMCHNTDGLYSAKQTAIVRASDDFYPHDPASHTIHISSVAYNSLFLGEFMQPDWDMFHSLHPAAEYHAAARAIGGCPIYVSDKPGNHNFDLLKKLVLADGSVLRAQLPGRPTRDCLFVDPARDRTSLLKIWNMNKCTGVVGVFNCQGAGWCKVEKKTRIHDTSPGTLTSSVSASDVDQINQVAGVEWHGETIVYAYRSGEVIRLPKGVSIPVTLKVLEFELFHFCPIQEIAPSISFAAIGLMDMFNTGGAVEEVEIHKASDNKQELFDGEVVSELTTSLSPNRTKTATVALKVRGSGKFGVYSSQHPLQCAVDGIDTDFNYDSETGLTTFSIPVPQEGMYRWSIEIQI

SEQ ID NO: 70392 - protein, 523 aa, Oryza sativa
MACVLRLASRSRSRSGLRPTLAAPRPSPVPPPPPRVGPTPVAPSPAPLRGLLLPLSPLRLASPDAFSSSSPSPAWLLDGLNWRRAGVGRRWFATEASAASTAAELVDVPLAQTGEGIAECELLRWFVTEGDQVDEFQRLCEVQSDKATIEITSRFKGKVHQIHFGPGDIVKVGETLLKMMVGDSQTVSHDSIASSTDHSHAVDAANPSGEGSVPSGTLSTPAVRHLAKQYGLNISDIQGTGKDGRVLKEDVLSYAASKGLCKEPTSALEENIDQVELLEGRGSLPDANSYEDRRISLRGYQRSMVKSMTLAAKVPHFHYLEEINCDALVELKASFQNANKDHTIKHTFLPFLIKSLSKALSKYPLLNSCFVEETNEVIFKGSHNIGVAMATEHGLVVPNIKNVQSLSILEITKELSRLHEMASHNRLSTEDIAGGTITLSNIGAIGGKFGSPLLNLPEVAIIALGRIQKLPRFDDDENVYPSSIINVTVGADHRVVDGATVARFCNEWKSLVEKPERLLLHMR

SEQ ID NO: 70393 - protein, 149 aa, Oryza sativa Japonica Group
MSAAAAADVVHSGGCHCGRVRWRAEAPASVVVWICNCSDCAMRGNAHFVVPASKFTLAAGAGESLTTYTFGTHTAKHTFCRVCGITSFYTPRSNPDGVAVTAACVDPGTLAHVEYRHADGRNWEKWFSRSDISDFSKPKAPPPPPPSKT

SEQ ID NO: 70394 - protein, 240 aa, Arabidopsis thaliana
MLEDLGAAPPGAIVVLQACAHNPTGVDPTFEQWEKIRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDGRISMASLSSKTVPQLADAIHAVVTRIA

SEQ ID NO: 70395 - protein, 158 aa, Shewanella oneidensis MR-1
MNVVQGNIEAKNAKVAIVISRFNSFLVESLLEGALDTLKRFGQVSDENITVVRVPGAVELPLAARRVAASGKFDGIIALGAVIRGGTPHFDFVAGECNKGLAQIALEFDLPVAFGVLTTDTIEQAIERSGTKAGNKGGEAALSLLEMVNVLQQLEQQL

SEQ ID NO: 70396 - protein, 367 aa, Shewanella oneidensis MR-1
MALHSIEEIIEDIRQGKMVILMDDEDRENEGDLILAAEMVTPEAINFMAKYGRGLICQTMTKARCQQLNLPLMVTNNNAQFSTNFTVSIEAAEGVTTGISAHDRAVTVKAAVAKDAKASDLVQPGHIFPLMAQDGGVLTRAGHTEAGCDLARLAGLEPSGVIVEILNEDGTMARRPDLEIFSEKHGIKIGTIAALIEYRNTKETTVVREAKCKLPTRFGEFDMVTFRDTIDNQLHFALVKGEVKPDCLVRVHLQNTFNDLLHSERDQQRSWPLEKAMARISAEGGVLVLLGNQEHSSEILAKVKAFEAEDQGQTPVSAKWQGTSRRVGVGSQILASLGVTKMRLLSSPKRYHSLSGFGLEVTECVAE

SEQ ID NO: 70397 - protein, 374 aa, Mycobacterium sp. MCS
MRTKGALLWELNAPFRVDEIEVGDPVDDEVQIRVHAAGMCHSDYHLTTGATPIGLPALGGHEGAGVVTKVGRNVTGIEEGDHVILAFIPACGQCQPCLKGYRSLCDRGALLLGGKAIADGTSRVHAGSTEVSPMNLLGTFAPYMTVHKDSVVKIDHDVPFETAAIMGCAVPTGFGSATNVAEVQPGETVVIVGVGGIGLSALQGAVIAGARNVVAVDPVEFKRDQATKFGATHVFSSMAEAIGPVLELTHGFMAEKTIIAVGEMRGEYIEEAMTLTAKTGTCVVTGMGSMFDADVKLNLFLFTMLQKTLKGNIFGGGSSHVETPRLVGLYKSGLLKVDEMVTNTYRLEDINQGYQDMLDGKNIRGVITFDESDW

SEQ ID NO: 70398 - protein, 307 aa, Staphylococcus epidermidis ATCC 12228
MNKNKVIVIGSTNVDKFLNVKRFPKPGETLHINQAQKEFGGGKGANQAIAASRLAADTTFISKVGKDGNANFILEDFKKAGIHTQYILTSESEETGQAFITVDEAGQNTILVYGGANMTLSATDVEMSADAFIGADFVVAQLEVPFEAIEQAFKIARKQNITTVLNPAPAIELPKSLLELTDIIIPNETEAELLTGISINNESDMKETATYFLDLGISAVLITLGEQGTYCAYQEQYKMIPACNVKAIDTTAAGDTFIGAFLSELNKDLSNIESAIRLANQASSLTVQRKGAQASIPTRKEVEAEYN

SEQ ID NO: 70399 - protein, 534 aa, Staphylococcus epidermidis ATCC 12228
MNIYNKVTLSVILVITIIISFLFYFYTTEKKVDKDKLYENKITNHKQAGKPKNYGVASNNKIATKVGNKIIEDGGNAVDAAIGVSYALAVTEPHSSGLGGGGATLTYNGKENETPKAYEYKTMSSYEYKEGDKIGVPGFVRGLHDMHAKEGKMDEKKILDYVIPLAKDGFEVDSELERSLKLYGRDIDHNSPFYKGNKSVREGDIVKQDKLANTLTKIKDKGPDYFYEDIGKSVSKQLDNKLTERDFKEFKTEEKEAVSTDYKNNQVYSAPNPLGGTLMLQGLKIDEKENVDNMDRNNFITAMIKSRDVMYKNRDIVNGNEPSNEQHLTDDYLLGELNKVNIGENTDNGSDFDQIRTDNTSTTHFVVIDKNGKLASTTNTLSSYFGTGDYMKEGFYMNNSLGDFSKDKSSPNHGEPHKAPRSFISPSVIVGPNFYMGIGTPGGNKIPTILNEVIVDYLNSDGSLQESINKPRFYNDGGTIFYENAMTDEDINIFKSLGYGVEEKHNDPNFGSVQGAVYDKDKNTVDVGHDVGNR

SEQ ID NO: 70400 - protein, 463 aa, Pseudomonas fluorescens Pf-5
MQQTLNTQLLIIGGGPGGYVAAIRAGQLGISTILVEGQSLGGTCLNIGCIPSKALIHVAEQFHQTRHHSQGSALGIEVAAPTLNIGKSVEWKDGIVDRLTTGVAALLKKNKVQVIQGWARVIDGKTVEIEGADTRIQCEHLLLATGSKSVNLPMLPIGGPIISSTEALAPKTLPKRLTVVGGGYIGLELGIAYRKLGVEVSVVEAQERILPAYDGELTQPVLDSVKQLGIKLYLKHSVLGFDAASSSLQVREPNGDTLNLATDQVLVAVGRKPNTQGWNLESLNLDMNGAAIKIDHRCQTSMRNVWAIGDLSGEPMLAHRAMAQGEMVAELIAGKHREFNPAAIPAVCFTDPELVVVGKTPDEARAAGLDCIVSSFPFAANGRAMTLESKNGFVRVVARSDNHLIVGWQAVGVGVSELSTAFGQSLEMGARLEDIGGTIHAHPTLGEAVQEAALRALGHALHL

SEQ ID NO: 70401 - protein, 429 aa, Arabidopsis thaliana
  misc_feature (120)..(120): Xaa can be any naturally occurring amino acid
  misc_feature (138)..(138): Xaa can be any naturally occurring amino acid
  misc_feature (159)..(159): Xaa can be any naturally occurring amino acid
MVGSGVGGGDRSKDAVGMMALHEALRSVCFNSDWIYSVFWTIRPRPRVRGGNGCKIGDESGSLMLMWEDGFCGGGRSEDLCLETDIEGHEEDLVRKAFSKMSIQLYNYGEGWVLGRCYIXVIMDQKIIRLYKHTLITXLMIKDIIIYNTSYYDLVMFMXYICRLMGKVASDKCHKWVFKEPSESEPNLANYWQSSFDALPPEWTDQFESGIQTIAVIQAGHGLLQLGSCKIIPEDLHFVLRMRQMFESIGYRSGFYLSQLFSSNRTATPSSSTVPNQIPQSQGFNWGSHSPLLPSPSFQNQLPASARFGFLQDNNVPPQMLPPMEEHEDDIKWPNGLSLFNALTGRADEASRLLFNQEQNPMNVENQNEFLNLEGHHPNKFRRSYTLPARMDSSSSSTSLDQQQPLEFRNNNSGSNSGLFPDVMETFLR

SEQ ID NO: 70402 - protein, 268 aa, Oryza sativa
MAGASAWYTVVSGSNGGGDCHMRICFKHVVDDDDPAARGTGGGSPRQPRRKHGGGGGGKINPYAERGLDKFSTVLSELEARRDKILRRVGSGGGLVMVRFVQSNGALEPIIVKLPDEQRRPKDDAAAKKPRPSSPSTAAAQQQGASAARATRAPPPAPAASRVSSFSWGRMRRPACYWPAVMVLMLVCLAVFGRVFAICCTSIWWYLAPTLLSNGGAGGEDAARRPLGSPRKSPPPASGKKLAGRRGTREVGSSPRGQRRPEYGEPMV

SEQ ID NO: 70403 - protein, 187 aa, Xylella fastidiosa Dixon
MNPIRPFLDKTPQLGCTVYIDPTSTVIGDVILGDDVSVWPQTVIRGDVNQIRIGARTNIQDGTIIHVSHHSPYNAAGYPTLIGTDVTIGHGTIIHACTIEKLCLIGMGACILDGVTIKKYSFVGAGAVISPNKIVGEAELWLGNPARLVRKLSDKEIESLHYSAQHYVKLKNRYLDLSAETTTTPSP

SEQ ID NO: 70404 - protein, 200 aa, Triticum aestivum
  misc_feature (96)..(96): Xaa can be any naturally occurring amino acid
  misc_feature (119)..(119): Xaa can be any naturally occurring amino acid
MASEFSFARGVSLPAAAHWPPLAFTSYRLRHSAACTRANPRVVAAARAVSVAAAKGRMPGSVRYGGARVAALRAEEAEVAVPPSVSVRVAYELQLXAGHRYLDVRTEGEFGGGHPARSXVNVPYMYSTGSGMAKNPHFLEQVSAIFGRDDEIIIGCQSGKRSLMAAAELCSSGFTAVTDIAGGFSTWRENGLPVNGRGLL

SEQ ID NO: 70405 - protein, 177 aa, Picrophilus torridus DSM 9790
MEKNMSYWHQVPPGPNPPDEVYVVVEIPKGERNKYEIAKEFPGIKLDRIIYSSYVYPLEYGLIPQTYYSDGDPIDAMVFMSQSTYPGVILRAKPVGMMNMVDSGDVDNKIICVCLDDPVYSKINNYREIPEHVLKETENFFETYKKLQNKEVKVTGWEGPDKAKQEIKKAIEDYKKL

SEQ ID NO: 70406 - protein, 46 aa, Capsicum annuum
  misc_feature (41)..(41): Xaa can be any naturally occurring amino acid
MQHITDKLGLHSLRQRHWYIQSTCATSGEGLYEGLDWLSNXIANKA

SEQ ID NO: 70407 - protein, 398 aa, Xylella fastidiosa Dixon
MNTPTHTHPHPFGSTATIRCERAAAELRTGRPVLLIDAHTRRHAIMALDSMTAQSFTTFANAVGNTHYLFLTPVRSNVLGLEAPQGARIPLATLSYDSLVKLAYLRQPTHPTTWVPGDIMDAAATEITRLALLLPAIVAAPLTQHTEHAFADCQTLDLADLDTAAACASTTEYELVTRTPVPLRDLGMSEFIVFRGGIAQRDQVAILIGQPDLSSAVPVRVHSSCLTGDLFGSLKCDCGDQLRHGLATLKALGGGVLLYLDQEGRGNGIAAKIRAYGYQHVGLDTIDADAQLGFGPDERRYTGAVMILRTLGITRIQLLSNNPTKVERLRAAGIIVEQRIPVIGQITEQNEHYLRTKVSRAGHDLDIDALIMTSQTPQDPSETVDGETVKPIAKTGHA

SEQ ID NO: 70408 - protein, 355 aa, Aspergillus oryzae
MSGHENNGAPPVGQEKINTDIVTLTRFLTEEQTKVPEATGDFTLLCHALQFSFKSIAYYIRRASLINLTGLAGSSNTTGDDQKKLDVIGNDIFISAMRGSGKCRILVSEEEEEAIIFDEHPYARYAVVCDPIDGSSNLDAGVSVGTIFGIFKLPDSVLGPENKVSPKDLLLPGTEMVASGFTMYGASAQLVITMRNGGVNGFTLENSLGEFILTHPNMTLPAKRAIYSVNEGNSSYWEEWTNAYFHSLKFPPEGQKPYSARYIGSMVADAYRTLLYGGVFAYPADKKAPKGKLRILYECAPMAMLFENAGGLAVNSRMERLLGVVPEHIHDKSGVFLGSKDEVQKIIDTYNKYKK

SEQ ID NO: 70409 - protein, 372 aa, Sulfolobus tokodaii str. 7
MLLIPGPVEVPRSVREASTLVVNHRSEKFREIVRKLESLMNKHFSASRTALLTGSGTLAVEAMVYSLIKPNEKVISFPYGEFGNRLVDSLRRRGAQVKVYEKKIGEIFSIDEIKKALDENKDATAVALVHNETSSGMAFRNLEDVVSEVKRRGLKLLVDSVSGFAAYKLLVNEWKIDAVATGSQKALASVPGMSFVALSDDGIEEIQGESLPSYLDISLHLKFQDKGETPFTPAVGVFNASLRAAELLEIEGIENRWKRHEACARFVREVLSSYGFLLFGNENNFSNTVVAGVPPIPDYRKKLLNEFNIEISGGMGELKEKIVRIGLLGVVDSRAVNKLLEATAKLLDKNYDYLPPRECKLPELLEKEVEWS

SEQ ID NO: 70410 - protein, 497 aa, Staphylococcus aureus subsp. aureus MW2
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 70411 - protein, 693 aa, Nostoc sp. PCC 7120
MAVIGCLVLPSDVTGLGSPVSDKNFITSVKMTSINHDPTFSGNSRSTLKKRTLLFRYLAEINLIFGLWYLQWRITNSINFDALWLSIPLLLAEIYSYLGGVMFVIGLWRPLVRQIKSLDQLTPSLPQTDWPIVDVFITCYNEPPEMVEQTAQAALAIDYPPTKLYVYVLDDGNSPAMRAMTEKLCIADLQSPLLQQEANRIDAERSHLVERLQKLESFTSNIQVAEEWLSKSSSVPNQDKTTDEVLAQSLQQFIRWLSPKHHSIAERLKTERQVLAGAIRQKELELVELTRFRYIARPKPAGVPHHAKAGNLNYAIFSGETSGEFILTLDADHIPKPQFLKRVLPYFYTYNLFNGKYEQNRIAFVQTPQDFYNIPPSDPFGHRASLFYGPLQQGKDGMNAAFYTGTNAILRREALINVGLQYFADDFTKDEKRLDEFQLVGGLSSNSITEDMNTAMRLHGAGWKSVYHHELLAEGLAPDDLSSTLKQRLRWAQGTIQVLVKENPLRKSGLTFWQRLQYFKTMYSYFSGFATLIFISCPIIYFFTEIVPVKTYGTDFILHFLPTFIINRLTFVVAIWGIPASEIWRSEQYAIALFPIFIQAVWSVFTGQKMNFQVTPKERQSGIYLSMIWPQLLIFFLTIIGIFWSLYSFAIGRLNHPWVNLLNSSWAVYNLLLLSGIIRASVWQMPKYDSKKV

SEQ ID NO: 70412 - protein, 440 aa, Arabidopsis thaliana
MYLDINGVMIKQFSFKASLLPFSSNFRQSSAKIHRPIGATMTTVSTQNESTQKPVQVAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAALKAPESYFKELKRDYNVKKETLVKGLKEVGFTVFPSSGTYFVVADHTPFGMENDVAFCEYLIEEVGVVAIPTSVFYLNPGEGKNLVRFAFCKDEETLRGAIERMKQKLKRKV

SEQ ID NO: 70413 - protein, 250 aa, Ralstonia metallidurans CH34
MATSLPGVVYHPADSSPASTLQRMSLLHQARFFTTVNHLRDLPATAVPEVAFAGRSNAGKSTAINILCNQKRLAFSSRTPGRTQHINFFTVAPVKAPDPVGFLVDLPGYGYAEVSGSAKFHWQGLLSDYVQARTQLSGLILMMDARRPFTDLDCQMVEWFLPTGKPIHVLLTKADKLTTSDNAKALRETRKVLADYAAQMENPPALTAQLFSSLKRRGIEEAQRVVAGWLALPEAQPAVAKSDTPDTPQG

SEQ ID NO: 70414 - protein, 394 aa, Streptomyces coelicolor A3(2)
MDLFEYQARDLFAKHDVPVLAGEVIDTPEAAREITERLGGKSVVKAQVKVGGRGKAGGVKLAASADEAVARATDILGMDIKGHTVHKVMIAETAPEIVEEYYVSFLLDRANRTFLSIASVEGGVEIEEVAATRPEAVAKTPIDAIDGVTPEKAREIVEAAKFPAEVADKVADILVKLWDTFIKEDALLVEVNPLAKVVSGDVIALDGKVSLDDNAEFRHPDFEALHDKAAANPLEAAAKEKNLNYVKLDGEVGIIGNGAGLVMSTLDVVAYAGEAHGNVKPANFLDIGGGASAQVMANGLEIILGDPDVRSVFVNVFGGITACDEVANGIVQALKLLEDRGEKVEKPLVVRLDGNNAELGRKILTDANHPLVQRVDTMDGAADKAAELAHAAAK

SEQ ID NO: 70415 - protein, 401 aa, Synechococcus sp. RS9916
MAKRSLASLTGADLSGKRVLVRVDFNVPLNDAGAITDDTRIRAALPTINDLIGKGAKVILSAHFGRPKGQVNDSMRLTPVAARLSELLGKPVVKTDSCIGPDAEAKVGAMADGDVVLLENVRFFAEEEKNDAGFAEKLAGLAEVYVNDAFGAAHRAHASTEGVTKFLKPSVGGFLMEKELQYLQGAIDAPKRPLAAIVGGSKVSSKIGVLEALMDKCDKILVGGGMIFTFYKARGLAVGKSLVEEDKLELAKELEAKAKAKGVELLLPTDVVLADNFAPDANSQTAPVTAIPDGWMGLDIGPDSVKVFQNALADCQTVIWNGPMGVFEFDKFAAGTNAIATTLADLSGKGCCTIIGGGDSVAAVEKAGLADKMSHISTGGGASLELLEGKVLPGVAALDAA

SEQ ID NO: 70416 - protein, 399 aa, Sulfolobus tokodaii str. 7
MPVDDFSLSANSISGESTLVYQDVARQVQKTKGIRIINFGIGQPDLPTFARIREAAKKSLDEGFTGYTSAYGIDELRQKIAEHLSSKYESVRKEEVIVTPGAKTALYLAFLLYINPGDEVIIFDPSFYSYAEVVKMLGGVPVYVKMKFNESTGFSLNLSELESKINKKTKMIVLNNPHNPTGMVFDPIEIEKLMEITKEKKVLLLSDEIYDYFIYEGKMKSVLEDPDWRDYVIYVNGFSKTFSMTGWRLGYVVAKEKVIKKMAEIAANIYTCPTSFAQKGALAAFESFDEVKEMISLFKKRRDIMYEELKKIKGIQVHKSQGAFYMFPFIGEILKKANLSVKDFSLKLIEEKGVTTIPGEVFPLEVGKDFVRLSFAVKEDDIREGIKRMKEFIDMLMTP

SEQ ID NO: 70417 - protein, 133 aa, Brassica napus
  misc_feature (113)..(113): Xaa can be any naturally occurring amino acid
  misc_feature (123)..(123): Xaa can be any naturally occurring amino acid
MEDEEGIGLILARATELRLKISDCIDTSSTAVSDGVHSGGRKDGSSPAKKDEFIGNQEKDSDEEEAERLLCIRDALESLESQLAALQNLRQRQQYEKQVALSEIDYSRKMLIXEKLKDYKGKXFEVLREASTC

SEQ ID NO: 70418 - protein, 393 aa, Mycobacterium avium 104
MKAVTWHGKRDVRVDSVPDPKIEQPTDAIIEVTSTNICGSDLHLYEILGAFMKPGDILGHEPMGVVREVGTETGDLRVGDRVVIPFQICCGSCYMCGQQLYTQCETTQVRDQGMGAALFGYSELYGEVPGGQAELLRVPQAQFTHIKVPVGPPDSRFVYLSDVLPTAWQAVAYADIPDGGTVAVLGLGPIGDMASRIADHLGYRVIAVDLVPERLGRAAQRGIHTIDLARLDAGLGDAIRDLTDGRGADSVIDAVGMEAHGSPAAKLAQQVAGVLPDALGKRLMQTAGVDRLSALYSAIDAVRRGGTISLIGVYGGMADPLPMLTLFDKQVTLRMGQANVKRWVDDIMPLLTDDDPLGVDDFATHVLPLERAPHAYEIFQKKQDGAVKVILKP

SEQ ID NO: 70419 - protein, 266 aa, Triticum aestivum
MAATPLDSAWEWLITNFSEFQLATVVTFVLHESVFFLSGFPSLLFERFGLFAKYKIQKKSNTSDYQNRCVMRLILYHVCVNLPVMIFSYPAFKFMGLRSSLPLPHWTVIGSQVLFYFILEDFIFYWGHRALHTKWLYKHVHSVHHEYATPFGLTSEYAHPAEILFLGFATVVGPALTGPHLFTLWLWMVLRVLETVEAHSGYHFPWSPSNFLPLYGGSDFHDYHHRVLYTKSGNYASTFVYMDWLFGTDKGYRKTKAIEGEEGKHL

SEQ ID NO: 70420 - protein, 485 aa, Zea mays
MANLADSFLADLDELSDNEGYPEEDNAEAAGRDDDEDDDMPDLESLNYDDLDSVSKLQKTQRYNDIMQKVENALQKGTDFSNQGSILEEDPEYQLIVDCNALSVDIENEIIIIHNFIRDKYRLKFPELESLVHHPIDYARVVKKIGNEMDLTLVDLEGLLPSAIIMVVSVTASTTSGKPLSEDNLEKTTEACDRALTLDASKKKVLDFVESRMGYIAPNLSAIVGSAVASKLMGTAGGLGALAKMPACNVQLLGAKRKNLAGFSTATSQFRVGYLEQTEVFQSTPPPLRTRACRLIAAKSTLAARIDSIRGDPTGKAGRNLLEEIRKKIEKWQEPPPAKLPKPLPVPDSEPKKKRGGRRLRKMKERYAQTDMMKLANRMQFGIPEESSLGDGLGEGYGMLGQAGSGKLRVSAGQSKLAAKVAKKFKEKSYGSSGATSGLTSSLAFTPVQGIELSNPQVQGNLLGGGTQSTYFSETGTFSKIRRTQ

SEQ ID NO: 70421 - protein, 379 aa, Yersinia pestis KIM
MEMIKTRAAVAWGPNQPLSVEEVDLMPPQKGEVLVRIVASGVCHTDAYTLSGADPEGVFPTILGHEGGGIVEAIGEGVTSVAVVDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 70422 - protein, 350 aa, Staphylococcus epidermidis ATCC 12228
MKAYEYLKPGHAQLTDKEKPTITSSTDAIIRIVKTTICGTDLHIIKGDTPEVKSHTTLGHEGIGIIEEIGDNVNNFKVGDKVIISCISSCGKCYYCKKGIYAHCENGGGWILGHLVNGTQAEYVKVPFADNSLYHAPSNLKEDALVMLSDILPTGYEIGVLKGKVKPGCTVAIVGAGPVGLAALLTAQFYSPSKIIMIDLDDNRLETAKEIGATHLINSKETETAIKKVKSLNPRGVDVAIEAVGIPQTFDLCQNLIGVDGTIANVGVHGLPVQLDIDKLWIKNINVTTGLVSGNTTEELLEALKSKIIQPEQLVTHYSKLSEIESAYDLFRNATDHKAIKLIIENDITI

SEQ ID NO: 70423 - protein, 233 aa, Zea mays
MAATTDRSRMQAAALVLTLLALLPPSILGARTRPPSPPHHSQGGHKRSPPPPASLPPPPPPPPPPPPAADAGLVRATCNSTAYYDLCVSTLGADPTSATADVRGLSTIAVSAAAADASGGAAAADALATAAGNTTATPVDATTRALLRSCAAKYGEARDALSAARDSIAQQDYDYAAVHVSAAAEYPQVCRVLFQRQRPADYPPELADREEPLRRLCTVALDIITLLANNDTN

SEQ ID NO: 70424 - protein, 158 aa, Vibrio sp. Ex25
MIRIGHGFDVHKFGGEGPVIIGGVAIPYEQGLVAHSDGDVALHALTDALLGAIAAGDIGRHFPDTDDKWKGADSRELLKDVYRRVKEQGYRLGNADVTIMAQAPKMAPHIDAMCAAIAEDLETDISNINVKATTTERLGFTGRKEGIATEAVVLLFKQ

SEQ ID NO: 70425 - protein, 400 aa, Mesorhizobium sp. BNC1
MAFLADALSRVKPSATIAVTQKARELKAQGRDVIGLGAGEPDFDTPDNIKQAAIEAIKRGETKYPPVSGIQPLREAIAAKFKRENNLDYDWKQTIVGTGGKQILFNAFMATLNPGDEVVIPTPYWVSYPEMVSICGGTSVFAETRLEDNFKLQPEVLERAITPRTKWLIMNSPSNPSGAAYTREELKAVADVLLKHPHVWVLTDDMYEHLTYGDFTYHTIAEVEPQLYGRTLTMNGVSKAYAMTGWRIGYAAGPIELIKAMDMIQGQQTSGAATVCQFAALEALTGPQDFIHQSKKVFQERRDLVVSMLNQAKGISCPVPEGAFYVYPSCAGTIGKKAPSGKLIESDTDFVSELLETEGVAVVQGSAFGLGPNFRISYATSDALLEEACSRIQRFTANLR

SEQ ID NO: 70426 - protein, 203 aa, Eubacterium acidaminophilum
  misc_feature (47)..(47): Xaa can be any naturally occurring amino acid
MVSVGKKAPDFEMAGFYKGEFKTFRLSEYLGKWVVLCFYPGDFTFVXATEVSAVAEKYPEFQKLGVEVLSVSVDSVFVHKMWNDNELSKMVEGGIPFPMLSDGGGNVGTLYGVYDPEAGVENRGRFLIDPDGIIQGYEVLILPVGRNVSETLRQIQAFQLVRETKGAEVAPSGWKPGKKTLKPGPGLVGNVYKEWSVKEAFED

SEQ ID NO: 70427 - protein, 431 aa, Aspergillus oryzae
MSATTARADPFRPAKRVAGQRQDVWYGDKPAAASPVQPIVNMGQGFFGYNPPQFAIDAAKEALDKVECNQYSPTKGRPRLKQAIADAYSPSFGRKLNPDTEVTITTGANEGMLSAFMGFIEPGDEVIIFEPFFDQYISNIEMPGGTIRYVPLHPPKDGATRTSPASEWSIDFEELEKTINPKTRMIQITNGHNSHNPVGKVFSRDELEKIGELCIKHNLIILSDEVYDRLYYVPFTRIATLSPELYERTLTVGSAGKAFYATGWRVGYLIGPEHLIKYVAGAHTRICYSSVSPLQEAAAVAFEQADKAGFWDESRTEMKKKMERFCEVFDELNIPYSDPEGGYFVLANMSSVKLPEGYPFPPHVASRPRDFKLCWFLIHEVGVAAIPPTEFYTDANAHIAEDYLRFAVCKNDDVLETAKERLRGLKKYIVQ

SEQ ID NO: 70428 - protein, 124 aa, Capsicum annuum
MAATSSEEGQVFGCHNVEEWDQHFKKGVETKKLVVVDFTASWCGPCRFIAPILADIAKKMPHVIFLKVDVDELKTVAEEWNVDAMPTFVFFKDGEEVDRVVGAQKEELQAAILKHVGAPATVTA

SEQ ID NO: 70429 - protein, 274 aa, Eubacterium acidaminophilum
MDFEKANTNEYTNIKKVIAIMSGKGGVGKSSVTSLLAVSLIKKGFKVGILDGDMGGTSIPKIFGITGEKSNTSSKGIEPVTTPSGIKVMSLSFLMEKEDSPVIWRGLLISKTLRQFYTDFLWGDLDYLLIDFPPGTSDLPLTMIHSLPGGWHNNCFVPARSCKPGYRARIRNHGHSCMIVKKSADMAKRMDVPILGIIENMSYYECPDCKKRINIFGKSKTEKISKEMRIELIAHMPIDPKLAELCDEGAIEEYYNINRALVNLLSDEVLKKLS

SEQ ID NO: 70430 - protein, 339 aa, Picea sitchensis
MAPIHSSSQQWVEKYRPKQVKDVAHQEEVVRALTNTLETGNLPHLLFYGPPGTGKTTTALAIAHQLFGPEYKSRVLELNASDDRGINVVRTKIKDFAAVAVGSGNTNSGYLCPPFKIIILDEADSMTEDAQNALRRTMETYSKVTRFCFICNYVSRIIEPLASRCAKFRFKPLVEDIMTGRILHICKEEGVHLDSDALTMLSSISEGDLRRAITYLQSAARLYGSSISSNNLISVSGIVPKEVVQSLYQACKTGQFDLAQKEVSDIIAEGHPASQIFSQLYDMVVQATDISDETKARISQRLAEADKCLIDGADEYLQLLDVASNAMRSLCNMTQECCY

SEQ ID NO: 70431 - protein, 142 aa, Glycine max
MGGRKCLLTLVLSLVLMMSMAEAQSGTSADCAQELIPCLDYLNGTINPPSSCCDPLKRTVQNELACLCNIYFSPGLLQSVNVTVDEALGLSRRCGVTSDLSSCKNGSAPAPGSRPPPGKTPPNIPNFFFFFFLDELLFCSDK

SEQ ID NO: 70432 - protein, 422 aa, Staphylococcus aureus subsp. aureus MW2
MTAEKITQGTEGLNVPNEPIIPFIIGDGIGPDIWKAASRVIDAAVEKAYNGEKRIEWKEVLAGQKAFDTTGEWLPQETLDTIKEYLIAVKGPLTTPIGGGIRSLNVALRQELDLFTCLRPVRWFKGVPSPVKRPQDVDMVIFRENTEDIYAGIEFKEGTTEVKKVIDFLQNEMGATNIRFPETSGIGIKPVSKEGTERLVRAAIQYAIDNNRKSVTLVHKGNIMKFTEGSFKQWGYDLALSEFGDQVFTWQQYDEIVEKEGRDAANAAQEKAEKEGKIIIKDSIADIFLQQILTRPAEHDVVATMNLNGDYISDALAAQVGGIGIAPGANINYETGHAIFEATHGTAPKYAGLNKVNPSSVILSSVLMLEHLGWQEAADKITDSIEDTIASKVVTYDFARLMDGAEEVSTSAFADELIKNLK

SEQ ID NO: 70433 - protein, 764 aa, Sulfolobus tokodaii str. 7
MINIAGGKGANLGELISMGIRVPPGFVITSHAYKYFISYNKLDEKIKEIFEKEKDDEIISSKIRELILSSQIPPDLANQILSAYENLSKLVGKEILVAVRSSATAEDIESASFAGQQETYLNVSKGELLDAVKKVWASLYTARAISYRRFKGIDQITVEMAVVVQKMVNSRSAGVMFTLHPVTGDRNYIMIESSWGLGEAVVSGKVTPDEVVIEKSSLKIVEKKVSHKILKIVYDREKRQNIIINLSNEEADQMSISDEEAIELARLALKIEEHYGRPMDIEWAIDADMKFPDNVFIVQARPETYWTSKQIERKKEEVKVSVGKVLTKGLPASPGIAYGKARVILDVKEAKDFEKGDILVTKMTDPDWVPIMKIASAIVTDEGGMTSHAAIVSRELGIPAVVGTGNATKVIKDGEEITVDAIRGIIYEGKLTFETEEKKEATQPVSVGGISRDVLLSLYPVTATKIYMNLGQPDIIHKYLDLPFDGIGLMRIEFIVSEWIKYHPLYLIKTGKPELFVDKLAEGISMVASAIYPRPVVVRFSDFKTNEYKRLIGGEEFEPEERNPMIGWRGVSRYVSPQYEPAFRLEVRAIRKVREEMGLKNVWVMFPFVRTTWELEKAIKIMEEEGVRRGQDFKVWIMAEVPSVVVLADKFSQLVDGFSIGSNDLAQLTLGVDRDSDLLARMGYYDERDPAVLESIKRLIKVAHKYGRTVSICGQAPSVYPEINEFLVRQGIDSISVNPDAVIQVKRQVASIEQKIMLEKLRKK

SEQ ID NO: 70434 - protein, 589 aa, Arabidopsis thaliana
MATTAVNLPIHEHPLYPSARCIIGECDGCHVNGYMYNGYFCNEPFCFIWFHKECAEAPAEISHSSHHQHPLLLTNDSIDGPCDLCGQKLLPPCYSCSTCEFKVDLTCAMKPSPPAIEHPLCHHHSLVFLKKREEKVSCELCKDSIAGPSYSCLECDVYFHVNCIQLSKEVNHPCHSAHPLKLIPFESLTDDAETTCLLCGKKPAENMLYHCSVCNFTSCLGCTKNPPLLVIEHIKTHKHPLILFPRRIPCICDICGKKCEFAVYVCPQCDFVTARGCIDLARVININRHDHRIYLTHHLGTGYSKCGVCHENVNQYKGAYSCSVCPHYAVHSTCAVRTDVWDGVELEGTTEITEDNSPFKVVGDNLICHFSHEEHPLRFQKDDVFIHDEHKRCAACIHPLGFGSIYCCETCPFILHEKCANLPMKKRLVFGTRPYTLMKETTQLTDCTLCGIFSDGFAYSSRWLDVDVHCGSLNEPLVHDGHIHPLNFDKMEGHFCDGCKKNIDDYMLRCKACDFDLCLYCATLPKKIWHRNDGHPLTLCCEEKEEASDKYWCDICEKELDPMCIRRFLTSRARTKLLVWGKSQVWGGS

SEQ ID NO: 70435 - protein, 337 aa, Triticum aestivum
MAPINIGINGFGRIDRLVARLALHSPDVQLVAFYHPFITIDYITYMFKYDTVPGQWKHHEVKVKDSKTLFFGEKEVAVFGCRNPEEIPWAAAGAEYVVESTGVFTDKDKAAAHIKGGAKKVIISAPSKDAPMFVCGVNEKEYKSDIDIVSNASCTTNCLAPLAKVINDRFGIVEGLMTTVHAMTATQKTVDGPSSKDWRGGRAASFNIIPSSTGAAKAVGKVLPELNGKLTGMAFRVPTVDVSVVDLTVRLAKPATYDQIKAAIKEESEGNLKGILGYVDEDLVSTDFQGDNRSSIFDAKAGIALNDNFVKLVSWYDNEWGYSTRVVDLIRHMHSTK

SEQ ID NO: 70436 - protein, 409 aa, Brassica napus
MAKKAVLIGINYPGTKAELRGCVNDVRRMYKCLVERYGFAEEDITVLIDTDDSYTKPTGKNIRKALADLVGSADSGDVLVVHYSGHGTRLPAETGEDDDTGYDECIVPCDMNLITDDDFRDLVDRVPQGCRMTIISDSCHSGGLIDEAKEQIGESHKKDDEEEEEEESSSRFGFRKFLRSKVESAIRGNKKDEDEADEIETKEIELEDGEMILAKDKSLPLQTLIDILKQQTGNDDIEVGKIRPSLFDAFGDDSSPKVKKFMKVILGKLKAGEGEGGLMGMLGKLASGFLEGKLNDDDYVKPAMQTEVGRKEEVYAGGSRGSVPPEACGILISGCQTDQTSADATPPGKPSEAYGAMSNSIQKILEETDGEISNREMVTRARKALKKQGFTQQPGLYCHDGYANAPFIC

SEQ ID NO: 70437 - protein, 590 aa, Glycine max
MRYEMGVSILTRFHFSLPLPRATARKRIFHFCPPIACRSSMDQSSGLNLEDLKWDHSFVRELPGDPRRDSFPREVLHACYTQVSPSVQVHNPQLVAFSQPVADLLDLDHKEFQRPDFPLFFSGATPLVGALPYAQCYGGHQFGMWAGQLGDGRAMTLGEILNSNSERWELQLKGAGKTPYSRFADGLAVLRSSVREFLCSEAMHHLGIPTTRALSLVTTGNLVTRDMFYDGNPKEEPGAIVCRVAQSFLRFGSYQIHASRSDEDLGLVRVLADYAIRHHFPHIQNMSKSDSLSFCTGDEDHSVVDLTSNKYAAWVVEIAERTASLIARWQGVGFTHGVLNTDNMSILGLTIDYGPFGFLDAFDPKFTPNTTDLPGRRYCFANQPDIGLWNIAQFTTTLQAAHLINEKEANYAMERYGTRFMDDYQVTMTKKLGLPKYNKQMINKLLSNMAVDKVDYTNFFRTLSNVKADINIPDDELLVPLKSVLLDIGKERKEAWTSWLKAYIHEVSTSGIPDDERKISMDSVNPKYILRNYLCQTAIDAAEIGDFGEVRSLLKLVEHPYDEQPGMEKYARLPPAWAYRPGVCMLSCSS

SEQ ID NO: 70438 - protein, 477 aa, Haloarcula marismortui ATCC 43049
MVVGDVTTSTDVLVIGAGPGGYVAAIRAAQLALDVTLVEKGEYGGACLNRGCIPSKALIHGSKLASEAGQAEELGIYADPTVALDEMINWKDGVVDQLTSGIEQLCTAAGVNLLKGTAEFADENKVRIIHQGEGQGSESLKFENCIIATGSRPIEIPGFGFEDERIVSSDGALNFDTVPDELVIVGAGYIGMELATVYSRLGSDVSVIEMLEQALPSYEEDIASIVRKRAERLGVDFHFGYTADSWAASDGKAVLTAVPADEAAHDSDIELTADRILVAVGRRPVTDTLSIDDAGVETNAQGFIPTDSTCRTNKEHIFAVGDVAGEPMLAHKGSKEGEVAAEVIAGEPAAVDYQALPAAVFTDPEIGTVGLTENEAANKGMTPVTGEFQFQASGRALTANRAEGFVRIIATKETERVIGAQIVGPEASELIAEIAAMIEMGAKLEDIGSTVHTHPTLSEAIMEAAQNAREKAIHRRN

SEQ ID NO: 70439 - protein, 540 aa, Haloarcula marismortui ATCC 43049
MPPCRSIHWRITTCHRRSVSKTASAKQSISNMVREFELPDVGEGVAEGELLRWRVEPGDAVSEDQPVAEVETDKAVVDVPSPVDGVVEELRAAEGEMVPVGDVIIVFRVDGEDGPKATETAPADDTTAGSGQQTEVGATAQPAEETQSEPAITQRVQVPAPPSVRRLARELGVDISSVADSSSGRITEPDVRAYASPESSTQERSSQQTTAAEQRTQQAAPAQSVSPAQTREVVDRETTVAVPKTRHIAAEEGIDLDTVPTDEQKDGEPFVTLEAVQEYAEAQQQAQQTDRDAVVERAAADEPARPESRKPYKGIRQTIGAAMTSSKYTAPHVTHQDEVDVTALVDARSTLRREAEAQDIRLTYMPFVMKACAAALQENPQVNVSLDEANEEIVEKQYYNIGVATATDDGLLVPVVENVDAKGLLEVASETNEKTQKARERSLSPEEMRGGTFTISNIGGIGGEYGTPIINQPESAILALGEIKKKPRVVEADGEETIEPRHIMTLSLSFDHRVLDGADAAQFTNSIQKYLQNPNLLLLE

SEQ ID NO: 70440 - protein, 518 aa, Glycine max
MKVISFSGGITKPCFFIAQTEMPILTFAHCKLSATLALRRMGSITRLQYSVADRTFTSGSVDLPASKTDSGRVNRRRGGGSSSVYSRPSLSEMKKEKAAIREKVYEFLRAIGIVPDELDGLELPVTVDVMRERVDFLHSLGLTIEDINNYPLVLGCSVKKNMIPVLDYLGKLGVRKSSITQFLQRYPQVLHASVVVDLMPVVNYLKGMDIKFDDVPRVLERYPEVLGFKLEGTMSTSVAYLIGIGVGRREIGGVLTRYPEILGMRVGRVIKPFVEYLESLGIPRLAIARLIEQRPYILGFGLGEKVKPNVKYLEEYNVRRTSLPSIIAQYPDIIGTDLNQKLEKQRSLLNSVLDLDPEDFGRVVEKMPQVVNLSSGPMLKHVDFLKNCGFSLPQMRQMVVGCPQLLALNIDIMKLSFDYFQMVMKRPLEDLVTFPAFFTYGLESTIKPRHKMVVKKGLKCSLSWMLNCSNEKFEQRMDYDTIDMEEMEMEPSFDMNSLTQPRSDESDFDYEDSDEDDE

SEQ ID NO: 70441 - protein, 735 aa, Zea mays
MSESESSNTAGFAAALELWQENQLRILVLISLATQCFLFVFAPLRQHRIPGPLRLSIWLAYLGSDAVAIYALATLFNSHRCDTGTGTGTARAGVELLWAPIMLVHLGGQDSIPAYNIEDNELWRRHVVTAVSQVPAATGPVVPAWPKSMAATAAHLVVDQDTRNRINAFMAHKSEMAAYGRILGPALLLFFSGITKCVCKPWDLKRVSVNSLVDSSSSGSSEEKGDAGESEMMDSLQEYVGAAAQYFESVGHEEEEEDDDAACKADEVWKPYNLCVDLAPPYSGRLSCLKHLARSPADEAHRLVKSSLSATFHQLYTKESLKLHDMSHIVLTDNRALNRLKLVTSARGLRTVAAATLLGAIAAFYGEGDVDQDPTDVTITYALLWSAFVMECVLPTVIHHTFAWIERLFTGHRTWPDQVAQYSLMGYVARGRSHSWLMKAVACLGCGDLVDQLWTMKPRMGASSREITGLVHAHVAGAWMQGHIAGADSFRAFNDYRGQWTLGNCREIGVGVSSSMVVLMSSVSRPFDESVLVWHLATDFCFHLLQVQGDPSRANATARRCIEMSNYMAYLLFVKPEMLMPGARRKLFRDACRELVGLLEEDRPDAPRARGKRDLAHKVVQLLKRDGDDVLGSAGVGVVRRAWCVAEKLVDSHSGDEEKMWTVIQGVWVEMLCFSASRCKGYLHAKGLGTGGEYLSYVWLLLLYMGMETLAEKMQRTELYEGSTAAALSISGQNV

SEQ ID NO: 70442 - protein, 443 aa, Shewanella sp. ANA-3
MSQQNPGLKQSLSLWQVVVMGLAYLTPMAVFDTFGIVSEITSGHVATSYLLALAGILFTAFSYGHLVRKYPYAGSAYTYAQKTFSPNVGFMVGWSSLLDYMFMPMINMLLAKIYLTAMFPNVEPWIFIFGLVAVMTVLNLRGIDLVANFNGVIVFAQIAIILVFIGLMAHSLSLGEGEGVIASVRPFYSEEISLAPLFTGATILCFSFLGFDGLSSLSEETKDAKRVIPRAIVLTALIGGVIFVSVSYFLQLFFPDISRFQQLDAVLPEIALYVGGNLFQSVVLVATTIAVLASGMAAHAGVARILYVMGRDNMLPNKGFGYIHPKWRTPAFNVILVGLLALSAVSFDLEMALALVNFGALVAFTFVNLSVIVQFYIKEKRNQSLKDHFQYFVLPLCGAATIGVLWINLEPQSLELGLIWAAVGILYLALRSLRLRKAVELQN

SEQ ID NO: 70443 - protein, 409 aa, Zea mays
RRCRGGNGCKVGDDNGSLMVMWEDGFCRPRVAECLEDMDGEDPVRKAFIKMSIQLYNYGEGLMGKVASDKCHKWVFKEPSECEPNISNYWQSSFDALPPEWTDQFASGIQTIAVIQAGHGLLQLGSCKIIPEDLHFVLRMRHMFESLGYQSGFFLSQLFSSSRGASPTPTPPFPLKQPPAAPAARAPPQLFSWPGHHQPQQLPSPLFPPGPGAFHPSSARPMPPFPGGKDEGHMFHLPPAAHHGTNKQPPQHMDEHHQQQQQPMVGAGGDAPDGDLRWPNGLSFFTALTGRADDAKLLFGGPGAGAGAADDDDKAAPDAHGGAENVEEYLSLESHSNKARKVESPAAQSTNKFKRSFTLPARMSSSSSTSAFPSVSASTAPPQQQQAGMEYRGPHEGGVYSDLMETFLE

SEQ ID NO: 70444 - protein, 782 aa, Cryptococcus neoformans var. neoformans B-3501A
MSPDIKPSFRPEVVKSKIKHYFGYTETTPETVSVFDWARSQTPALGPGIKAYILSLFPFIQWVPRYNLTWLFGDLVAGITVGMVLVPQSLSYAKIAELEPQYGLYSSFIGVLTYAFFATSKDVSIGPVAVMSLETGNIILSVQDKYGDLYSKPVIATALAFICGFIVLGIGLLRIGWLVEFIPQPAVSGFMTGSALNIAAGQFPAVFGLSKKFDTRAATYKVIINTLKYLPQASLDTAFGMTALAALYGIKWGFTWLGKRYPRYGRITFFCQSLRHAFVIIIWTIISWRVNVHAASPRISLVGNVPSGLQHVGRPFIDSQLLSAIGPHIPVATIILLLEHISIAKSFGRLNGYKINPNQELIAIGVNNTIGTLFSAYPSTGSFSRSALKSKAGVRTPAAGLATGVVVIVALYAVAPAFYWIPNAALSALIIHAVADLVASPKHSYSFWRVAPIEYVIFVGAVLWSVFYTIESGIYWSLATSVVLLLLRIARPKGHFLGRVRIKPEAGNTLEHIRDVYVPLDEESSGEDVKVENPPAGVIIYRFEESFLYPNASYINDRLIEQAKKVTRRGGDYSKVAAGDRPWNDPGPSKKNAAAVIEADMVKPVLKAVILDFAAVANLDTTGVQNLIDTKTEMEKWADGPVEFHFCGILSPWIRRALVAGGFGQGRAKEGAALEVAPAVIENLENAASPGMERERYNEHEVSFIHEVGQASNSTSAGTSFSEEEKRIGSGATTPSPQLDGVNERRPSGVSTKTVPLLDRSTPFFHFDLADALNSLNLPENE

SEQ ID NO: 70445 - protein, 356 aa, Arabidopsis thaliana
MEVKGATRSSIIVPSVQEMVKEKVITTVPPRYVRSDQDVAEIAVDSGLRNQIPIIDMSLLCSSTSMDSEIDKLDSACKEWGFFQLVNHGMESSFLNKVKSEVQDFFNLPMEEKKNLWQQPDEIEGFGQVFVVSEEQKLDWADMFFLTMQPVRLRKPHLFPKLPLPFRDTLDMYSAEVKSIAKILLGKIAVALKIKPEEMDKLFDDELGQRIRLNYYPRCPEPDKVIGLTPHSDSTGLTILLQANEVEGLQIKKNAKWVSVKPLPNALVVNVGDILEIITNGTYRSIEHRGVVNSEKERLSVAAFHNIGLGKEIGPMRSLVERHKAAFFKSVTTEEYFNGLFSRELDGKAYLDVMRL

SEQ ID NO: 70446 - protein, 553 aa, Shigella flexneri 2a str. 2457T
MLAGIAIGPWGLGFISDVDEILHFSELGVVFLMFIIGLELNPSKLWQLRRSIFGVGAAQVLLSAALLAGLLMLTDFAWQAAVVGGIGFAMSSTAMALQLMREKGMNRSESGQLGFSVLLFQDLAVIPALALVPLLAGSADEHFDWMKIGMKVLEFVGMLIGGRYLLRPVFRFIAASGVREVFTAATLLLVLGSALFMDALGLSMALGTFIAGVLLAESEYRHELETAIDPFKGLLLGLFFISVGMSLNLGVLYTHLLWVVISVVVLVAVKILVLYLLARLYGVRSSERMQFAGVLSQGGEFAFVLFSTASSQRLFQGDQMAPLLMKLVDKWLSRQFNGPEEEDEKPWVNDDKPQVIVVGFGRFGQVIGRLLMANKMRITVLERDISAVNLMRKYGYKVYYGDATQVDLLRSAGAEAAESIVITCNEPEDTMKLVEICQQHFPHLHILARARGRVEAHELLQAGVTQFSRETFSSALELGRKTLVTLGMHPHQAQRAQLHFRRLDMRMLRELIPMHADTVQISRAREARRELEEIFQREMQQERRQLDGWDEFE

SEQ ID NO: 70447 - protein, 587 aa, Yersinia pestis KIM
MSACHTRLHLLFCHSAEISCKTGGDTLAILWHNARRITFFILLEYPYSVIKSRASSVLSTNNITMQFGSKPLFENISVKFGGGNRYGLIGANGCGKSTFMKILGGDLVPSGGNVFLDPNERLGKLRQDQFAFENNTVLDTVIMGHGELWEVKEERDRIYAMAEMSEEDGYKVADLEVAYGEMDGYSAEARAGELLLGVGIPVEQHYGLMSEIAPGWKLRVLLAQALFSDPEILLLDEPTNNLDIDTIRWLEQVLNERNSTMIIISHDRHFLNMVCTHMADLDYGELRVYPGNYDEYMTAATQARERLLSDNAKKKAQISELQSFVSRFSANASKSKQATSRARQIDKIQLDEVKASSRQNPFIRFDQDRKLFRNALEVEMLTKGFDNGPLFKNLTLRLEVGEKVAILGPNGIGKSTLLKTLLGEYESDAGTVKWSENSKIGYYAQDHASDFDIDLTVFDWMSQWKQEKDDEQAVRSVLGRLLFSQDDIKKKVSVLSGGEKGRMLFGKLMMQRPNILVMDEPTNHLDMESIESLNMALEMYEGTLIFVSHDREFVSSLATRVIEMTPNKLIDFTGNYEDYLSSQGIHS

SEQ ID NO: 70448 - protein, 337 aa, Picrophilus torridus DSM 9790
MEEIVKIGGSILTGTESIERIAELFNDSRIIVTSALKGVTDRLIRIYNENDQESLKDLIEEHKTILTAISDNFDEHLKEIANDMNYYLSCRYKSAFITSGERLAALILYAAISKRNDRFLLLNRPVIITDDSMDDAYAIMDETEKNLKNLVGYEHNYVIPGFMGLSRSGRITSLGRGGSDYSATVIARALNINVVRFITDVPGIMTADPKVVKNAYTVKEVSIYEAMEMARFGVKKFNRKTFEPVLGSNIEIRIESLVSGEMTLISNKTENTVKCLMFDESKNSVTIIGHGILNDKLQNIIITLSDNFVSNGLSITSMLKPGRSFEDVYKEVIGCQR

SEQ ID NO: 70449 - protein, 511 aa, Oryza sativa Japonica Group
MELTTLLLLALISFFFLVELIARYASPSGRESALRLPPGPSQLPLIGSLHHLLLSRYGDLPHRAMRELSLTYGPLMLLRLGAVPTLVVSSAEAAAEVMRAHDAAFAGRHLSATIDILSCGGKDIIFGPYTERWRELRKVCALELFNHRRVLSFRPVREDEVGRLLRSVSAASAEGGAACFNLSERICRMTNDSVVRAAFGARCDHRDEFLHELDKAVRLTGGINLADLYPSSRLVRRLSAATRDMARCQRNIYRIAESIIRDRDGAPPPERDEEDLLSVLLRLQRSGGLKFALTTEIISTVIFDIFSAGSETSSTTLDWTMSELMKNPRILRKAQSEVRETFKGQDKLTEDDVAKLSYLQLVIKETLRLHPPAPLLIPRECRETCQVMGYDVPKGTKVFVNVWKIGREGEYWGDGEIFRPERFENSTVDFRGADFEFIPFGAGRRMCPGIALGLANMELALASLLYHFDWELPDGIKSEELDMTEVFGITVRRKSKLWLHAIPRVPYISTY

SEQ ID NO: 70450 - protein, 88 aa, Capsicum annuum
MSQDLKKVKQEDDQLKDSLPPAKREVNRCSGCRRKVGLTGFRCRCGELFCGEHRYSDRHDCSYDYKTAGREAIARENPVVKAAKIIKV

SEQ ID NO: 70451 - protein, 524 aa, Zea mays
MAAVGAPGSSLHGVTGREPAFAFSTEHEEAASNGGKFDLPVDSEHKAKSVRLFSVANPHMRTFHLSWISFFTCFVSTFAAAPLVPIIRDNLNLTKADIGNAGVASVSGSIFSRLTMGAVCDLLGPRYGCAFLIMLSAPTVFCMSLIDDAAGYITVRFLIGFSLATFVSCQYWMSTMFSSKIIGTVNGLAAGWGNMGGGATQLIMPLVYDVIRKCGATPFTAWRLAYFVPGLMHVVMGVLVLTLGQDLPDGNLRSLQKKGNVNKDSFSKVMWYAVINYRTWIFVLLYGYCMGVELTTDNVIAEYMYDRFDLDLRVAGTIAACFGMANIVARPMGGIMSDMGARYWGMRARLWNIWILQTAGGAFCLWLGRASTLPVSVVAMVLFSFCAQAACGAIFGVIPFVSRRSLGIISGMTGAGGNFGAGLTQLLFFTSSTYSTGRGLEYMGIMIMACTLPVVFVHFPQWGSMFFPPSATADEEGYYASEWNDDEKSKGLHSASLKFAENSRSERGKRNVIQADAAATPEHV

SEQ ID NO: 70452 - protein, 118 aa, Triticum aestivum
  misc_feature (56)..(56): Xaa can be any naturally occurring amino acid
  misc_feature (61)..(61): Xaa can be any naturally occurring amino acid
  misc_feature (75)..(75): Xaa can be any naturally occurring amino acid
  misc_feature (103)..(103): Xaa can be any naturally occurring amino acid
MDSSRRPSGIQQLLAAEQEAQQIVNAARAAKTARLRQAKEEAEREIAEYRAQMEAXFQEEXTGTNGDPGANSNAXEQRTNVKDWSNSKQQAQISPKSIQMLLXTSQLWKTKVYDQPCI

SEQ ID NO: 70453 - protein, 498 aa, Nostoc sp. PCC 7120
MKTPLNCQNYINGQWLNAATETTLNSHNPADKSEIVATFPRSQADDVDRAVAAARQAYGSWRKVPAPARAEYIFRVGELLLQHKEELAQLISREMGKPLTEARGDVQEGVDCAFYSAGEGRRLFGQTTPSEMPNKFAMTMRMPIGVCALITPWNFPVAIPCWKAMPALVCGNTVILKPAEDTPACATKLIEIFAAAGLPPGVINLVHGVGEEVGKALVEHPNIDLVSFTGSSATGAYVGETCGRTHKRVCLEMGGKNAQVVMEDADLELALDGALWGAFGTTGQRCTATSRLILHRDIKEKFTTMLRERTSQLRLGAGTEPETDIGPIINNRQLQRVHEYMNIAREEGAKILIGGEIATEGQLQQGYFFQPTILDNVTPQMRVAREEIFGPVVALIEVSTFEEAIAILNDTKYGLSSSVYTRDINRAFVAMRDIEAGITYINGPTIGAEVHLPFGGVKQTGNGHREAGTTALDVFTEWKSVYVDFSGSLQRAQIDNRS

SEQ ID NO: 70454 - protein, 560 aa, Vitis vinifera
MASRRLLSSLIRSSVRRYSAKSPAISPRTPSPYPSSRPSPKGFLLNRAVDYATSAAAAASPPPPPPAKGAGPSGKITDEFTGAGAIGSVCQVIGAVVDVRFDEGLPPILTALEVLDNSIRLVLEVAQHLGENMVRTIAMDGTEGLVRGQRVLNTGSPITVPVGRATLGRIINVIGEPIDERGEIKTDHFLPIHREAPSFVDQATEQQILVTGIKVVDLLAPYQRGGKIGLFGGAGVGKTVLIMELINNVAKAHGGFSVFAGVGERTREGNDLYREMIESGVIKLGDKQASFSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEVFTGAPGKYVELKESITSFQGVLDGKYDDLSEQSFYMVGGIEEVIAKAEKIAKESAA

SEQ ID NO: 70455 - protein, 294 aa, Vibrio sp. Ex25
MQQTLTSFQQRNNQQLNLWLDQLPYQEQPLIQAMKYGLLLGGKRVRPFLVYITGQMLGCKPEDLDTPAAAIECIHAYSLIHDDLPAMDDDELRRGQPTCHIKFDEATAILTGDALQTLAFTIIADGQLNPAAETQRINMIKALAHSSGANGMCVGQALDLGAENRQVSLEEMEEIHRKKTGALIDCAVKLGALAAGEKGIEVLPHLERYSKAIGLAFQVQDDILDIISDTETLGKPQGSDQGLNKSTYPSLLGLEGAIEKAHTLLQEALQALEAIPYNTQLLEEFARYVIERKN

SEQ ID NO: 70456 - protein, 356 aa, Bacillus clausii KSM-K16
MAAWAGLLKEYGSYLPITENTPALTLGEGNTPLIKLEHLSEEWGVELYVKYEGANPTGSFKDRGMVVAVAKAKEEGAQALICASTGNTSAAASAYGARAGLRSIVVIPKGKTALGKVAQAAMYGAEIIEIEGNFDRALALVRELCETEPIALVNSVNPYRLHGQKTAAFEICDALGAAPDVLAIPVGNAGNISAYWMGFKEYDELHQTGRPRMHGFEAEGAAAIVKQHVIEHPETIATAIRIGNPASWKLAVQAANESKGEIDLVTDEEIVEAYREIAKKEGIFAEPGSCASLAGLKKHIQAGKVAKGSKIVAVLTGNGLKDPTTAIDLSNVQTTTVEDSKTALADYLMATKPAVK

SEQ ID NO: 70457 - protein, 200 aa, Zea mays subsp. parviglumis
VAKINPQAPLDKVCVLSCGISTGLGASINVAKPPKGSTVAVFGLGAVGLAAAEGARIAGASRIIGVDLNPSRFEEARKFGCTEFVNPKDHNKPAQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEIN

SEQ ID NO: 70458 - protein, 382 aa, Gluconobacter oxydans 621H
MSFTIASRLADLPRPATIAMAARARELKAQGADVISLALGQPDFPSPPEAIEAAYAAAKAGDTGYPPIPGQKPLIDAIIRKFRRDNALDVTSDRIMVANGGKQVIFNALMASLEVGDEVIVPAPYWVSYPLITRMLGGVPVEIRCREENGFRPDPEAIREAITPRTKWLVLNFPNNPTGAILERQNLEAIADVLREAPHVLVMSDEIYEHLTFDGKKHLSLLSVAPDLADRILIVNGMAKAYAMTGWRVGFACGPVPLIQAMIAVQGNSTSGVCTLAQAGSVAALDGDADGIARMLETYERRRGLVVGALQQVPGLTCVMPDGASMPIRGCGPDWWHIGAGTVARHGCGFCGGTSGRSACRDRAGLGVRIQPVSAPVFCCFG

SEQ ID NO: 70459 - protein, 224 aa, Candidatus Kuenenia stuttgartiensis
MYKDYLSRLENGAFPDVSPQMKQGALFVPYVVEKTGHGERHYDIFSRLLKDRIIFIGSAIEDTLTNLVIAQILFLQNENKNQDINIYINSPGGSITAGLAIYDTMQFVQCDVATFCIGQAYSMAAILLAGGTKNKRFGLPHTRIMLHQPWGGMRGTATDISIQAEEILKMKKCLNEILVKHTGQPLERIEADVDRDFYMSSHDAKEYGLIDEVIESLRDKKEKE

SEQ ID NO: 70460 - protein, 621 aa, Vibrio sp. Ex25
MTLDISKYPTLALANTPEELRLLPKETLPNLCDELRTYLLNSVSQSSGHLASGLGTVELTVALHYVYNTPIDKLIWDVGHQAYPHKILTGRRDKMPTIRQKDGLHPFPWREESEYDTLSVGHSSTSISAGLGMAISAQKEGKGRKIVSVIGDGAITAGMAFEAMNHAGDVHPDMLVILNDNEMSISENVGALNNHLAKVLSGSLYTSIREGGKKVLSGVPPIKELVRRTEEHLKGMVVPGTLFEEFGFNYIGPIDGHDVNELVKTLKNMRELKGPQFLHIMTKKGKGYEPAEKDPIGYHGVPKFDPTHNCLPKSSGGKPTYSKIFGDFLCDMAAQDPKLMAITPAMREGSGMVRFSKEYPDQYFDVAIAEQHAVTLATGMAIAGDHPIVAIYSTFLQRGYDQLIHDIAIMDLPVMFAIDRAGLVGADGQTHQGAFDLSFMRCIPNMVIMAPSDENECRQMLYTGHKHTGPSAVRYPRGSGMGVEIETEFTALEIGKGRMVRQGEKVAILNFGTFLGNALEAAEYLNATVADMRFVKPLDEALIRQLAADHDVLVTLEENVIAGGAGAGVVEFMMKDKIIKPVLNIGLPDEFIHQGTQDELHEELGLDAKGIEKSILDYLAK

SEQ ID NO: 70461 - protein, 178 aa, Anaplasma phagocytophilum HZ
MNLDDIGSGSNAPEEVNVVIEVSQDSHPVKYEFDEKNGALWVDRFLPTAMYYPCNYGFIPNTIAGDGDPVDVLVLARFPVMPGAVICVRPVGVLMMNDEKGEDAKVLAVPATKVDQYYGNIVNYSDLPSSFLDSISHFFSFYKKLEKDKFVSVGCWQDAASAKELIRSAIIAAKKGEN

SEQ ID NO: 70462 - protein, 406 aa, Gluconobacter oxydans 621H
MIRKPVMSFIADRLNRILPSQTIAVTQKARALKAEGRDIISLSAGEPDFDTPDFIKRAAIRAIEAGKTKYTDVAGTLELRKAVAARLNADFDLDYKAEEICVSTGGKQVIYNVMVSTLNAGDEVIIPAPAWVSYPDIVTLADGTPVIVQTDPENGFRLTAEQLRAAITPRTKWLCLNSPCNPTGAAYDTEALKALTDVLLDYPDIWILTDDMYAKLLYDGAVAKTVVQVEPRLRSRTVTMNGVSKAYAMTGWRIGFSAAPVELTRQLVKLQGQSTSNPCSIAQAAAQEAVSGPQDFISEMVAVYQERRNLVIGMLNEAPGLSCALPEGAFYAFPSIAGTLGKTSKGGRLIDGDEAFVTALLEETGVAAVHGTAFLTPGYFRISYATSTELLKEACTRVQNFCRGLS

SEQ ID NO: 70463 - protein, 227 aa, Brassica napus
MPSGAKKRKALKKKKEQEAFGASPSNKGFNGHGYDEHGSQDEGESDGNLSSPGSQGNGEVWTRDSSPSPLSGLKKDTAKEKTDVPQGQEAKGEDVTALGRGTCHEEKNGVDKPHNNFSENVTHNTVKAATKEAGGGTLEIAPADDSVTKVVITNNNGPAEISTDLGSVQLEEAKEGNIPGSAAETSKESQVPESSEDKSLLPSGPPVTRTSWLSCCGLFDVMAGSER

SEQ ID NO: 70464 - protein, 369 aa, Gluconobacter oxydans 621H
MSDAYKLLVLAGDGIGPEVMREVARIVHWMSAHRGLKLEITEELVGAASLAVHGVPIRDEVIELARQSDAVLFGSVGDPAWSHVGFDKRPEVAILKLRKELELFANLRPAKLFDALIDASALKPEVVRGLDLMIVRETVGGIYFGEPRGIETLPDGSRRGINTEVYTTSEIERVARVAFDLARKRDNRVCSVEKCNVMESGLLWKEVVTDVHKREYPDVQLSHMLADNCAMQLVRDPNQFDVIVTGNLFGDILSDLASMLTGSLGMLPSATLGPVRADGKRNALYEPIHGSAPDIAGKGIANPLAQILSFAMLLRYSLNRAEDADLIEMAVSNVLASGLRTGDIMSPGMARVGTEMMGQAVLREMEKLA

SEQ ID NO: 70465 - protein, 509 aa, Anabaena variabilis ATCC 29413
MSNSELDRVIVRPVDEYNQKLVAYVHPPNWVNPQPADSYDLVVIGAGTAGLVVAAGAAGLGLGLKVALIEKHLMGGDCLNVGCVPSKTIIRSSRVVGEIWNGKNLGINIPSQIDIDFPAVMARMRRIRADISHHDSAERFASLGVDVFLGSGKFASSDIVEVAGKTLKFKKAVIATGARATKPAIIGIEQAGYLTNETVFSLIQRPEKLAVIGGGPIGCELAQAFRRLGSEVVLIHSGSHLLNKEDNDAAQVVQQTLIKEGIRLVLNAKVEEVVTVTEGKRLYFSTNGYRDSVTVDEILVGAGRSPNVEGLNLEAVGVKYDKRRGVEVNDYLQTTNPKIYAAGDICMDWKFTHAADAAARIVIKNTLFSPFGLGRSKLSSLVMPWVTYTDPEIAHVGLYESQDVETIKIPFSSVDRAIADAQEDGFLKIHHKKGSDEIVGATIVATHAGEMISEITTAIVNKIGLNKLSNVIHPYPTQAEAIKKAADTYRRTLLTPRTKKLLGFLTKFS

SEQ ID NO: 70466 - protein, 695 aa, Mycobacterium avium 104
MADISAIYVAAPEPETGKSTVALGLLHRLTATVAKVGVFRPITRDGQDRDYILELLLSRTTAGLSYQQCVGVTYQQLHADGDAAIATIVDAYHAMAELCDVVVIVGSDYSELGQAIRPAELSTNARIAVNLGAPILLTVSGKGRTAAEVATVVQVCLAELDAQHAHTAAVVANRCEPAELDAVAEALRGFPQRCYVLPDEPLLSAPTVTELEKAVAGSPVSGEESLREREVTGILVAGMTADHVLERLADGMAVITPGDRSDVVLAVASAHAAEGFPSLSCIVLNGGFALHPSIAALVAGLRLRLPIVATALGTYDTASAAAAARGRVTATSQRKIDTALELMDRHVDIADLLEQLAIPIPTVTTPQMFIHQLTLQARADRKHIVLPEGDDDRILRAAGRVLQRRVADLTILGDEARIRQRSGELGVDLSDVKVIDPRTSALRPEFAQQYAQLRKAKGVTIEQAREIMRDATYFGTMLVYTSQVDGMVSGAAHTTAHTVRPAFEIIKTVPDVSTVSSIFLMCLPDRVLAYGDCAIIPNPTPEQLADIAISSARTAAQFGIEPRVAMLSYSTGDSGTGADVEKVRTATQLVRQRNPDLPVEGPIQYDAAIEPSVAATKLRDSPVAGRATVLIFPDLNTGNNTYKAVQRSAGALAIGPVLQGLRKPVNDLSRGALVEDIVNTIAITAIQAQGLPGGR

SEQ ID NO: 70467 - protein, 372 aa, Haloarcula marismortui ATCC 43049
MSQYAARVEEMDISGIREVFEAAGEDAINLGLGQPDFPTPEHAREAAMSAIQDGMGDSYTSNKGIPELREAISDRYATDNGQDIPAENIIATAGASEAIHVAIEAHVQPGDEVLCPDPGFLAYEQLVLLAGGEPKRVELRDDLTLDPAAVENAITDNTSLFIVNSPANPTGAVQSKRDMAEFARIADEHEVICLSDEVYEKIVFDGEHHSPAEFANSDRVIQASACSKTYSMTGWRLGWVAASAERIERMLRVHQYVQACASAPSQYAAEAALTGPQEPVREMVSAFEERRNVLLDGLADIGLDTPVPKGAFYAMPHVPDGWTQKMLDNDVIVVPGEAFGPSGKGQARISYATSTAELKEALEVMRTVTNSL

SEQ ID NO: 70468 - protein, 259 aa, Oryza sativa Indica Group
MAAAEAAAALEGSEPVDLVKHPSGIIPTLQFSLGGYYMFEVLICLIDEKGGRSEIRESEKVEHAYIAACHSVPASMCSHKNIVSTVNLDCKLDLKAIALQARNAEYNPKRFAAVIMRIREPKTTALIFASGKMVCTGAKSEQQSKLAARKYARIIQKLGFAAKFKDFKIQNIVGSCDVKFPIRLEGLAYSHGAFSSYEPELFPGLIYRMKQPKIVLLIFVSGKLVLTGAKVRDETYTAFENIYPVLTEFRKVQQCLLPI

SEQ ID NO: 70469 - protein, 459 aa, Coccidioides immitis RS
MLQETGPRISSLADVPISLLKAELERRSLDIRAQGVSPGPAQPSTRPACGSTTRAGSYNTPIHVFALFLILILSTLACSFPIIARRFPRLPIPRRFLFLSRHFGTGVLIATAFVHLLPTAFISLTNPCLPHFWNRGYPETAGLVAMIAVMIVVTIEMFFAMRGAGHVHGSEYDTLMDEVSHHNHYEGLGVGRDDTRGSGTQHGTRQMSLGFRPVPTASRDSLIDGASPTLAKDPENQRQGDDENLQLEELDPFPDDSSEFNDSPTSEAHPSHPRPPPHHSHGHVHFSGSRSQKAQKQLIQCLLLEAGILFHSVFIGMALSVATGANFIVLLVAISFHQTFEGFALGARIASLIPDLFPASSPKPWLMALAYGTTTPIGQAIGLGLHTLYDPASEIGLITVGMTNAFSSGLLLFAGLVELLAEDFLSDRSFETLRGRNRIEACFAVAGGAALMALVGAFA

SEQ ID NO: 70470 - protein, 430 aa, Synechococcus sp. RS9916
MLDSLDLVIDTIVAREVLDSRGNPTVEAEVLLEGGASGRAIVPSGASTGAHEAHELRDGGSRYMGKGVTKAVDHIEDRIAPALCGLSALDQAAVDSTMQELDGSENKSNLGANSILAVSMATARAAANGVGLPLYRYLGGPMASLLPVPLMNVINGGAHAANSLDFQEFMLVPHGAPTFREALRMGTEVFHTLKGLLHDRGLSTSVGDEGGFAPDLGNIEAGDVLVQAIEKAGYKPGEQISLALDVASTEFFKDGRYAFDGGSFDSAEMVGQLEQLVNRFPIVSIEDGLAEDDWSGWKLLTERLGSKVQLVGDDLFVTNSKRLQQGIDQGVANSILIKVNQIGSLTETLQAIDLAGRSGYTSVISHRSGETEDTTIADLSVATRAGQIKTGSLSRSERVAKYNQLLRIEDELGSQAVYAGAAGQGPRGNG

SEQ ID NO: 70471 - protein, 375 aa, Solibacter usitatus Ellin6076
MNTAILALEDGSVFEGRSFGAPTERSGEVVFNTALTGYQEVFTDPSYSGQIVILTNPQIGNYGTSSRDNESKGPYIEGLVVREFSSIASNWRSDSSADRFLANSGVPIVSDLDTRALVRHLRTRGVMRGVLSAVESDAQKLVEKARNIPTMTGLDLASRVTTAERYEWTKTVEQCSPSDLVGKTAEPLYNVVAYDFGIKHNILRRLVHAGCRVTVVPALTSAEDVLALNPDGIFLSNGPGDPEPLVPQVNNIRKLIGKKPIFGICLGNQLLGLAMGGKTYKLKFGHRGANHPVRNEITKRVEITSHNHGFAVDPDSLNLNEVEITHVNLNDQTLEGFRHRSHPVFCVQYHPEAAPGPHDSHYLFDDFTRLMREAK

SEQ ID NO: 70472 - protein, 245 aa, Vitis vinifera
MALSLHSPSSLLTPIQPSKPSSLTLLNCQYSPLTKPTNHITYNDAAVLSNPSPSKKWRVGVSFFPAFLKKGKDAKALKEELLDAIAPLDRGADATLEDQQRVDQIASELEAVNSIKEPLKSDLLNGKWELIYTTSQSILQTQRPKFLRSIANYQAINVDTLRAQNMESFPFFNQVTADLTPLTAKKVAVKFDSFKILGLIPIKAPGRARGELEITYLDEELRVSRGDKGNLFILKMIDPSYRVPV

SEQ ID NO: 70473 - protein, 213 aa, Coccidioides immitis RS
MQNVNPTIINAADLPRRESVTKTTAPSRKADVFDGTIFASSNLATRPWEDDPFSTYLDKSNSETESVGELEDDSEEPIDEQEIYAWTSIDLISTISDPEHPISLGELAVVSLPDISITPALPSDPSSPLKKVTVLVTPTITHCSLATVIGLGVRVRLEQSLPSRFRVDVRIKEGTHSTAEEVNKQLADKERVAAAAENSTLMSVIEKMLETCK

SEQ ID NO: 70474 - protein, 256 aa, Vitis vinifera
MAISSYSCSSYPSATLLNGTLHSSFTDLFISRTPLPINIKPKPILTTTQTYHYHPHKALEFSGYWKWRTGVSFFPSFLTKSKDSEALKEELFTAIAPLDRGAEATAQDQELVDQIARKLEAVNKIKEPLKSDLLNGKWELLYTTSQSVLQTQRPKFLRPNGKIYQAINVDTLRAQNMETWPFFNQVTANLVPLNARRVAVKFDFFRIAGLIPIKSPGSGRGQLEITYLDEELRISRGDRGNLFILKMVDPSYRVPL

SEQ ID NO: 70475 - protein, 295 aa, Triticum aestivum
MGAGMVELGPGVVEVGAAEAAQTVPPAKRRRVLAVKTAAAAAAGRRPRRDRRPTAIQRLFQACRAVFKGPGTVPKPAEVALLRAMLDKMRPEDVGLSSNMPFFRNREAATEGTPTITHTTIYKSEKFSMVLFFLPTNAVIPLHNHPGMTVFNKLLIGSMHAKSYDWADPDDPANESGASSPDGKLRLAQLVVDDVFTAPCDTSVLFPTAGGNMHRFRAVAPSAFLDILGPPYSIEEDRDCTYYTDIPYSEHRMTSNEPIGDEQEGRRLAWLKEVEMPKDLKMCSVRYGGPPISGR

SEQ ID NO: 70476 - protein, 576 aa, Aspergillus oryzae
MNCPSRTDDTLEHPGWNQNPSDLNADVTTRNDFNGIANSKVHRKHASGVGAAMGEGIATVEPQLHGRDRNDTESEKKMPGEVVSAASGYQTPERNSRSPRRSLKTSITAPFSHMVQSIVKFARFVGPGFLIAVAYIDPGNYATDVAAGAEYRYALLFIVLVSNLFAIFLQSLCIKLGTVTGLNLAENCREHLPRWLVYILYFLSEAAIVATDIAEVVGSAIALNLLLKIPLVAGCAITLADVLFILIFYKPDGSMLGLRLFEFFVMGLVLGVVVCFCIQLSLIRDQSVGDVFRGYLPSSAIVESTGLYQSCGILGATVMPHSMFLGSGVVQSRLKEFDVTEGYVDPSVCLGSTNGEVEYRPSLHAIRGCLKYSIVELALSLFTFALFVNSSILIVAGAALYGNPDVGEADLWGIHDLLSTSIAPAAGLIFGLALLLSGISAGIVCTMAGQMVSEGMLNWSIRPWLRRLITRSVSIIPSIVVAGAVGRKGLDKTLTASQVVLSVILPFVSAPLVYFTCRNRYMTVPSDRVMHGEDQTQTEGVKMKNNLITTVIAIVIWLIIAVMNVALLVLVGLGKA

SEQ ID NO: 70477 - protein, 235 aa, Glycine max
SISYRDAPYRRDSRRGFSRDNLCKNCKRPGHYARECPNVAICHNCGLPGHIASECTTKSLCWNCKEPGHMASSCPNEGICHTCGKAGHRARECSAPPMPPGDLRLCNNCYKQGHIAAECTNEKACNNCRKTGHLARDCPNDPICNLCNVSGHVARQCPKANVLGDRSGGGGGGGGARGGGGGGYRDVVCRNCQQLGHMSRDCMGPLMICHNCGGRGHLAYECPSGRFMDRYPRRY

SEQ ID NO: 70478 - protein, 439 aa, Acinetobacter sp. ADP1
MDLVSRIENLPIGKFHYTLLWVVGLGWMFDALDTGIIAFIMTTLVKDWALTPAESGWIVSIGFIGMALGAVFSGGLADRFGRKTVFATTLLIYSLATAACAFAPNLTWLLAFRFIVGLGLGGQLPVAVTLVSEYIPAHVRGRFIVLLESFWGLGWLVAALVSYFVIPHFGWHIAFLIGGLPAIYVYVIIKKVPESIPYLINRGRIDEAHELVQQIERHAGVPVIDTIVVKPVAQKQQVSFRQLWSGRFARRSLMLWLVWFGIVFSYYGIFTWLPSLLVKQGYSVVQSFEYVLIMILAQLPGYISAAWLVERLGRKATLAGFIGACAISAYFFGQADTVFNIMVWGCLLSFFNLGAWGVLYTYTPEQYPANIRAFGAGWASAVGRMGGIAAPIVVTHMMVAHDGFHQVFMMFTLVLLAVAAVIVILGEETQGKTLESIGL

SEQ ID NO: 70479 - protein, 82 aa, Arabidopsis thaliana
  misc_feature (70)..(70): Xaa can be any naturally occurring amino acid
KSSAAFPVTRKTNKDITSIASNGGRSSCMKVWPPIGKKKVETLSYLPDLSDVELLKKVTTFSANRWIPCXEIRVKARIVYRE

SEQ ID NO: 70480 - protein, 174 aa, Polaromonas sp. JS666
MAIYSLNGVAPQISESAWVEKSATVIGNVELQNDASVWFGAILRGDSDKIHVGKGSNIQDRSVFHVDKGQPLHIGNFVTIGHGVTLHGCSIGDGSLVGINAVILNGAMIGKNCLIGAGSLVTEGKEFPDGWLVVGSPAKAIRPLTREQIAGLERSARHYMNNAVLFRTSCLGIA

SEQ ID NO: 70481 - protein, 431 aa, Gluconobacter oxydans 621H
MTSFAELKLAEPIQKALAEEGYTTPTPIQAGAIPYLLEGRDLLGLAQTGTGKTAAFALPILNHIFTNRRPAPPKGVRALVLAPTRELASQIGESFAAYARHMKFSYAVVFGGVGQGRQIETTRRGVDVLVAAPGRLLDLIGQKHIDLSTLEILVLDEADRMLDMGFVRDIQRIMALLPKQRQTLLFSATMPPSISDLAHSLLKNPATVQVTPESSTVDRINQAVMFVDSGSKKDAALMLLESPSVARAVVFTLMKHEANKVAEFLNKNGIRAEAIHGNKSQGARERAMAGFRSGAIKALVATDIAARGIDVDEVSHVFNYDLPNVPESYVHRIGRTARAGREGCAVSLCDAEQRAWLKDIEKKIGKPIPVVTDHPFHSEEARLSTQRPPVLGGGRGGGGGGRRRSGPPSGGRPGGGRGGAPGRGGPRPGAR

SEQ ID NO: 70482 - protein, 175 aa, Acinetobacter sp. ADP1
MSYNNIPAGKDAPNDIYVIIEIPANAAPIKYEIDKDSDALFVDRFMGTAMFYPANYGYVPNTLSEDGDPLDVLVVTPYPVAAGSVIRCRPVGKLNMEDDGGIDAKLIAVPHEKLSPLYKDVQEYTDLPQLLISQVEHFFAHYKDLEPGKWVKISGWEGADVAKAEVLKAIEAAKK

SEQ ID NO: 70483 - protein, 289 aa, Brassica napus
  misc_feature (268)..(268): Xaa can be any naturally occurring amino acid
MSTDLTEEESLSGKDYQDPPRVKIFEARELGKWSFYRAVIAEFIATLLFLYVTVLTVIGFKSQTDLQTGGGACASVGLLGISWAFGGMIFILVYCTAGISGGHINPAVTFGLFLASKVSLVRAISYIVAQCLGATCGVGLVKVFQKTYYNRYGGGANVLADGYNVGVGVGAEIIGTFVLVYTVFSATDPKRNARDSHIPVLAPLPIGFSVFMVHLATIPITGTGINPARSFGAAVIYNNQKAWDDQWIFWVGPFVGAAIAALYHQFVXLRAGAMKAYGSVRSQLHELHA

SEQ ID NO: 70484 - protein, 238 aa, Picea sitchensis
MCSLEKRDGVFILTLSGEGEHRLNPASIDSILSALAHVNENAHLVSALITTNDGKFFSNGLDLQWVSEFSSSRESRSQILGLKYAQLLVAVMELKLPSIAAVCGHASAGGFIFALAHDYRFMRRDRGFLYMSEVDVGISIPPSVMSIIRSKVGSRHLTEVLLGGRKYTAPMAFKAGIVDSVHENSGETLQAAMDASVKMGKRNWNKEAYLQLRFSLFPEVTEKLGLRLKGRSPLLSSL

SEQ ID NO: 70485 - protein, 474 aa, Solanum lycopersicum
MSRYDSRPADPGSYRDRRSDSGFGGGSNYRSSSSSRRDSEGKESPRKVNLDDLPPFEKNFYVESPSIAAMTEGEVEEYRRRREITIEGRDVPKPIKSFHDVGFPDYVLQEIEKAGFTEPTPIQAQGWPMALKGRDLIGIAETGSGKTIAYLLPAIVHVNAQPILDHGDGPIVLVLAPTRELAVQIQQEATKFGASSRIKNTCIYGGVPKGPQVRDLQKGVEIVIATPGRLIDMLESNHTNLRRVTIVLDEADRMLDMGFEPQIRKCISDTPDRQTLYWSATWPKNVNHVSSACGNRLGDQKYNKLVKLLEDIMDGSRILIFRTLKGCDQVTRQLRMDGWPALSIHGDKSQAERDWVLSEFKAGKSPIMTATDVAARGLDVKDVKFVINYDFPGSLEDYVHRIGRTGRAGASGTAYTFFTAANARFAKDLVNILEEAGQKVSPELAKMGRGAPPPPGHGGFRDRGRGYGGNKQWS

SEQ ID NO: 70486 - protein, 541 aa, Oryza sativa Indica Group
MAPLPAAATATASSAATPADDEAHSLLPSTPSDEEDDDDLEERAYEATEKVIVSISDFPDADDDEEESGLATSTAASGIPPFSWRKLWLFTGPGFLMSIAFLDPGNLEGDLQAGAVAGDTLLWLLLWATSMGLLVQLLAARVGVATGRHLAELCRDEYPSWARRALWLMAEVAMVGADIQEVIGSAIAIKILSRGFLPLWAGVVITALDCFIFLSLENYGVRKLEAVFAILIATMAVSFAWMFTDTKPNMKNLFIGILVPKLSSRTIRQAVGVVGCVIMPHNVFLHSALVQSRKIDPNKEHQVREALRYYSIESTIALAVSFMINLFVTTVFAKGFYGTKEAGNIGLENAGQYLQEKFGGGFFPILYIWGIGLLAAGQSSTITGTYAGQFIMGGFLNLKLKKWIRSLITRSFAIVPTIIVALFFDKSDSLDVLNEWLNVLQSIQIPFALIPLITLVSKEKVMGVFKIGRNTQAVTWTVATLLITINGYLLLDFFSSEIRGLLSGSILCVAVLAYASFVLYLILRGTELPNQIITTIRKSFS

SEQ ID NO: 70487 - protein, 391 aa, Staphylococcus epidermidis ATCC 12228
MRRHSMEMSERLASIPDSYFGKTMGRIVEHGPLPLINMAVGIPDGETPKGIINHFSEALCIPENQKYGPFHGKDAFKQAIVNFYQRHYDVELDKEDEVCILYGTKNGLVALPTCVVNPGEIVLLPDPGYTDYLAGVMLADAKPLPLKLSPPNYLPNWNTISAKVLEKTKLIYLTYPNNPTGSTATQDDFDEAIHRFKGTQTKIVHDFAYSAFGFDAKNPSILASKNAKDVAIEIFSLSKGYNMSGFRVGFAVGNKKMIQALKKYQTHTNAGMFGALQDAATYALNHYDEFLEKQNEIFRRRRDNFESQLKHAHLPFVHSKGGIYIWLHTPPGYDSEAFEQLLLKEKSILVAPGKPFGENGNQYVRVSLALDDKQLEEAANRLTQLRYLYER

SEQ ID NO: 70488 - protein, 196 aa, Triticum aestivum
  misc_feature (37)..(37): Xaa can be any naturally occurring amino acid
  misc_feature (56)..(56): Xaa can be any naturally occurring amino acid
  misc_feature (160)..(160): Xaa can be any naturally occurring amino acid
  misc_feature (175)..(175): Xaa can be any naturally occurring amino acid
LLLGTIEQASTAGWYRSVPPGISSTHASAATSVAPFXGLKSTAGLPVSRRSNGASXGSVSNGGRIRCMQVWPIEGIKKFETLSYLPPLSTEALLKQVDYLIRSKWVPCLEFSKVGFIFREHHPSPGYYDGRYWTMWKLPMFGCTDATQVINQVEEVKRDXPDAYVPIIGFDNMRXCSAVTFIAFKPTGLARNPGKA

SEQ ID NO: 70489 - protein, 535 aa, Brucella melitensis 16M
MPVLKSEISTRSTSFEANRKAMLAAIDVVAEASRIAIDGGGEKARDRHVSRGKLLPRERVAQLLDPGSPFLELGLTAAHGMYGGPAPAAGFITGIGRVSGRECMIVCNDATVKGGTYYPMTVKKHLRAQEIAGENRLPCIYLVDSGGANLPNQDEVFPDRDHFGRIFYNQAQMSAAGIPQVAVVMGSCTAGGAYVPAMSDETVIVRGQGTIFLAGPPLVKAATGEVVSAEDLGGGDVHTRLSGVADHLANDDAHALQIARAIAANLASEKRSFIPRGDGAAPLYDPEELLGVVSADTRIPYDVREVIARLVDGSDFDEFKARYGTTLVCSFASVYGMPVSIITNNGVLFSEAALKGAHFIELCCQRNIPLVFLQNITGFMVGRKYEAEGIAKHGAKLVTAVATANVPKITMLIGASYGAGNYGMAGRAYSPRFLWTWPNSRIAVMGGEQAAGVLATVKRDGIERTGGTWSAEEEAEFKRPTLEMFERQSHPLYASARLWDDGIVDPRKSREVLGLSLSATLNAPVEPTRFGIFRM

SEQ ID NO: 70490 - protein, 405 aa, Vitis vinifera
MAASLQLSARPFKPHFQSKSLSKPSSIRLATIRCSAATPPKRYSITLLPGDGIGPEVISVAKNVLKLAGSLEGIEFGFQEMPVGGCALDLTGVPLPEETLLVAKQSDAVLLGAIGGYKWDSNEKHLKPETGLLQLRSGLKVFANLRPASVLPQLVDASTLKKEVAEGVDLMVVRELTGGIYFGKPRGFSKNENGEEIGFNTEVYATYEIDRIARIAFETAQKRRGKLCSVDKANVLEASMLWRKRVTAMASEYPDVELSHMYVDNAAMQLVRNPKQFDTIVTNNIFGDILSDEASMITGSIGMLPSASVGESGPGLFEPIHGSAPDIAGQDKANPLATVLSAAMLLRYGLGEGNAAKRIETAVLDTLDRGFRTRDIYEAGTKLVGCKEMGEQVLKAVESQIRAAV

SEQ ID NO: 70491 - protein, 247 aa, Mycobacterium sp. MCS
MLGHMTDSKIILVTGASSGIGAAVATHLARAGHHVIAGARREDRLRELADGAADLERGSLSVRRLDVTDRAEMAAFVDDAVSTHGRLDVLVNNAGIMPLSRLDALLVDQWDAMIDVNVRGLLNGIAAALPHFHRLGGGHFVTVASIGAHEVVPTSAVYSATKYAAWAITEGLRQESDPSIRVTTVSPGVVESELASTITDPGAAAAMQEYRAAAITPDAIARAIAYAISEPEEVDVNEVIVRPARQR

SEQ ID NO: 70492 - protein, 459 aa, Staphylococcus epidermidis ATCC 12228
MADKLQRELSNRHIQLIAIGGAIGTGLFLGAGQSIHLAGPSILLTYIIVGFVLFMFMRAMGELLLSNLGFKSFGDIAHHHIGSMAGFMVGWTYWLTWIISGMAEVTAVAKYVSFWYPTIPNWLTAAATILVLVALNLFSAKLFGELEFWLSIIKVLTILALIAVGVVMIVFGMKTSYGPATVTNIWKDGGFFPNGAQGFFMSFQMAIFSFIGIELIGITAGETKDPHKTIPQAINNVPFRILLFYIGSLAVIMSVVPWQQLNPADSPYVKMFGLVGIPFAAGIINFVVLTAAASSCNSGIFANSRTMFGLAGRKQGPAFLHRTNKHGVPHYAILVTCGLLSISVVLNAIFKDATKVFVQITTFSTVLNIMIWTIIMIAYLGYLRHEPKQHKESNYKMWGGKYMAYSILGFFAFIFIILLINSATRYAVLSAPVWFVIMLLMYQKYKKESRKAKIKNEEE

SEQ ID NO: 70493 - protein, 285 aa, Staphylococcus epidermidis ATCC 12228
MNEQWMSALPLDNVKDISPVSGGDVNEAFKVTTVEEDIFFLLVQRQRSEAFYAAEIAGLNEFENAGITAPRVIASGEINGDAYLLLSFLEEGSQGSQRELARLVARMHSQYQQDNKFGFRLPHEGADISFDNSWTETWKEIFINRRMDHLQDELLRVGLWKQEDKKMYERVRKVIVDELSNHTSKPSLLHGDLWGGNYMFLTNGQPALFDPAPLYGDREFDIGITTVFGGFTQEFYDEYNQQLPLAKGSQKRIEFYRLYLLMIHLLKFGGMYADSVQRSMKIILE

SEQ ID NO: 70494 - protein, 420 aa, Anaplasma phagocytophilum HZ
MPVKVLMPALSPTMKSGTIAKWHKNAGDAVKPGDIVADIETDKAVIEFEYADEPGVMYKILKEEGSKNVAVNQSIAVIKVDGDEEAALLEMVHSAEGASGSVSNEAASAALQATPAKVAGDMVAPSSANKASETAHITSGSDRVKASPLAKKLAAQLSVDISKITGSGPYGRVVKADVLGASVPTSDTTIQEGSRVVEVSTMRKVISERLAESKRNIPHFYLAIDCMVGELLEVRSRINSNAEALGTKITVNDLVIKATALAAREFPEVNALWAGDKIVYHQNVDIAFAVALDDGLLTPVIAGADKMTLSELSKTAKSLVARAKDRKLLPHEFQGGCLTISNLGMFCIKEFYAIINPPQSCIMAVGQSEKRPVVVDNCVVAADVMSVTLSVDHRVIDGALAAKFLNRFKFYIENPLAMLA

SEQ ID NO: 70495 - protein, 307 aa, Anabaena variabilis ATCC 29413
MRGFDRLDTVDLSTWVALAKTKTNCGRVVERIPRLAVADTAWFAVHICCKSGKFYSEGDTNCVFPLMSVIKPFTFLYLLEHMGMEKVLSWVGVKPSDAPFNSLEQLVADGGYPRNPMINSGAITLADKLLGEDADYSTRSFCEWLNQLAGSQIQLDESMLASVRLSRSPANQAIANYLAEKGYLGNLDVALDTYEQICCLSGTVEDLALLGKLLALESSSISPQHQQLVNSVMLSCGLYQASAEYADKIGLPMKSGIGGGLLAVVPKEGAIACYSPALDRIGNPVGAIAFVEVLSRSLGLCGRFSHL

SEQ ID NO: 70496 - protein, 237 aa, Aspergillus oryzae
MKLNISYPANGSQKIIEVDDERKLRPFMEKRMGTEVVGDSLGDEFKGYLFKITGGNDKQGFPMKQGVLLPTRTRLLLADGHSCYRPRRTGERKRKSVRGAITGFDLAVLALSIVKQGEGELPGLTDTVVPKRLGPKRATKIRRFFGLDKKDDVRKFVIRRTVTKEGKPEYTKAPKIQRLVTPQRLQRKRHRIAIKRRRSEAAREAANDYAKLLANRVHEEKAKRDELRKRRASSMRK

SEQ ID NO: 70497 - protein, 320 aa, Aspergillus oryzae
MAANSIKLLTGNSHPELANLVADRLGIELTKIMVLQYSNQETSVTIGESVRDEDVFILQSTKPNDINDGLMELLIMINACKTASARRITAVIPNFPYARQDKKDKSRAPITAKLMANMLQTAGCNHVITMDLHASQIQGFFNVPVDNLYAEPSILKWIRENLDVSNCIIVSPDAGGAKRATAIADRLDLQFALIHKERPRPNEVSRMVLVGNVQDKVAIIVDDMADTCGTLAKAADTVMQHGAKEVNAIVVHGILSGKAIENINKSCLKRLVVTNTVPHQEKKEQCDKIETIDISPTLAEACRRTHNGESVSFLFSHAVA

SEQ ID NO: 70498 - protein, 367 aa, uncultured archaeon GZfos32E7
MEETVAKIRKFALQNAVRYEKPPKVDAVLKKILGENPELRKDAKHVYALVKEEIKRIESMSKDARIAELAKLAPELVAEPKEKEKEKQEVRLPDLQLTEGEEVVMRFAPNPNGPATLGSVRGIIVNSEYAKRYKGKFILRFDDTDPVVKRPLLDAYDWYLEDCAWLDAEPDEVVVASDRIDIYYKYAEELLKKNAAYVCFCTSDAFKIYKEREEPCPHRAVSVMANMANWEKMLTGAYEEKEAVLRIKTDMASADPALKDWVAFRILKKDHPRVGSRYVVWPTLDFESAIEDHLLGITHIIRGKDLMKSGQRQQFLYDYLGWRYPRTILWGRIKMQEFGKFSTSELRKQIESGEYDGWDDPQLPTLK

SEQ ID NO: 70499 - protein, 385 aa, Oryza sativa Indica Group
MADKENSTPASAARLTRSSAAAGAQAKRSAAAGVADGGAPPAKRKRVALSDLPTLSNAVVVAPRQPHHPVVIKPSSKQPEPAAEAAAPSGGGGGSPVSSASTSTASPSSGWDPQYASDIYTYLRSMEVEARRQSAADYIESVQVDVTANMRAILVDWLVEVADEYKLVADTLYLAVSYLDRYLSAHPLRRNRLQLLGVGAMLIAAKYEEISPPHVEDFCYITDNTYTRQEVVKMESDILKLLEFEMGNPTIKTFLRRFTRSCQEDKKRSSLLLEFMGSYLAELSLLDYSCLRFLPSVVAASVVFVAKLNIDPYTNPWSKKMQKLTGYKVSELKDCILAIHDLQLRKKCSNLTAIRDKYKQHKFKCVSTLLPPVDIPASYLQDLTE

SEQ ID NO: 70500 - protein, 386 aa, Staphylococcus aureus subsp. aureus MW2
MYYHQPLLLTPGPTPVPDAIMREIQAPMVGHRSKDFEDIAQQAFQGLKPIFGSQNDVLILTSSGTSVLEASMLNIVNPEDHFVVIVSGAFGNRFKQIAQTYYKNVHIYDVTWGEAVDVKDFINFLSTLNVEVKAVFSQYCETSTTVLHPIHELGNAINQFNSNIYFVVDGVSCIGAVDVDINKDKIDVLVSGSQKAIMLPPGLAFVAYSHRAKERFKEVTTPKFYLDLNKYISSQADNSTPFTPNVSLFRGVNAYVETVKAEGFNHVIARHYAIRNALRSALKALDLTLLVNDKDASPTVTAFKPNTNDEVKIIKDELKNRFKITIAGGQGHLKGQILRIGHMGKISPFDILSVVSALEIILTEHRKVNYIGKGISKYMEVIHEAI

SEQ ID NO: 70501 - protein, 379 aa, Pennisetum glaucum
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHSKSAESNMCDLLRINTDRGVMIGDGKSRFSINGKPIYHFVGTSTFSEYTVMHVGCVAKINPEAPLDKVCVLSCGISSGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEH

SEQ ID NO: 70502 - protein, 518 aa, Oryza sativa Indica Group
MVAGGSNGGAAVLVGITVLLFVVVVVVVVLVRWWSGGEGGAAPSPPALPVLGHLHLLKKPLHRSLAAVAAGVGAPVVSLRLGARRALVVSTHAAAEECFTACDAALAGRPRTLAGEILGYDHTIVLWAPHGDHWRALRRFLAVELLSAPRLAALAADRHAEAASLVDAILRDAAGGAKVTLRPRLFELVLNVMLRAATTRRRHASVDARKLQEIIEETFSVNGTPSVGDFFPALRWVDRLRGKVGSLKKLQARRDAMVTGLIDDHRQWRSGSAGDGDQDKEKKGVIDALLALQETDPDHYTDNVVKGIILSLLFAGTDTSALTIEWAMAQLVTHPETMKKARAEIDANVGTARLVEEADMANLPYIQCVIKETLRLRTAGPVIPAHEAMEDTTVGGFRVARGTMVLVNAWAIHRNGDVWDAPEEFRPERFVDSDAGGAVTAPMMPFGLGRRRCPGEGLAMRVVGVSVAALVQCFDWEVGDDDVVDMTEGGGLTMPMATPLAAVCRPREFVKTILSTSM

SEQ ID NO: 70503 - protein, 379 aa, Pennisetum glaucum
MATAGKVIKCKAAVAWEAGKPLSIEEVEVAPPQAMEVRVNILYTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEH

SEQ ID NO: 70504 - protein, 570 aa, Oryza sativa Indica Group
MAASSRHGPFINWSDGLFLFLSSSSSRNRFLRVFLPFPDPSTMMVGLEVATTAVTGGDASLVVVVGVLFLMVAVVVMTRLGDGGAAPSPPAMPVLGHLHLIKKPLHRSLAEVAARVGAAPVVSLRLGARRALLVSTHAAAEECFTACDAAVAGRPRLLAGDVLGYGHTTVVWASHGDHWRALRRLLGVELFSNARLAALAADRRAEVASLVDAVLRDAAAGGGGGGTVTLRPRLFELVLNVMLRAVTARRHAGDETRRFQEIVEETFAASGAPTVGDFFPALRWVDRLRGVVATLQSLQKRRDAFVAGLVDDHRRTRRAAAAAADKDQKKNGIIDALLTLQETDPDHYTDNVVKGIVLVLLTAGTDTSALTTEWAMAQLVAHPEAMTKVRAEIDANVGAARLVEEADMASLPYLQCVVKETLRLRPVGPVIPAHEAMEDCKVGGYHVRRGTMILVNAWAIHRDGDVWGSPEEFRPERFMDDGAGAGAVTAVTAPMLPFGLGRRRCPGEGLAVRLVGLTVAALVQCFDWEIGEGGAVDMAEGGGLTMPMATPLAAVCRPREFVKTVVSDCF

SEQ ID NO: 70505 - protein, 473 aa, Mycobacterium avium 104
MTITAPETVGESLDPRDPLLRLSNFFDDGSVALLHERDRSGVLAAAGTVNGVRTIAFCTDGTVMGGAMGIEGCSHIVDAYDTAIEEQSPIVGIWHSGGARLAEGVKALHAVGLVFEAMIRASGYIPQISVVVGFAAGGAAYGPALTDVVVMAPESRVFVTGPDVVRSVTGEDVDMASLGGPETHHKKSGVCHIVADDELDAYERGRRLVGLFCQQGHFDRTKAEAGDTDIHALLPESARRAYDVRPIVTAILDDETPFDEFQANWAPSMVIGLGRLSGRTVGVLANNPLRLGGCLNSESAEKAARFVRLCDAFGIPLVVIVDVPGYLPGVDQEWGGVVRRGAKLLHAFGEATVPRVTLVTRKTYGGAYIAMNSRSLNATKVFAWPDAEVAVMGAKAAVGILHKKKLAAAPEHEREALHDQLAAEHEKIAGGVDSAIEIGVVDEKIDPAHTRSKLTEALAQAPARRGRHKNIPL

SEQ ID NO: 70506 - protein, 74 aa, Solanum lycopersicum
CRAAVPSGASTGIYEALELRDGGSDYLGKGVSKAVNNVNSIIGPALVGKDPTDRAGLDNFMVHQLDGTQNEWGW

SEQ ID NO: 70507 - protein, 152 aa, Synechococcus sp. RS9916
MATERTFVAIKPDGVQRGLVGEILGRFERKGFKLVGLKQITPSRALAEEHYGVHKERPFFAGLVDFITSGPVVAMVWEGDGVIASARKLIGATKPLEAEPGTIRGDLAVNIGRNVIHGSDAPETAQFEIGLWFQASELNDWTPSDQSWRVEG

SEQ ID NO: 70508 - protein, 185 aa, Triticum aestivum
MSSPSKRREMDLMKLMMSDYKVETVNDGMQEFLVEFRGPQESLYQGGVWKVRVELPDAYPYRSPSIGFVNKIYHPNVDELSGSVCLDVINQTWSPMFDLVNVFEVFLPQLLLYPNPSDPLNGEAAALLMRDRPAYEQKVKEFCEKYAKPEDAGITPEDNSSDEELSEEDDDDSGDDEPILGHADP

SEQ ID NO: 70509 - protein, 197 aa, Glycine max
FTLAGLTARSYRYYDPATRGLDFQGLLEDLSSAPSGAIVLLHACAHNPTGVDPTLEQWEQIRQLMRSKALLPFFDSAYQGFASGSLDKDAQSVRMFVADGGELLMAQSYAKNMGLYGERVGALSIVCGSADIAVKVESQLKLVIRPMYSNPPLHGASIVATILKDSAMFDEWTLELKAMADRIISMREQLFNALKIR

SEQ ID NO: 70510 - protein, 166 aa, Triticum aestivum
  misc_feature (109)..(109): Xaa can be any naturally occurring amino acid
  misc_feature (123)..(123): Xaa can be any naturally occurring amino acid
  misc_feature (131)..(131): Xaa can be any naturally occurring amino acid
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDXRYWTMLKLPKFGCXDATQVLNXWRSQEGVPDPMSRIGSQLRKCMRNSLKHGKDPRLT

SEQ ID NO: 70511 - protein, 311 aa, Aspergillus oryzae
MAPASITLIVEPRGKPIKKLPKEIQINPNAPAQDIYAALAAASGSSIHRLRITKGSDRSVVPNSKETKVDDTGLKERSVVHVKDLGPQIGWRTVFIIEYFGPLVIPALFLYPLRPYIYYNFDKPLPEPSYLQQLVCALLSIHFLKREFETIFIHRFSNATMPARNIFKNSAHYWVLAGLNIAYWVFRPDASAVNEPNPALLYAGLGLFVFGELANLNSHLVLRGLRRPGTTDRGIPSGFGFSLVTCPNYLFEIMAWVGVYLVSGLSWSVLFFITVGGAQMAAWAKKKERRYRKEFGDKYKRKSFVMIPGLI

SEQ ID NO: 70512 - protein, 463 aa, Anabaena variabilis ATCC 29413
MADLTPNSSFSVTLRLQIPNRVGMLASITQAIASSGGNLGQIDLIEQTRQVSLRDLTVDAASTEHAETIVQAVKAIPDIKLVSVYDRTFNLHRGGKISITSRIPLKSVSDLAMAYTPGVGRVCTAIAQDPSQVYNLTIKQNTVAIVTDGSAVLGLGNLGPHAALPVMEGKAMLFKEFAGLDAFPICLATQNTEEIIQAVKNIAPVFGGVNLEDIAAPRCFEIEQRLKQELDIPVFHDDQHGTAIVTLAALFNSLKLVQKSLTDIRIVINGAGAAGVAIARLLRKAGAEKIWMCDSKGIISTTRTDLNEEKQEFAVKAQGTLAGAVQGADVFIGVSAPGVLTPEMVKSMAKDPIVFAMANPIPEIQPELVQNDVAVIATGRSDYPNQINNVLAFPGVFRGALDCRAQTITTTMYLEAASAIASLVNPSDLSREHIIPSVFDERVVTAVAAAVQRAAREEGIARA

SEQ ID NO: 70513 - protein, 515 aa, Acinetobacter sp. ADP1
MTDATVAKIPHVLVIMDGIGHREAIKDNAFLAAKTPSLSMMKQKHPHSLISGSGEDVGLPDGQMGNSEVGHMNLGAGRVLYQDFTRITKDIRDGVFFEHEVLVDAVEKAKAVHGAVHIMGLLSEGGVHSHEDHIVAMCELALKRGATVYLHAFLDGRDTPPKSAQPSLEKLDALFAQYPEQGRIVSMIGRYFAMDRDNRWDRVEQAYRLLTESEAVRTAQSAVQGLELAYAAGESDEFVKATRIGDAVAVQDGDSIVFMNFRADRARELTRAFVEHDFSGFTRQRIPHLSKFVMLTRYQATIDAPVAYMPEALHNSIGEYLSNLGKTQLRIAETEKYAHVTFFFSGGREDEYPGEKRILIPSPNVATYDLKPEMSAYEVTDQLVNAIDSGEFDLLVVNYANGDMVGHTGIFDAAVKAVEAVDTCLGRVYQAVMAKHGHMIITADHGNVEQMQDYQSGQVHTQHTTELVPFIYVGPTQAVIAEGGVLADVAPTLLNLMQLPVPAEMQGRNLITLSS

SEQ ID NO: 70514 - protein, 361 aa, Gibberella zeae PH-1
MSVQIPSQQRAAVRQGSGPDARAPIKTVPVPSPGPGQILVKVNWTGLCGSDKSLLHDEWSDFGICMKDVTNGIAGHEGAGSVVAVGQGMEQRWKIGDRAGVKWIASVCGECDFCMVGSDEVHCPEQTNSGFSVPGTFQEYVVADGKYSSKLPDGVTDEEAGPIMCGGVTAYTACKRSGVTPGQWLVIPGAGGGLGHFAIQYAKAMGMRVIAIDGGDEKRDLCLKLGAEVFIDFKTTKDIATQVLKVTTHGAHGVIVTAATRAAYESAPNYLRPNGTVVAVGLPQDPTVLAGAPPMLVALRRLKIVGSVTGSMKDVEEALEFTARGLVHPILSKGKLEDLDDWVHKLATGQVAGRCVLKVAA

SEQ ID NO: 70515 - protein, 447 aa, Arabidopsis thaliana
MLDVLKFNFKFSQVVSVFVSNSSNMQKEIAGDAPSAPTTRVRHRKRNSDVGAGAGKPNGNHLLVNDSKKYKSFLIRAYSTFWMIGGFALIVYLGHLYITAMVVVIQIFMARELFNLLRKTHEDKQLPGFRLLNWHFFFTAMLFVYGRILSQRLVNTVTPDKVLYRLVTSLIKYHMAICYSLYISGFVWFILTLKKKMYKYQFSQYAWTHMILIVVFTQSSFTVANIFEGIFWFLLPASLIVINDIFAYICGFFFGRTPLIKLSPKKTWEGFIGASITTVISAFLLANIMGRFLWLTCPREDLSTGWLLCDPGPLFKQETHALPGWISDWLPWKEISILPVQWHALCLGLFASIIAPFGGFFASGFKRAFKIKDFGDSIPGHGGITDRMDCQMVMAVFAYIYHQSFVVPEVLSVDKLLDQIITSLTLEEQQALLVKLGQMLQEKVIGS

SEQ ID NO: 70516 - protein, 132 aa, Helicobacter pylori
SNIKYELDKKSGALMVDRVLYGAQNYPANYGFVPNTLGSDGDPVDVLVLSDVAFQAGSVVKARLVGVLNMEDESGVDEKLLALPIDKIDPTHSYVKDIDDLSKHTLDKIKHFFETYKDLEPNKWVKVKGFEN

SEQ ID NO: 70517 - protein, 131 aa, Picea sitchensis
MDKDGAYKGDKLILQGLLFHGFHGVFEEERKLGQKFLVDLDAWLDLKRAGKSDNLEDTVSYAEIYSLIKEVIEGPPHSLLESVADSIASSIFSKFPQIHSLRIRLSKPHVAVLGIVDCLGVEIYRTSKSEE

SEQ ID NO: 70518 - protein, 124 aa, Ralstonia metallidurans CH34
MAITKDDILEAVGAMSVMELNDLVKAFEEKFGVSAAAMAVAAAPGAGGAAAAEEKTEFNVILAEVGSNKVGVIKAVREITGLGLKEAKDLVDGAPKPVKEGVDKATADDAKKKLEDAGAKVDVK

SEQ ID NO: 70519 - protein, 352 aa, Medicago truncatula
MGHFSSMFNGLAQSLKMKKGRSKCSGREAAEALAKEAKRNHSLINSSGTINVDGSNNFASVFSKRGKKGVNQDCCIVWEEFGCQEDMIFCGIFDGHGPWGHYVSRTVRESMPSALLCNWQETLSQTSIDPEIDLKTGKKHQQFNIWKHSYLKTCASIDQELEQNHKIDSFFSGTTAVSIVRQGELIVIANVGDSRAVLATTSDDGNLVPVQLTIDFKPNLPQEAERILDCQGRVFCLDDEPGVHRVWLPNEESPGLAMSRAFGDYSMKDYGLISVPEVTQRNITSKDQFVVLASDGVWDVISNQEAVDIVSSTEDRTSSSKRLVECAMHAWKCKRQGIAMDDISAICLFFHS

SEQ ID NO: 70520 - protein, 286 aa, Vitis vinifera
MEGKEEDVRVGANKFSERQPIGTAAQGDDKDYKEPPPAPLFEPGELCSWSFYRAGIAEFIATFLFLYVSVLTVMGVVRADSKCSTVGIQGIAWAFGGMIFALVYCTAGISGGHINPAVTFGLFLARKLSLTRAVYYMVMQCLGAICGAGVVKGFEKGRYNSLGGGANVVNAGYTKGDGLGAEIVGTFVLVYTVFSATDAKRNARDSHVPILAPLPIGFAVFLVHLATIPITGTGINPARSLGAAIIYNKDHAWDDHWIFWVGPFIGAAPAALYHQVVIRAIPFKSK

SEQ ID NO: 70521 - protein, 319 aa, Petunia x hybrida
  misc_feature (1)..(1): Xaa can be any naturally occurring amino acid
  misc_feature (21)..(21): Xaa can be any naturally occurring amino acid
  misc_feature (23)..(23): Xaa can be any naturally occurring amino acid
  misc_feature (46)..(46): Xaa can be any naturally occurring amino acid
  misc_feature (52)..(52): Xaa can be any naturally occurring amino acid
  misc_feature (61)..(61): Xaa can be any naturally occurring amino acid
  misc_feature (84)..(84): Xaa can be any naturally occurring amino acid
  misc_feature (114)..(114): Xaa can be any naturally occurring amino acid
  misc_feature (209)..(209): Xaa can be any naturally occurring amino acid
  misc_feature (233)..(233): Xaa can be any naturally occurring amino acid
  misc_feature (245)..(245): Xaa can be any naturally occurring amino acid
  misc_feature (286)..(286): Xaa can be any naturally occurring amino acid
  misc_feature (304)..(304): Xaa can be any naturally occurring amino acid
  misc_feature (307)..(307): Xaa can be any naturally occurring amino acid
  misc_feature (313)..(313): Xaa can be any naturally occurring amino acid
XENFPIISLDKVNGVERAATXEXIKDACENWGFFELVNHGIPREVXDTVEKXTKGHYKKCXEQRFKELVASKALEGVQAEVTDXDWESTFFLKHLPISNISEVPDLDEEYREVXRDFAKRLEKLAEELLDLLCENLGLEKGYLKNAFYGSKGPNFGTKVSNYPPCPKPDLIKGLRAHTDAGGIILLFQDDKVSGLQLLKDGQWIDVPPXRHSIVVNLGDQLEVITNGKYKSVXHRVIAQKDGARXSLASFYNPGSDAVIYPAPALVEKEAEENKQVYPKFVFDDYXKLYAGLKFQAKEPRFEAXKAXETDVKXDPIATV

SEQ ID NO: 70522 - protein, 521 aa, Arabidopsis thaliana
MAAFISVDFQNCFIFILLCFFSLLCYSLFFKKPKDSRGCDLPPSPPSLPIIGHLHLLLSSLSHKSLQKISSKYGPLLHLRIFNVPIILVSSASVADEVFRIHDMNISSRGAAAIDESLVFGSSGVVYAPYGDYLKFVKKIIATKLLRPQVLERSRGLRAEELQRLYNRILDKAKMNENVEIGKEATMLMNNIFCRMSMGRSFSEENGEAERVRGLVAESYALAKKIFFASVLRRLLKKLRIPLFKKDIMDVSNRFNELLEKILVEHNEKLDEEHKDTDMMDVLLAAYADENAEYKITRNHIKSFFVELFVGGTDTSVQTTQWTMAEIINNSDVLERLREEIDSVVGTSRMIQETDIPNLPYLQAVVKEGLRLHPPFPLLTRKFEERCEIKGFYIPEKTFLIINAYAWMRDPDSWEDPNEFKPERFLGSSRLGQVDEREEAQKYIPFGGGRRGCPGANLASIFVGTAIGVMVQCFDWGIKGDKINMEETFEGLTLTMVHPIKCTPIPRTLPFVTSNLQSPSS

SEQ ID NO: 70523 - protein, 286 aa, Vitis vinifera
MEGKEEDVRLGANKFTERQPIGTSAQTDKDYREPPPAPLFEPGELHSWSFWRAGIAEFMATFLFPYITVLTVMGVVRSPSKCATVGIQGIAWAFGGMIFALVYCTAGISGGHVNPAVTFGLLLARKLSLTRAVFYMIMQCLGAICGAGVVKGFQGHQYEVLGGGANVVAAGYPKGDGLGAEIVGTFVLVYTVFSATDAKRNARDSHVPILAPLPIGFAVFLVHLATIPITGTGINPARSLGAAIIYNREHAWDDMWIFWVGPFIGAALAALYHQIVIRAIPFKTRA

SEQ ID NO: 70524 - protein, 287 aa, Vitis vinifera
MEGKEEDVKLGANKFTERQPLGTAAQTDKDYKDLPPAPLFEPGELKSWSFYRAGIAEFMATFLFLYITILTVMGVKKSPTMCASVGIQGIAWAFGGMIFALVYCTAGISGGHINPAVTFGLLLARKLSLTRAIFYIIMQCLGAICGAGVVKGFEGSQSYEVLGGGANVVNSGYTKGDGLGAEIVGTFVLVYTVFSATDAKRNARDSHVPILAPLPIGFAVFLVHLATIPITGTGINPARSLGAAIIFNREHAWDDMWIFWVGPFIGAALAAMYQQIVIRAIPFKSRA

SEQ ID NO: 70525 - protein, 334 aa, Mycobacterium avium 104
MASYVAGSGEFTRDTDYITTRITADGRDGYPVEPGRYRLVVARACPWANRAIIVRRLLGLESVLSIGFCGPTHDERSWTFDLDPGGVDPVLKIPRLQDAYFKRFPGYPKGITVPAIVDVGTGAVVTNDFAQMTLDLSTEWTAYHRDGAPELYPERLRAEIDEVNKRVYTEINNGVYRCGFAGSQQAYEAAYDRLFTALDWVSDRLADRRYLVGDTITEADVRLFTTLARFDAVYHGHFKCNRSKLSEMPVLWAYARDLFQTPGFGDTVDFVQIKQHYYIVHSDINPTGIVPKGPDLAGWLTPHGREALGGRPFGDGTPPGPPVEAERVPAGHGA

SEQ ID NO: 70526 - protein, 483 aa, Haloarcula marismortui ATCC 43049
MEYTGPTDLYIGGEWREATNGDSIETEDPATERTYASVQKAEASDIDAAVEAAQAAVAEGSEWATMDPGTRRAKLHAMADAIEAMKDELSMVESHDNGKTPFEAGLEIDMVIDTFRHYAGWTDKVRGDEIPVENGRLNYTTREPVGVTAHIAPWNYPFQLAGRGLAPALATGNSVILKPSAMTPLSALYYAKAAEEAGLPDGVVNVVPGKGSEAGDALTGHEGVDHVTFTGSTGVGKTVQRTAADAVADVTLELGGKGPAVVFPDADLDAAARGIQYGIFMNAGQMCWANSRIVVHEDVYEEMVSRMAEIAENIPLGGGIDDDGQMGPVVSAGQQQEILDYIETGKEEGATVAAGGGVPGDKETGHFVEPTVFADVDNEMTIAQEEIFGPVLTAIEVSDEEAAIDVANDSPFGLTACVWTNDLTRAHTVTDRLDYGMVMVNETPNTWPQTPFGGTKQSGHGRAQGEQAIESYTEVKNVHINLG

SEQ ID NO: 70527 - protein, 286 aa, Vitis vinifera
MEGKEEDVKLGANKFTERQPLGTAAQTDKDYREPPPAPLFEPGELHSWSFWRAGIAEFMATFLFLYITVLTVMGVVRSPSKCATVGIQGIAWAFGGMIFALVYCTAGISGGHINPAVTFGLLLARKLSLTRAVFYMIMQCLGAICGAGVVKGFQGHQYEVLGGGANVVAAGYSKGVGLGAEIVGTFVLVYTVFFATDAKRNARDSHVPILAPLPIGFAVFLVHLATIPITGTGINPARSLGAAIAYNKEHAWDDMWIFWVGPFIGAALAAMYQQIVIRAIPFKSRA

SEQ ID NO: 70528 - protein, 421 aa, Yersinia pestis
MSFDSLGLNADILRAVEEQGYLVPTPIQRQAIPVVLEGRDLMASAQTGTGKTAGFTLPLLQLLSQDQQPIKGRRPVRALILTPTRELAAQIDENVQSYSKYLKLRSLVVFGGVSINPQMMKLRGGVDILVATPGRLLDLEHQNAVDLSKIEILVLDEADRMLDMGFIHDIRRVLAKLPAKRQNLLFSATFSDEIKGLASKLLHNPASVEVARRNTASEQIAQSVHFVDKNRKRELLSQMIGEGNWQQVLVFNRTKHGANHLAEQLNKDGITAAAIHGNKSQGARTRALADFKDGKIRVLVATDIAARGLDIDQLPHVVNYELPNVPEDYVHRIGRTGRAERTGEAISLVCVDEHKLLRDIERLLKREIPRIALDGYEPDPSIKADPIQNGRQGRGAQRPGMGRGSSAGRPQNGGGASGARG

SEQ ID NO: 70529 - protein, 527 aa, Oryza sativa Japonica Group
MQGANMLLDEPVRLTSVLTPVKPKVFPSLTKIVGTLGPNSHSVEVIQECLTAGMAVARFDFSWMDASYHQETLNNLRKAAQNVNKLCPVMLDTLGPEIQVHNSTGGPIELKAGNHVTITPDLSKAPSSEILPIKFGGLAKAVKKGDTLFIGQYLFTGSETTSSWLEVVETSGENVECLVTNTATLAGPMFTLHVSKAHVSLPTLSDYDKEVISTWGLHNSVDIISLSHTRSAEDVRELRSFLQSHGLQDTQIYAKVENTEGLDHFDEILQEADGVIISRGDLGIDLPPEDVFISQKTAIKKCNLAGKPVIITRVVDSMIDNLRPTRAEATDVANAVLDGTDGILLGAETHRGPYPVDAVSTVGRICAEAESVYNQLVHFKKLVKHVGDPMPHEESVASSAVRTAMKVKAAAIVVFTFSGRAARLVAKYKPPMPVLAVVFPREGSDPTKWRSYGTTQARQCFAARGVYPLMASTEEAETGGLTREEYGIKLAQNYGRSVGMLKPYDRLIIFQKIGDSSVVKIIECDSS

SEQ ID NO: 70530 - protein, 269 aa, Brucella melitensis 16M
MLTARFGQPMFAGMNVSSRPFSPEELERYARHIVLPVIGGPGQQKLKAARVLVVGAGGLGAPVLQYLAAAGVGTLGIVDDDTVSLSNLQRQIIHDTDSIGQPKVESALASIARINPHVKVEGHQLRLDAHNAEALIAGFDVVVDGSDNFATRYVLADAAAKVGRPLVTGAMGRFDGTVTVLMPYANGPDGAKNPSYRDLFPDAPPPGTVPSCAEAGVLGVLPGVIGSLQAMEVIKLVTGIGEPLVGRLLLYNALNVRFETIRYKARKPK

SEQ ID NO: 70531 - protein, 691 aa, Photorhabdus luminescens subsp. laumondii TTO1
MKILLIDNYDSFTQNIAQYLYEVTGSVPSVVTNSLTYEELTIDEYDAVVLSPGPGHPAESSDFGVCAEVIAHAKVPLLGICLGHQGINLAFGGVVEHAPNPVHGYRSRIRNTGEGLFLGLPEQFEVVRYHSLVCTRLPDNLKCTAWTDDGLIMAIEHTERPIWGVQFHPESIDSEYGRELLSNFVRIAETYKENNEQEVTAQNICTDINEAYLAVGGRQDLNLNYRECKEIVDPESLFIQRYGNDTHAFWLDSENSDRPNARFSMMGSGNEQGAVRLEYSVQTENLRLIGPDGERIVQGDFFSLMSQLLDVVAISTPKSMPLVFKGGFVGYLGYELKALTIGSNKYRSEHPDASLIFTPHFFVFDHQQSKLYECFITPIGQPHHWSPELFVTNTKNTGEVIPDFIPGAVDQNKICLEYGAEKYMDGIHKSLQYITDGESYEICLTNRAKMTYSGHPLDAYRRMRHASPVPYGAYLACGDFSVLSASPETFLRIDDARNIESRPIKGTRPRGKTAADDQHLQMELSQSTKDRAENLMIVDLVRHDLNQVCRPGSVHVPELFKVESFSSVHQLVSTIRGQLCEETSSIEAIRACFPGGSMTGAPKKRTMEIIDALESSARGVYSGALGWLSFSGEVELSIVIRTAVLHQECAEFGIGGAIVAHSDPYGEFEETLVKASVPYFSFSHMAEEVCE

SEQ ID NO: 70532 - protein, 150 aa, Oryza sativa
FAPPQQPPPLPHPQRTLIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPDFWRDTKFVKSPFQEYTDLLAKPTGVFFFF

SEQ ID NO: 70533 - protein, 284 aa, Vitis vinifera
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAVKALGSFRSTAHV

SEQ ID NO: 70534 - protein, 966 aa, Neurospora crassa
MTGLRIGWGSVLLVLALVLVVLPDKAAAFGAGNIPSIAQVEGHNWRHGDIEDVLKTLAFINGKKWTTMMVGRTYFGNWLRDYSQAIDVGSLKGVNAATIRIIVWVLSFLAHGYATEEFEVTEERLGVYRPEEHIDNPLGYADGKDAREFDPRLRGPVHPGELEIDLYSGMKNYIANERLAYQQGWNTTSAGYIRFSLERCIHFGRLYTSGSRGRGKESDLCEALRCLGQALHTLEDFPAHSNYCELVLIDMEERRGGHSPVFPHVGTDTRITLRNDTRNNGKSVWPLVTGTFGGVDFLHSVLGEANDHFTQSEVDEMNDALLTAEQLTKGSGGGSSRDRGLSLFGLNLGGSSSNDGDFISLVSKLPGVGDGYASTARSLKAASEAQEQENSRSAGNVNVVPGMSPNFDPVKTAAKIYPILEFRDKIVRSINNMIEKIPGLESLLEKISETLTAFILGLLGPFLRPIINQVTQVLKEGSSGLIATSAKQQLEPWNNPQCDNPTHSMLSKDHFTNILNSCAGRVAANIVQYVVPRVVYAWENPGVPDSEVIADVLQVFHHPANYKEEVEIQRTMYETVVQWSRETHHDYKTLLASESVKEGHNHVLNGQPMDRGPGGGHTSCGADGGHGKVAGSLWSKIQSRDLDTSAPSGGVGGGRPSSSTGHKYGYSASSSHHEVPTHGEAASYFSSADPRHASPPTDRYYGSRPSSSGYGSSVHGSGRPSPAPASFGYHHGGHQAYEGSSSSYPSQPSYGGSSGPSYGGSSGPSYGGFSQPSYGSQPSYSSQPSYGAPPSQPPYGSQPHYGGPPHSSYSGGRPPSPPRPSGYGGGYAGYSAGPPPSHGGYGGSPHGGAPYPHGGAVGGGGSAPYPHGGRADAYERNYDQHYERDERRGGRDGRRRRGSHGSRSSSEERIGRGFPGQGSRGSGHHGGGGGYGGGYGGGYGGGYGGGYGGGGGYGGSYGGRDEHRRY

SEQ ID NO: 70535 - protein, 483 aa, Staphylococcus epidermidis ATCC 12228
MGSFFNRMTRKENPTIYQSKDGHLKRTLRVRDFLALGVGTIVSTSIFTLPGVVAAEHAGPAVSLSFLLAAIVAGLVAFTYAEMASTMPFAGSAYSWINVLFGELFGWVAGWALLAEYFIAVAFVASGFSANLRGLIAPLGISLPKSLSNPFGSNGGVIDIIAAVVIILTALLLSRGMNEAARMENVLVILKVLAIILFVIVGLTAINFSNYIPFIPEHKVTETGDFGGWQGIYAGVSMIFLAYIGFDSIAANSAEAINPQKTMPRGILGSLIVAIVLFVAVALVLVGMFHYSQYADNAEPVGWALRESGHGIIAAIVQAISVIGMFTALIGMMLAGSRLLYSFGRDGLLPSWLSQLNHKHLPNRALVILTIIGVVIGSMFPFAFLAQLISAGTLVAFMFVSLAMYRLRKREGKDLPKPEFKLPLYPILPAITFILVLLVFWGLSFEAKLYTLIWFIVGIIIYLIYGIRHSKKNDEEAYQVPRK

SEQ ID NO: 70536 - protein, 445 aa, Staphylococcus epidermidis ATCC 12228
MSKVNHLIDEDERYFAHSGRIKYYPLVIDHGYGATLIDIDGKSYIDLLASASSQNVGHAPKPVVEAIKNQTEKFIHYTPAYMYHEPLVRLSKKLCDIAPGNYEKRVTFGLSGSDANDGIIKFARAYTGRPYIISFTNAYHGSTFGSLSMSSISLNMRKRYGPLLNGFYHIPFPDKYRGMFEQAKPNTVEEYLAPLKEMFTKYVPAEEVACIVVETIQGDGGLLEPVPGYFEALQELCHAHNILIAVDDIQQGLGRTGKWSSVDHYHFTPDLMTFGKSLAGGLPMSAIVGRKEIMESLEAPAHLFTTGANPVSCEAALATIKMIEDEDLLNASWKKGSYVRKRIDPWIERYQYVGDVRGIGLSIGIDIVSNKIEKTRDSEAALKICNYCFENGVIIIAVAGNVLRFQPPLVITYKQLDKALDTIEEALEKLERGELNQYDISGQGW

SEQ ID NO: 70537 - protein, 190 aa, Brassica napus
LLLISKHYKRFDVLVEAEANKAAGKYDNASIDFQVEFYKNEGLTPYSVAKLPITSDVPEGCVILREHVPISNLFTCLWFNEVDRFTSRDQISFSTVRDKIAAKTNWTVSMFLDCERRNFVVQRYHRAEQERYARQKPPVPKFSPPPPSLPTKPVLTSSDLPRKVSSGRAVSRTTPPRRRGGGLVQAVTGS

SEQ ID NO: 70538 - protein, 407 aa, Bacillus clausii KSM-K16
MNAKEIKKLFPILDQQVNGNPLVYLDSAATSQKPIQVIEKLDDYYRRYNSNVHRGVHTLGTLATDEYEGAREKVRAFLNAQDTAEIVFTRGTTTAINLVAQSYGTDHVGEGDEIVITPMEHHSNIIPWQQLAKRKGAVLKYIPLQEDGTIALADVEKTITERTKIVSVVYVSNVLGTVNPIAEMAKVAHKHGAVMVVDGAQAAPHVHVDVQQLDCDFFAFSAHKMCGPTGIGALYGKKALLEAMEPIEFGGEMIDFVGLQDSTWKELPWKFEGGTPIIAGAIGFGAAIDFVTDLGFNEIEQHEKELVDYSFERLGDFKDLTIFGPKDRAGVITFQLGDVHPHDVATVLDAEGIAVRAGHHCAQPLMKWLDVVATARASYYVYNTKEDIDALANGLVKAKEYFSDVFS

SEQ ID NO: 70539 - protein, 379 aa, Acinetobacter sp. ADP1
MSNANRYTGLVDRYRDRLPVSATTRAISLGEGNTPLIKLENIPRIIGKDVEIYVKYEGLNPTGSFKDRGMTMAVTKAVEEGSKAIICASTGNTSAAAAAYAARAGIKAFVLIPEGKIAMGKMAQAMMYGAITMQIRGNFDDGMRLVKEVADQAPVTIVNSINPYRLQGQKTIAYEIVEALGRAPDYHCLPVGNAGNITAHWMGYTEAVANQPADQFEQVIYDAATDQFTGPKPEGLPTMVGYQAAGAAPFLRGAPVEQPETVATAIRIGNPQSWNHAKAVVRDSQGWFDELQDSEILEAQRLLSMYEGVFVEPASAASIGGAIRDIKAGKIAEGSVIVCTVTGNGLKDPDTAIKQCADAVMLSIDATMNQVKDSILSNM

SEQ ID NO: 70540 - protein, 172 aa, Anabaena variabilis ATCC 29413
MDLKSLIRDIPDFPKPGILFRDITTLLRDRQGLRYTIDFLAEKCFEANLDIDYVIGMESRGFIFGTPLAYKLGAGFIPVRKKGKLPAAVHSIEYELEYGTDCLEVHRDALHPDSRVLIVDDLIATGGTASATAKLVQQIGCELVGFGFIIELRDLQGRKHLPDVPIISLVEY

SEQ ID NO: 70541 - protein, 398 aa, Zea mays
  misc_feature (263)..(263): Xaa can be any naturally occurring amino acid
MASSDLAESLLPGGGGGASASHDEYEERAYDSEDKISIAVSDSDGEDDGAPASRPPFSWRKLWRFSGPGFLMCIAFLDPGNLEGDLQAGAAAGYQLLWLLLWATIMGALMQLLSARLGVATGKHLAELCRQEYPPWATRALWAMTELALVGADIQEGIGSTNASLGLKIAVLCFIFLFLENYGVRKLEAFFAVLIATMAVSFAVMFGETKPSGKELLIGLVVPKLSSKTIKQAVGIVGCIIMPHNVFLHSALVQSRKIDTNKXMITPSFTILPTMIVALFFDTEDPTMDILNEALNVLQSIQIPFALIPLITLVSKEQIRGSFVIGPIPKVISWIVTVFLMLINGYLILSFYITDVRGALLRSSLCVVLVVYLAFIVYLIVRNTSLYSRLCSSTSKSS

SEQ ID NO: 70542 - protein, 257 aa, Picrophilus torridus DSM 9790
MKISIIGAGTIGRAMAEALKDDYEIGLSSRDFSKLESWSGGRFKLFKNNAENAAYGDLIILSVKPFNIDDVLNEIKDNIKNKIIVSFLAGINIDYIESYAKTSIFRAMPNLPIITGDAITAVAYKNADENTIKIVDDIFKKTGECIFIDEKSMDAVTGLSGSGPAFISIMIDSMIVAGIRMGLPRDTARKLTLKTFEGTARLMEKTGLPPSEIRDRVMTPAGTAAAGVFEIENGNIRTTIARAVEASTKRSMELKRK

SEQ ID NO: 70543 - protein, 314 aa, Brassica napus
  misc_feature (307)..(307): Xaa can be any naturally occurring amino acid
MKLRLRCHETRETLKLELPDSSTLHDLRQRINEPSPSSVHLSLNRKDELLAPSPDDTLRSLGVTSGDLIYYSLVPSAFAASVEEIALASSSEGKSQDKTIVQDSMGIGFAATDVDMNIQDPEEASTGEESGHAPDPMDVEELAAAGSKRLTEPFFLKKILLEKSGDTSELTTVAMSVHAVMLESGFVLFNPVSSDNKFSFSKELLTVSLKYTLPELMTREDGVESVTVRFQSLSDKVVVYGSLGGKLRRVYLDKRRFVPVIDLVMDTLKSDKDGSSSIYKEMFMFWRMVKDGLVIPWLIGLGDKSGXEIPTCLM

SEQ ID NO: 70544 - protein, 495 aa, Gibberella zeae PH-1
MSTVKITGIGGRQISVHTGLFINNEFVPAQDNATVKTENPFNGKVLADISAAQASDVDKAVAAAEKAFNGTWKLTQPTVRRDLMNRLADLIERDNEELASLESVDAGILFRESSGMFVPQAVETLRYYAGWADKVDGQSLHIPQGISYSRRVPIGVCAAIVPWNAPLMITMWKLAAALATGNVLIIKTPEASPLYGQKLGQLIVEAGFPPGVVSILCGLGIVAGSALSAHPAIRKLSFTGSPGVGRQILAASAKTNLKKISLELGGKGPSIVFDDADFENALQWTAAGITVNNGQICAAGSRIYVHADIYDKFVKAFSERTKDSVAGDPLLQETTKGPVINAGQKKRVMEYIKIGQDEKVKVLHGADDSKLPTEGHFVPNTAFVDVDPQATVIREEIFGPVACIAKFSTEEEVVRLANDSSYGLGSAVFTKDINKAIRVSEELESGQVTINMWGVVNANVSFGGFKESGFGRDCGKEAIDDWTQAKYISVMVPKL

SEQ ID NO: 70545 - protein, 356 aa, Escherichia coli K12
MTTFHSLTVAKVESETRDAVTITFAVPQPLQEAYRFRPGQHLTLKASFDGEELRRCYSICRSYLPGEISVAVKAIEGGRFSRYAREHIRQGMTLEVMVPQGHFGYQPQAERQGRYLAIAAGSGITPMLAIIATTLQTEPESQFTLIYGNRTSQSMMFRQALADLKDKYPQRLQLLCIFSQETLDSDLLHGRIDGEKLQSLGASLINFRLYDEAFICGPAAMMDDAETALKALGMPDKTIHLERFNTPGTRVKRSVNVQSDGQKVTVRQDGRDREIVLNADDESILDAALRQGADLPYACKGGVCATCKCKVLRGKVAMETNYSLEPDELAAGYVLSCQALPLTSDVVVDFDAKGMA

SEQ ID NO: 70546 - protein, 335 aa, Photobacterium sp. SKA34
MKTLVVEKPYTFKYEETNIQKPGLNTVTLRVLAVGICGTDIHAYTGNQPFFTYPRVLGHEVCGEITEVGENVTQWKKGDRVALIPYVSCQVCPSCQSGRPNCCENISVIGVHENGGFCEYLNVPASQLLSVTDVEPSTAALIEPFAISAHAVRRANVQKGQDILVVGAGPIGLGAAAIAKSDGANVIVADTSEERRMHIEKVVGVKAIAPDEEAVRECFSGALALTVIDATGNANAMNNAVNLIRNGGTIVYVGLHKGNLEISDPDFHKKETTLMGSRNATLEDFEKVARLMSSKDISAEMMLTHSFMFSELAEIYQEQVIDNKQLLKAVILMSE

SEQ ID NO: 70547 - protein, 893 aa, Saccharomyces cerevisiae YJM789
MSREGYPNLEEVEIPDFQETNNTVPDLDDLELEYDQYKNNENNDTFNDKDLESNSVAKHNAVNSSKGVKDSKIDYFNPSDVSLYDNSVSQFEETTVSLKEYYDHSIRSHLTVKGACSYLKSVFPIINWLPHYNFSWFTADLIAGITIGCVLVPQSMSYAQVATLPAQYGLYSSFIGAYSYSFFATSKDVCIGPVAVMSLQTAKVIADVTAKYPDGDSAITGPVIATTLALLCGIISAAVGFLRLGFLVELISLNAVAGFMTGSAFNILWGQVPALMGYNSLVNTRAATYKVVIETLKHLPDTKLDAVFGLIPLFLLYVWKWWCGTYGPRLNDRYNSKNPRLHKIIKWTYFYAQASRNGIIIIVFTCIGWAITRGKSKSERPISILGSVPSGLKEVGVFHVPPGLMSKLGPNLPASIIVLLLEHIAISKSFGRINDYKVVPDQELIAIGVSNLLGTFFNAYPATGSFSRSALKAKCNVRTPLSGLFSGSCVLLALYCLTGAFFYIPKATLSAVIIHAVSDLLASYQTTWNFWKMNPLDFICFIVTVLITVFASIEDGIYFAMCWSCAMLILKVAFPAGKFLGRVEVAEVTDAYVRPDSDVVSYVSENNNGISTLEDGGEDDKESSTKYVTNSSKKIETNVQTKGFDSPSSSISQPRIKYHTKWIPFDHKYTRELNPDVQILPPPDGVLVYRLSESYTYLNCSRHYNIITEEVKKVTRRGQLIRHRKKSDRPWNDPGPWEAPAFLKNLKFWKKRENDPESMENAPSTSVDVERDDRPLLKILCLDFSQVAQTDATALQSLVDLRKAINQYADRQVEFHFVGIISPWVKRGLISRGFGTLNEEYSDESIVAGHTSYHVARVPQGEENPEKYSVYTASGTNLPFFHIDIPDFAKWDI

SEQ ID NO: 70548 - protein, 670 aa, Oryza sativa
MAIHGVFIALLLLSAVISVLCLLAVLVPDAGGRHHRHGCPPFTCGNLSSVSSPFRRRGDPSECGVLSYELNCADDKATIQIDNGTYYVTGINYTDSTFLIVDADISDSPSSCPLPRWNSLREPRFQVLWTRIASFVNCSQEIKNSSWIMYMPVACLSTSRSFVYVLTGQNPALIQSLEPSCGYLAMTPLGGRDSVAPVNESLSLSYADVVKSMRKGFRVQFPFRYSFKQCPMDSIPTGKTNWFGTILSADTNFQLCIPVHQIPSRYRMPLGIMLYVIAYAFQIWKMIAATCRFLLTPLAVLVFLAHKYWKTRVTIDAVEKFLRMQQMLGPTRYAYTDITAITGHFREKLGQGGYGSVYKGVLLPGDLHVAVKMLNGNSNCNGEEFISEVATIGMIHHVNVVRLVGFCSEEMRRALVYEHMPRGSLDKYIYLSERSFSWDKINEIALGIARGINYLHQGCDMQILHFDIKPHNILLDDNFVPKVADFGLAKLYPRDKSFVPDRALRGTVGYMAPEMVSRSFGVISSKSDVYSFGMLLLEMAGGRRNVDPNADSSKSKAYYPSWVYDQLIADQQFDEISNVANMHELERKLCLVGLWCIQMKSHDRPTMSEAIEMLEGGVDALQVPPRPFFCDGDGIGNGMPPPQVMDSYFHSSKLTAISEEGDGIAKLASS

SEQ ID NO: 70549 - protein, 311 aa, Photobacterium sp. SKA34
MADITISVIGECMVELQKSGDLYKPNFGGDTLNTALYLARLVDGKNISINYVTGIGEDIFSQKMVKAWQAENINTDLVHTSATKNAGLYVIDTDSDGERSFHYWRSDSAARYWLQDVSMSDLVSKLSQSQWIYLSGISLAILPQKALEILFDVLHECHRQGTKIAFDNNYRANLWSSKEEAQSAYRRILKMTDLAFLTFDDEQALFGDASESQSIERAQTMGIDEIVIKRGSQACFVVKDDHLHEVPARHISNIIDTTAAGDSFSAGYMASRLIECDAPKAAAMGHLLAGTVIQYPGAIIPLDVMPQLNDN

SEQ ID NO: 70550 - protein, 288 aa, Hordeum vulgare
MEGKEEDVRLGANKYSERQPIGTAAQGSEDKDYKEPPPAPLFEPGELKSWSFYRAGIAEFMATFLFLYVTILTVMGYSGAASKCATVGIQGIAWSFGGMIFALVYCTAGISGGHINPAVTFGLFLARKLSLTRAVFYIIMQCLGAICGAGVVKGFQQGLYMGNGGGANVVASGYTKGSGLGAEIIGTFVLVYTVFSATDAKRNARDSHVPILAPLPIGFAVFLVHLATIPITGTGINPARSLGAAIIYNREHAWSDHWIFWVGPFIGAALAAIYHQVVIRAIPFKTKS

SEQ ID NO: 70551 - protein, 279 aa, Vitis vinifera
MSKEVSEEGQSHGKDYVDPPPAPLIDIAEIKLWSFYRAVIAEFIATLLFLYITVATVIGYKKQSDPCGGVGLLGVAWAFGGMIFILVYCTAGISGGHINPAVTFGLFLARKVSLIRALAYMVAQCLGAICGVGLVKAFMKSFYNSLGGGANSVAAGYNKGTALGAEIIGTFVLVYTVFSATDPKRSARDSHVPVLAPLPIGFAVFMVHLATIPITGTGINPARSFGAAVIYNNEKVWDDQWIFWVGPFVGALAAAAYHQYILRAAAIKALGSFRSNPTN

SEQ ID NO: 70552 - protein, 273 aa, Arabidopsis thaliana
MYICTNVHLSPLSLHHLACEFINSCEMEPRINDLQVESRVHELLDFPVHTNQISSAIYEILLQCPNDHIENPKKKPYNCPHSGAKCDVTGDIQRLLLHLRNDHNVEMSDGRSFSHRYVHHDPKHLHHATWMLTVSYITDYLALFLQLCEFLSFNPLETMQLLDCCGRKFCLYFEAFHLRKTPMYMAFMQFMGDEEEAMSFSYSLQVGGNGRKLTWQGVPRSIRDSHKTVRDSQDGLIITRKLALFFSTDNNTTDKELKLKVSGRVWREQPVSI

SEQ ID NO: 70553 - protein, 672 aa, Oryza sativa
MAIPGSFCHPTALQVFVSVQFVFAVLVPHAAGRHHRHGCAPFSCGHLSDVSPPFRRRGDPPECGVASYELTCTDDKPATIQIDNGTYLVMDIKYKDSTFWVIDANISDSRNNCPLPRWNRDFGYYDQMLYERHGEDSRRRSIQAELMPPYQSTTATFVTCSPGKHLEGANGKVQAWLLAWSTNSSLRLRATGMNSDSIGSLEPSCGYLAMTPLGAGDRPLVLENASYADVVKLMRGGFAIRFPYTSRFYGYSSKIKQCIAQSFQIFYTVIFDYHFWGCLLLHPVVQLNVGVIPLAMWTLKWIAVFCRFILVPLVILTFLARNYWKIRITTDAVEKFLRMQLMNGPTRYAYTDLIAITGHFREKLGQGGYGSVYKGVLLPGNAHVAVKVLGNSNCNGEEFISEVSTIGMIHHINVVHLVGFCSEEIRRALVYEYMPRGSLDKYIFSSERSFSWDKLNEIALGIARGINYLHQGCDMQILHFDIKPHNILLDVNFVPKVADFGLAKLCPRDQSFVPLSALRGTIGYIAPEMISRSFGIISSKSDVYSFGMLLLEMAGGRRNSDMYAENSNQTYFPSWVYDQLTEQQVGVGEIPAGTVANMHELERKLCIIGLHCIQMKSHDRPTMSEVIEMLEGGVVGLQMPPRPFFCDDEPVSLAVNSHQFSSELSEILEEDE

SEQ ID NO: 70554 - protein, 287 aa, Vitis vinifera
MAKDIEVAGHGDLTLKDYHDSPPAPLVYPEELGSWSFYRAIISEFVATLLFLYVTVLTVIGYKNQTDPYHHGNECNGVGILGIAWAFGGVIFILVYCTAGISGGHINPAVTFGVFLARKVSLVRAVMYMVAQCGGAICGCGLVKLFQDIYYIRYGGGANELASGYSIGTGLAAEIIGTFVLVYTVFSATDPKRNARDSHVPVLAPLPIGFAVFLVHLATIPITGTGINPARSLGAAVIYNQPKAWSDHWVFWAGPFIGAAIAAFYHQFILRAGAVKALGSFKSSSHM

SEQ ID NO: 70555 - protein, 173 aa, Brassica napus
MEVLFYPDVFCFCLLPFVSDQVTKSIEGLLPLPKVRTPNDPRRIELKELEAAKAVIDVKAHSLVRRELWAGLGYLILQTAGFMRLTFWELSWDVMEPICFYVTSIYFMAGYGFFLRTSKEPSFEGFYQSRFEAKQKKLMNVHGFDVERYGELKKLFCHKASDRVSKILGTIQS

SEQ ID NO: 70556 - protein, 485 aa, Oryza sativa
LEPSCGYLAMTPLDGMGRVAPAVDSLSYEDVVKFMRKGFRVQFPFRHHRNRSFKDCLMESIPKSTGIGKLSDWFSLSVTENFVDCATAKIPSPYNILLGIILYALMFWTMLAPPCRYLLAPLVVLIFLAQKFLIRMITIDAVEKFLRMQQMLGPTRYAYTDIIAITGHFREKLGQGGYGSVYKGVLLPGDLHVAIKILNGYSNCNGEEFISEVATIGRIHHVNVVRLVGFCSEGMGRALVYEYMPRGSLDKHIFSSERRFSWDKLNEIALGIARGINYLHQGCDMQIIHFGIKPHNILLDDNFVPKVADFGLAKLYPRDKSFVSDRALRGTVGYMAPEMVSRSFGIISGKSDVYSFGMLLLEMVGGRRNADPNADSSASKAYYPSWVYDKLIADQQVDEISNFANMHELERKLCLVGLWCIQMKSHDRPTMSEAIEMLEGSVDALQVPLRPFFCDGDGMPPPQVMDSYFHSSDLSAISEEDVWNS

SEQ ID NO: 70557 - protein, 449 aa, Glycine max
  misc_feature (291)..(291): Xaa can be any naturally occurring amino acid
MAILPPASSLPSSSEGICCSTYGITSNSIKLPIDGRRWHDLASTRCKSPFFGSPHLLWLSTGHDLCLSKVNVAADYSDSIPDSSDQMDEQGYHPLEELKGSNDIQPARLSPAEIAKTTVEANKSALLVFPGMVHCEPHDQISWAEFQYHIDDVGDIYFEFSDDANLLADCGANNPVNALIGMDIPIYDNNRRTASEYDIFNNGSDDEFKFDDDDIEVSEMEEFNIPVNWGQSDTTKSVHPIYFSKCLAKAINNMEYVKRMNHPSNGVSIIGFLRPVYGEEKSYLRWMYHTXDGDVYISDWRDFYSNSDDDDERDTNLTLYRLEILSIELHSMYGYQSEISVLDFQDAEPDILAHSSSEILERFNQFCDDEIKALCKKKGLYGEGAYLVGVDSLGVDVRVLSGAEVKTHRFPFKVQAANANAAEKQIWQLLFPRSRRKKNMKKWWSASMI

SEQ ID NO: 70558 - protein, 185 aa, Desulfitobacterium hafniense Y51
MNLPNQLTMARIILIPIFMALLLIQFPKGQPIFPYQDFVAAMIFILAAATDGLDGYIARKRGQVTVLGKFMDPLADKLLVSAALIALVDLGHVPAWICWIILAREFAVTGLRAIASADGTVIAASKLGKIKTVSQVVAISLILLHDWPLSLFNLYLGQPLLYVALFFTIISGADYLVKSKKLLKK

SEQ ID NO: 70559 - protein, 453 aa, Solibacter usitatus Ellin6076
MGNTLERVRTDLPSLTGSVPGPRARAVIERDEKVVSPSYTRCYPLVVEKGEGAMIEDVDGNRFLDFNAGIAVVATGHCHPRVVEAIQKQAARLIHMSGTDFYYEELTALAEKLNEIAPGDVARRVSFGNSGAEAMEGAIKLARYATKRDKIIAFFGSFHGRTMGALSLTSRRAVQRAGFGPLIPGVVHAPYPYCYRCPYGQKPESCAVECVKHIEDTLLKTICPAEETAAIVVEPVQGEGGYIVPPRKFIDELTRVAKENGILLVFDEVQSGMGRTGKMFAADHFDAVPDILSVAKGIASGMPIGATVARADLMTWPPGAHASTFGGNPVACAAALVTIELLQRELVDNAARMGAYLMERLRQWPSRFPIVGDVRGLGLMIGIELVLDQATKEKAPSGLRDRVVELAFRRGLLILGAGDNVLRLCPPLIITRDQCDFALDTLEACLQQVIEKA

SEQ ID NO: 70560 - protein, 249 aa, Vitis vinifera
MPKIAFGRFDDSFSLASFKAYLAEFHSTILFVFAGVGSVMAYNKLTSDAALDPAGLVAVAVAHGFALFVAVAISANISGGHVNPAVTFGLVVGGQITILTGILYWIAQLVGSILACFLLKLVTGGLTTPVHSLGAGVGVIDAIVFEIVITFALVYTVYATAVDPKKGSLGIIAPIAIGLVVGANILAAGPFSGGSMNPARSFGPAVVSGDFKDNWIYWVGPLIGGGMGGSVYAIMYMGSDHQPLASSEF

SEQ ID NO: 70561 - protein, 486 aa, Glycine max
MVEKSSRTNLGHHQDFGMEAYSIDGVSSQSESKFYDDDGHVKRTGNVWTTSSHIITAVVGSGVLSLAWAMAQMGWVAGPVVMIFFSAVTLYTTSLLADCYRCGDPVTGKRNYTFMDAVQSILGGYYDAFCGVVQYSNLYGTAVGYTIAASISMMAIKRSNCFHSSGGKSPCQVSSNPYMIGFGIIQILFSQIPDFHETWWLSIVAAIMSFVYSTIGLALGIAKVAEMGTFKGSLTGVRIGTVTEATKVWGVFQGLGDIAFAYSYSQILIEIQDTIKSPPSEAKTMKKSAKISIGVTTTFYMLCGFMGYAAFGDSAPGNLLTGFGFFNPYWLIDIANAAIVIHLVGAYQVYAQPLFAFVEKWASKRWPEVDTEYKIPIPGFSPYNLSPFRLVWRTVFVIITTFVAMLIPFFNDVLGLLGALGFWPLSVFLPVQMSIKQKRTPRWSGRWIGMQILSVVCFIVSVAAAVGSVASIVLDLQKYKPFHVDY

SEQ ID NO: 70562 - protein, 338 aa, Glycine max
MAAGVYNQPIVAFQSHSHINNFNHQQKFNNLVRLVTKDFIGSNFLSRRDCRVIQSLASQTSVVDTVSSPSKSKTSDRDTHKKSNEASLILIRHGESLWNEKNLFTGCVDVPLSKRGIDEAIEAGKRISSIPVDLIFTSALIRAQMTAMLAMTQHRRGKVPIIMHNECDQARSWSQVFSEDTKKQSIPVIASWQLNERMYGELQGLNKQETADRYGKEQVHEWRRSYDIPPPNGESLEMCAERAVAYFRDQIEPQLLSGKNVMISAHGNSLRSIIMYLDKLTSQEVISLELSTGIPMLYIFKEGRFIRRGSPIGPSEAGVYAYTRRLALYKQKLDNMFQ

SEQ ID NO: 70563 - protein, 120 aa, Taraxacum officinale
SKHQEWQLRAREEVLNVLGDKKMDLDGLNHLKVVNMIFHEVLRLYPPIVGLARKIDKDIKLGEFALPSGIQIGLPIMNIHYDEEAWGPDAKKFGPNRFSEGISKATKNQVIYFPFGWGLR

SEQ ID NO: 70564 - protein, 875 aa, Staphylococcus epidermidis ATCC 12228
MTQFVYAFNEGNIAMKDLLGGKGANLSEMKRLGLPVPDGFTITTEACITYLKQNEELPTEVKTQLIDHLAAFSKRTGKAFSSDDNLLLVSVRSGAKISMPGMMDTILNLGLNDDNVKKLVDKTNDARFAYDCYRRLLQMFGEVVYGIPMTAFDTYFNDFKTKHRYQNDAEIPAEGLQTICEKYKEIYVEEAYKPFPQEPLKQLEEAIEAVFKSWDNDRARVYRDLNDIPHDIGTAVNIQEMVFGNSGENSGTGVAFTRNPVTGENHLFGEYLLNAQGEDVVAGIRTPKDIDTLKQQMPDVHQEFVDVTKQLEKHYKDMQDIEFTIENGKLYLLQTRNGKRTAKAAIKIAVDLVHEQLITREEAVSKVEVKSIDQLLHPNFNEESLKQATVVSKMGLPASPGAATGKVVFSAEEAKLQAENGNKVVLMRPETSPEDIEGMVASEAIVTTHGGMTSHAAVVARGMGKCCVTGCSNVEIDTVNKTVYYPEGELHEGDIVSVDGSAGDLYLGAIETVNAEHSEEFDQFMTWSEEIARLQVRMNAETPQDIKAGYNFGSKGIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGITCLPEIMIPLVSTVEEFTTLKERLVNTITHLEKESQQDIQYMIGTMIETPRACLIANDLAKHCDFFSFGTNDLTQLTFGFSRDDAGKFINVYTENNILQLDPFQTLDREGVGRLIQLAVEQAKNTNPEIKIGVCGELGGDAKSIRKFNQWEIDYVSCSPFRVPGAILATAQSQAEESER

SEQ ID NO: 70565 - protein, 93 aa, Triticum aestivum
MASGQQERSQLDRKAREGETVVPGGTGGKSLEAQENLAEGRSRGGQTRREQMGEEGYSQMGRKGGLSTNDESGGDRAAREGIDIDESKFKTKS

SEQ ID NO: 70566 - protein, 340 aa, Cyanidioschyzon merolae strain 10D
MAVPKVGINGLGRIGRLVLRAAVEKGTVEIVAVNDPFIFSDVSYAAYSLKYDSTHGAFPGEIGTDGEHLVINGKKITCFAIRDPADIPWASTGAEYVVESSGAFTTAEKASLHLKGGAKKVVVSAPAKDVPMFVMGVNHDSYTKDLQVVSNASCTTNCLAPLVKILDEAFGIENGLMSTIHAVTATQRTVDGPSNKDWRRGRSAMLSIIPSSTGAAKAVGKVYPKLDGKLTGMAFRIPVALVSVVDLTANLKTPTTYEEIKHVMKAAAENPEFKGIFGYTEDPIVSADLAHSSYSSVFDAQAGIMLSPTFVKLVSWYDNEWGYSNRVVDLITHMAKVDAA

SEQ ID NO: 70567 - protein, 376 aa, Gibberella zeae PH-1
MSNPHMNLRGLDTKSHVDVKRRAAQYSRIASFMNADPDEIAFGLSTTGLLRTLTNSLRPNLNPDSEIIVSVLCHEAGITAWRALAKSLGIVIKWWAPPKGYGTDPRLTLGSLRPLLSPKTRLVACGHVSNVTGTIEPIKEIADLVHTIPGAMVCVDGVAWAPHRPIDVKSLDVDFYIFSWYKAFGPHLSQIYARRRVQQRFLSSLNHYFFEPNTLSVKLGLGNHCIELEHSVVPIINYLEDQVGWESIVGHEQAITGYLLDYLTSNPDMYTVYGSHSSDPNDRVSLVSFSVNGLSSDRVAQEVHETSACRLISGDCWSPRTVYDVLGRGDDGIIRASLVHYNTMDEMRTFTQVLDQAVRRLRHRDSPPSAVHAAAS

SEQ ID NO: 70568 - protein, 562 aa, Vibrio sp. Ex25
MNNDKRPLYIPYAGPALLATPLLNKGSAFSAEERSSFNLEGLLPESTETIQEQVERAYQQYKSFESDMDKHIYLRNIQDTNETLYYRLVQNHISEMMPIIYTPTVGAACENFSNIYRRGRGLFISYPNRDRIDDLLNNAANHNVKVIVVTDGERILGLGDQGIGGMGIPIGKLSLYTACGGISPAYTLPIVLDVGTNNPQRLADPMYMGWRHPRITGAEYDAFVEEFIQAVQRRWPDALIQFEDFAQKNAMPLLERYKDRVCCFNDDIQGTAAVTVGSLLAACKAAGTQLSKQRITFLGAGSAGCGIAEAIIAQMVSEGISDEQARSQVYMVDRWGLLQEGMPNLLDFQQRLVQKHTNTKEWENEGNGFSLLDVMRNAKPTVLIGVSGAPGLFSQEVIEEMHKHCKRPIVFPLSNPTSRVEATPNDIIRWTNGEALVATGSPFEPVVHEGRTYPIAQCNNSYIFPGIGLGVLAVNAKRVTDEMLMESSRALATCSPLAINGRGALLPPLEEIHSVSKKIAFAVGKKAIEQGVALEITDEALNVAIEQSFWQPVYRRYKRTAF

SEQ ID NO: 70569 - protein, 132 aa, Helicobacter pylori
SNIKYELDKESGALMVDRVLYGAQNYPANYGFVPNTLGSDGDPVDVLVLSDVAFQAGSVVKARLVGVLNMEDESGVDEKLLALPIDKIDPTHSYVKDIEDLSKHTLDKIKHFFETYKDLEPNKWVKVKGFEN

SEQ ID NO: 70570 - protein, 196 aa, Escherichia coli K12
MPIYQIDGLTPVVPEESFVHPTAVLIGDVILGKGVYVGPNASLRGDFGRIVVKDGANIQDNCVMHGFPEQDTVVGEDGHIGHSAILHGCIIRRNALVGMNAVVMDGAVIGENSIVGASAFVKAKAEMPANYLIVGSPAKAIRELSEQELAWKKQGTHEYQVLVTRCKQTLHQVEPLREIEPGRKRLVFDENLRPKQ

SEQ ID NO: 70571 - protein, 349 aa, Yarrowia lipolytica CLIB122
MTTIPKTQKAVIFETSGGPLMYKDVPVPVPADDEILVNVKFSGVCHTDLHAWKGDWPLDTKLPLIGGHEGAGVVVAKGKNVTTFEIGDYAGIKWINKACYTCEFCQVSAEPNCPKATMSGYTHDGSFQQYATANAVQAAHIPKNCDLAQIAPILCAGITVYKALKTAGLKAGEWAAVTGAGGGLGSLAVQYAKAMGYRVLAIDTGADKEKMCKELGAEVFIDFAKSKDLVKDVQDATKGGPHAVINVSVSEFAVNQSVEYVRTLGTVVLVGLPAGAVCKSPIFQQVARSIQIKGSYVGNRADSQEAIEFFARGLVKSPIIIVGLSQLESVYKLMEEGKIAGRYVLDTYK

SEQ ID NO: 70572 - protein, 572 aa, Haloarcula marismortui ATCC 43049
MQVKISDDATESEAQAIAEALATHFEDDITLVVDGGETVSSATYDGTRQDESTDPVEDDLGPTEREEALREEIAEILEGGPEKYKEQLPEEGKLFVRDRIDLWFGDDFLFEDGKFAEFDADDQLPADGLITGAAEFEGRDLHFMANDYTVKRGSMAAKGVEKFLRMQQRALKTGRPVLYLMDSSGGRIDQQTGFFANREGIGKFYYNHSMLSGRVPQICVLYGPCIAGAAYTPVFADFTVMVRDMSAMAIASPRMVEMVTGEEISLEELGGPDIHAQHSGSADLIADDEEHARELVAQLISYLPDNADEDPPQTSGTAPKRSPEGIDSVVPEKPNKGYDMFDVIERVVDAGSTLELRPEYGKEIITSFARIDGRPIGVIANQPAQRAGAIFPDAAEKAAQFIWTCDAYNIPLLYLCDTPGFMAGSGVEKEGILEQGKKMIYATSSATVPKQSVVVRKAYGAGIYAMSGPAYDPESTIGLPSGEIAIMGPEAAINAVYARKLSEIDDEDERQQKEQELREAYREDIDIHRMASEVVVDDIVPPSDLRTELTNRFAFYETVEKDLPDKKHGTIL

SEQ ID NO: 70573 - protein, 634 aa, Hordeum vulgare
MILHLLSSHDELRCISTFCYILALAISSILSLLLSTTEAEGTLGRAVCPLLCDTSRHPASFPLRGDPPSCGVREYELICRDAQAIIHINTGRYFVTSISYSDSVFWVVDAKLDHGSCPIPERNQLPYFYGFDSANMILFLLYSGRWASFVSCSRMIKDNANYRPVACQSTNSSFVYVSTALRWAVDVEPSCRYLAMTPLESSRLRVADVTSYDYEDVVKFMREGFAVRFPFLPPDWTYSWIINTCLNNSRRNNSKSDNSKLYWAVLVVVSAIMFAVLSRLVFAPLSILIFLAHKYWKTKISIDAVERFLQMQLALGPTRFAYTDITAITSHFKEKLGQGGYGSVYKGVLPGDVHVAIKMLVSSMSNGEEFISEVSSIGSIHHVNVVRLVGFCSEEMRRALVYEYMPHGSLEKYIFSPEKSFSWDKLNQIALGIARGIDYLHRGCDMQILHFDIKPHNILLDSDFTPKIADFGLAKLYPRDNSFLPVSCAGTVGYIAPEMVSRSFGAISSKSDVYSFGMLLLEIAGGRRNVDPRASRSQTYYPAWVYNQLQEVGVEISEAVVGIHQVERKLCVVALWCIQMKPDDRPAMSEVLDMLEAGIDGLEMPPEPFFCGDEYAPAADSSILLLSEISTISE

SEQ ID NO: 70574 - protein, 105 aa, Desulfitobacterium hafniense Y51
MLIWSLMLVCLLNIPFGYWRKNVRKLSLPWFMAIHLPVPFVALLRHHLELPGATLLAFLAAYFLGQYLGSRLSRTLRPYGNVSSSLVHDLVHRSWIIIIGRQIGR

SEQ ID NO: 70575 - protein, 518 aa, Desulfitobacterium hafniense Y51
MSILNVENVNHGFGGRKILENTTFRLLKGEHVGLVGANGEGKSTFLDIITGKLIPDEGKVEWSNRVSVGYLDQHTVLTQGKSIRDVLREAFQKMFELEAEMLELYNRMAEATEAQMNKMMEDVGEIQTILESNGFYMIDAKVEEVANGLGLGEIGLDKDVADLSGGQRTKVLLTKLLLQKPTILILDEPTNYLDAEHIIWLSNYLKDYENAFILVSHDIPFLNDVVNVIYHVENADLTRYTGNYEQFMQLYNIKKEQELKAYEKQQKEVDRLEDFIARNKARISTTGRAKSRQKQLDRMEILEKPKEKIKPQFRFKEARSPGRVIFEAKDLVLGYNEPLTRPLSLHLERGQKVAIRGVNGLGKTTLLKTLLGIIPSLSGEVILGDYLYPGYFEQESSRGNTNTPIEEIWQEFPGLTNYEVRQALAKCGLTNEHISNKMMVLSGGESAKVRLCKLMLKDINFLVLDEPTNHLDVDAKDELKKAIREFKGTVLLVSHDPDFYSDWVSDIWNLEQWTTKIV

SEQ ID NO: 70576 - protein, 403 aa, Arabidopsis thaliana
MASLGLSFPPAAKTPTYLASSSSTFFSNSSLSVRTSQFRSRNSVFACVKCDMPESLNVGNGNPSIPIINERTLPKFLESARMEKSVNRTNTRLKLFSGTANPALAQEIAWYMGLDLGKVNIKRFADGEIYVQLQESVRGCDVYLVQPTCTPTNENLMELLIMVDACRRASAKKVTAVIPYFGYARADRKTQGRESIAAKLVANLITEAGADRVLACDLHSGQSMGYFDIPVDHVYCQPVILDYLASKSIPSEDLVVVSPDVGGVARARAFAKKLSDAPLAIVDKRRSGHNVAEVMNLIGDVRGKVAIMVDDMIDTAGTIVKGAALLHQEGAREVYACCTHAVFSPPAIERLSGGLLQEVIVTNTLPVAEKNYFPQLTILSVANLLGETIWRVHDDSSVSSIFL

SEQ ID NO: 70577 - protein, 586 aa, Arabidopsis thaliana
MEFFTEYGDANRYRILEVIGKGSYGVVCAAIDTQTGEKVAIKKINDVFEHVSDALRILREVKLLRLLRHPDIVEIKSIMLPPSKREFKDIYVVFELMESDLHQVIKANDDLTREHHQFFLYQMLRALKYMHTANVYHRDLKPKNILANANCKLKVCDFGLARVSFNDTPTTVFWTDYVATRWYRAPELCGSFCSKYTPAIDIWSIGCIFAEVLTGKPLFPGKSVVHQLDLITDLLGTPKSETIAGVRNEKARKYLNEMRKKNLVPFSQKFPNADPLALRLLQRLLAFDPKDRPTAAEALADPYFKCLAKVEREPSCQPISKMEFEFERRRLTKDDIRELIYREILEYHPQLLKDYMNSEGSSFLYPSAIGHLRKQFAYLEENSGKSGPVIPPDRKHASLPRSAVHSSAVNSNAQPSLNASDSRRVSIEPSRNGVVPSTSAYSTKPLGPPPRVPSGKPGRVVESSVTYENDRNLKESSYDARTSYYRSTVLPPQTVSPNCYFLPNTMNQEKRSGTEAASQPKPQFVPTQCNSAKPAELNPNPYVQSQHKVGIDAKLLHAQSQYGPAGAAAVAVAAHRNIGAVGYGMS

SEQ ID NO: 70578 - protein, 491 aa, Mycobacterium sp. MCS
MTQTVQEHKTTWDKLFIGGQWVAPSTSDVIEVFSPATGQKVGQVPLAAEADVNAACAAARKAFDEGPWPRMSPDERAAVLGAAVKLMEERGAELKYLLAAETGQPQTIVDMMQYGAAMSSFTYFAGAADKFQWSEIRDGIYGQTLVTREPIGVVGAITAWNVPFFLAANKLGPALLAGCTVVLKPAAETPLSVFAMAQMFAEAGLPEGVLSVVPGGAETGRALTANPEIDKYTFTGSSAVGKEIGKLAAEKLKPCTLELGGKSAAIVLEDADLDSTLPMLAFSGVMNSGQACVAQTRILAPRSRYDEVVEKLANFVSAMPVGLPDDPNAAIGPLISEKQRERVESYIKKGTEEGARIVTGGSRPEGLDSGWFVQPTVFADVDNSMTIAQEEIFGPVLAVIPYDTEDDAIRIANDSVYGLAGSVWTTDNKKALEVASKIRTGTYAVNMYAFDPGAPFGGYKNSGIGRENGPEGIEQYCQAKSTLLPFGYTPE

SEQ ID NO: 70579 - protein, 418 aa, Lotus japonicus
MDSQNISPSPTASSGSVFAHLVRAPEDPILGVTVAFNKDPSPVKLNLGVGAYRTEEGKPLVLNVVRKAQHQIVNDPSRNKEYLPIVGLADFNKLSAKLIFGADSPAIQENRITTVQCLSGTGSLRVGGEFLAKHYHQRIIYLPKPTWGNHTKVFTLAGLSVKTYRYYAPATRGLDFQGLLEDLGSAPSGSIVLLHACAHNPTGVDPTPEQWEQIRQLIRSKALLPFFDSAYQGFASGNLDADAHSVRSFVADGGELLAAQSYAKNMGLYGERVGALSIVSKSADVASLVESQLKLVIRPMYSNPPLHGASIVATILKDRDLYNEWTIELKGMADRIISMRQQLFDALRSRGTPGDWSHIIKSIGMFTFTGLNPEQVSFMTKEYHIYLTSDGRISMAGLSSKTVPHLADAIHAAVTRAS

SEQ ID NO: 70580 - protein, 496 aa, Staphylococcus epidermidis ATCC 12228
MELVDKLSNRQYIDGEWVESSNKNTRDIINPYNQETIFTVAEGTKEDVERAILAARRSFEDGEWSLETSEVRGKKVRAVADKIKENREELAKLETLDTGKTLEESYADMDDIHNVFMYFAGLADKDGGEIINSPIPNAESKVVKEPVGVVTQITPWNYPLLQASWKIAPALATGCSLVMKPSEITPLTTIRVFELMEEVGFPKGTINLVLGAGSEVGDVMSGHEEVDLVSFTGGIETGKHIMKQAANHVTDVALELGGKNPNIIFDDADFELAVDQALNAGYFHAGQVCSAGSRILVHNDIKDKFEKALIDRVSKIKLGNGFDQDTEMGPVISTAHRDKIEGYMEVAKKDGATIAIGGKRPEREDLQAGLFFEPTVITDCDTSMRIVQEEVFGPVVTVEGFADEEEAIRLANDSIYGLAGAIFTKDIGKAQRVANKLKLGTVWINDFHPYFAQAPWGGYKQSGVGRELGKEGLEEYLVSKHILTNTNPEPVDWFSK

SEQ ID NO: 70581 - protein, 123 aa, Taraxacum officinale
NAKLAVEKSLTPPEVPQLPSPETSASSTTVSLSVATDLESGAVPSSLSPATVEVVPKPQQRNRCGSCSRRVGLTGFTCKCGTTFCGTHRYPELHACTFDFKTIGKEAISKANPLIKAEKLNKI

SEQ ID NO: 70582 - protein, 577 aa, Candida albicans SC5314
MENKVSEISEMTTDLNSNSETKFDHFTTTTKTTTDQIQKKSTETTTTTQSISINSKDEKKAGSKLSRVVKVSRRALTTYASFIGPGLLVSVAYMDPGNYATGITAGASNRYSLLFIVLLADIIAIFLQVLCIKLGCVTGYDLARCCREYLPKKLNWILWILAECAIISTDVAEVIGSATALNILLKIPLPAGVVITIVDVIFVLIAYRTDTSSLKFVKIFEYAVGCLVMIVVICFAVELSQITANVGQVFRGFVPSKEMFDGNGMTVATSVIGSTVMIHSLFLGSGLVQPRMRDYDVKHGYVNLYEIAKEEKVQEEEEEDQTEISPVASNPIQNNIAPTYEQEAKFFRTKYKPSYKSICYCLKYSKIELIVTLATIALFVNAAIVIIAGATLYGTSEAMNADLYTIHSLLSKSLSPAVGTIFMVALLSSGQSAGVVCTIAGQMVGEGHINWTLKPWMRRILTRAISIIPCLTISVFIGKNGLGVALNISQIIISILLPPLTAPLIYFTCCKKIMKVELGEEDEVEGIEEDDGDSGKRYKYMTNSWLTTIIVVIIWLLVAILNVYAIYQMAVSGVTGS

SEQ ID NO: 70583 - protein, 376 aa, Synechococcus elongatus PCC 6301
MRGDFAPNDRTQTTEAARLNKGLFASQIMSQGQQSDRRFPAEWEAQDGVLIAWPHADSDWRSLLDQVDRVYRDLAEAVTRFEQLLIVTPEPDRVAEQLAQTTANCDRIQIVELPTNDTWSRDFGPLTVETPAGLRLLDWGFNGWGLKFAANHDNQVTRRLWQQGIFGTTPLETVPLIFEGGSIESDGRGTLLTTSQCLLEANRNPGLSREAIAQIIQRQLGGDRLLWLEHGHLEGDDTDAHIDTLVRIAPNDTLIYVACDDPSDSHAAELTALEAELKALRAADGQPYHLIPLPWPQPCFDADGQRLPTTYANYLVINGAVLVPTYNDPADEAAIAAIAAAFPDRLAIGINCRPLLEQHGSLHCITMQLPAGLLSR

SEQ ID NO: 70584 - protein, 547 aa, Oryza sativa
MESSAAENWWVLPLTFLPPISGQNESAATLSAMATSFVYLAIFACLAWAGTALLYWAHPGGPAWGKYRRARGQSPRCSIPGPKGLPVVGSLGLMSGLAHCSLAAEAARRPGAKRLMALSLGPVRAVVTSHPDVAKEILDNPAFADRPLNHAAYGLMFHRSIGFAEHGPYWRALRRVAAGHLFGPRQVDAFAPYRARVAGGVVAALRGAGGEAAVQVRGVLRRASLYYIMRFVFGKEYDVSRGAPESGEEVEELLEMVHEGYDLLGKENWCDYFPGLAAVDPQGVGARCAELMPRVNRFVRGIIQEHRGKAIAGGEARDFVDILLSLQESEGLADADIAAVLWEMIFRGTDAMAVLMEWTLARVVLHPDVQANVHRELDAVVGRSNTVAESAVPSLPYLQALLKEALRMHPPGPLLSWRHRAISDTYVDGHLVPAGTTAMVNQWAMSRDADVWDAPLEFQPERFLPGGKAHGVSVLGADGRLVPFGSGRRSCPGKSLAMTTVTAWMATLLHEFEWTPASGAVDLSEVLRLSCEMAVPLEVRVSARRNV

SEQ ID NO: 70585 - protein, 391 aa, Anaplasma phagocytophilum HZ
MVCDFMIPFYKPFDISFVRGEGVYLYDSSGKRYIDFGSGRATSALGHCHPAMVQALCEQSKALWHVSNMYRIQESESLAAELVGLSFADMAFFVNSGAEAVECGFKVARSYQNGIGRPERYKVLTLRRAFHGRTYATCSASEPTGFLPLLYPYVDWFVSVTPSIEAIRSEVEKGNIGAILVEPVQGEGGIHVLSGELLRDLRALCDQHDILLFFDCVQCGSGRTGKFFAYEHFSVTPDICSLAKGLGGGFPIGGCLITKKAGQFVTERMHGSTCGGNPLATAVARAIVREITKPGFLANVEQNGAYFIEQLSQMATRFPIIKNVRGIGLLIGVEINDTASAHSMAEQLISHGILIAPASGNVLRMVPPLIVSRQEIDEFLQIFEGFLRSFS

SEQ ID NO: 70586 - protein, 473 aa, Clostridium acetobutylicum ATCC 824
MQKTKMIFTVGPASETEEIVTAFIKAGMNASRHNFSHGDHAEHGGRIALVKKVRAKLNKPVAICLDTKGPEIRTGDFNPSKLELQKGSKFTIVCGEEIVGDATKCSISYKDLYKDVKPGNTILIDDGLVGLTVEAIEGTNVICTVANTGLVGSHKGVNVPNVSIQLPAMTEKDKSDLIFGCKEEIDMVSASFIRKPEDVLAIRKVLNENGGENIQIFSKIENQEGVDNIDAIIEVSDGIMVARGDMGVEIPIQRVPLIQKMIIKKCNAVGKPVITATQMLDSMMRNPRPTRAEASDIANAIFDGTDAIMLSGESANGSYPIEAVTTMAKIAQEAENEINYDKFLAERKGNEKKNTSDVISLGTCTAAADLEASAIITATQTGSTARTVSKYRPKAPVIAVTPSEKVARKLAMSWGVHPIISDKFGSTDELISTSVDKALEAGYVQKGDLVVVAAGVPTNVSGTTNMLKVQVVE

SEQ ID NO: 70587 - protein, 175 aa, Synechococcus elongatus PCC 6301
MEDVPTLLVQDDAGRTLLCDLEHLVPIDGQEYALLMPVDTPVSLFAWDGEDEDEPPRLVEDESEVEAVWPTASAVLQEQNLTLINSAVTLTVEGELPDLEDEDEESDFEEDEEVEEEFIHLVSFYHEEQEYSFFVPLEPIYVVARLVDGEAKLLTPEEFEAIEERLTAELDERMA

SEQ ID NO: 70588 - protein, 298 aa, Cyanidioschyzon merolae strain 10D
MFVTLGVPSRAVSSKAESYAQRLRIVRTARTRLFMSAQSARKFFVGGNWKCNGSKQSVQELCEAFNAGKNIDFNRVEVVVAPPSVYAMLTRSILRPDFGVALQNCWVGKPGAFTGEVAVEMIRDIGLSHVILGHSERRHLPEIRESDDVIGRKTKYAIDKGVHVILCIGELLEEREAGRTREVNERQLSAVRAHLSADDWAKVVIAYEPVWAIGTGKVATAAQAQEAHSEIRSWIRRQVSEACASQMRILYGGSVTPENCLELAAQPDVDGFLVGGASLKPTFLDIVRAYQAKETVSV

SEQ ID NO: 70589 - protein, 426 aa, Bacillus clausii KSM-K16
MPQEWNDLAQTIPYRLAPSMAKDHPNLPVEKEEGCYYYGVDGKTYLDFTSGIAVTNVGHRHPKIVAAIQEEAGRFTHGPIGVIQYESILQLANELAEIMPGDLDCFFFGNSGTEAVEGALKLARHVTKRPYVISFNGCFHGRTLGSLSVSTSKAKYRKYQPAQGMAYQIPYYATGDTEEQAIAKLEDSFASLFAHQVSPDEVAAVIIEPVLGEGGYIVPPASWLQRIRTICDEHGMLLIFDEVQTGFGRTGEWFAAHTFGVVPDIMAIAKGIASGLPLSATVANHKLMQQWPLGSHATTFGGNPIACAAARATIAVIKEEQLLDNAKQVGAYAKQRLNAMQEKWPQIGAVRGIGMMFGIEIVDPKTGEKDGDIAAKILDLALEEGVLFYFCGNAGEVLRMIPPLTVTKAEIDEGLAKLDRAFTRLG

SEQ ID NO: 70590 - protein, 141 aa, Triticum aestivum
PQHFRRPSFNQQTLHGVFIFTSSPHNPLLRLPADSQANFRSSRNIATSLFKQYKNVIDRGGGDNIKGFVSAGVQAYALGCTEEGLRKELMDIKNSGVKIEGLQSYGGTSLSFKVRSFEVKECILWLSIVFITILCTPQPTV

SEQ ID NO: 70591 - protein, 442 aa, Gibberella zeae PH-1
MGVKSDSHLNHGELRTSCVFSSQDALKAEQDHSAKNYQSLPIVFSRAQGASVWDPEGRHYLDFHAASTALNHGHCHPKLVATLVDQASRLTLTSRAFHNDIYPQFARYVTGLFGYDRVLPSSTGAEASETAIKVARKWAYKVKGVPENQAIVFGAAGNHHGRTLATIALASDNMSRDNYGPLDQNISCTIPGTNRHIEYNNKAALDEAFEAAGFNLAAFIVEPIQGDAGVIVADDDYLRHARSLCDKHNVLLICDEIQTGIGRTGKFLGHYWSGIRPDMVLLGKTMTGGMYPFSCVLGDNAVMLTVEPGTHGSTYGGNPLGAAIAMRALQVVEEENLAENAERLGCVMRDGLKEIQAQTNIIETVRGRGLLNAVVIDQSKTNGHTGIGLCELMKEKGLLLKSSRTGIIRISPPLVITVEEIHWSLRIMKESIDELMQLPSAS

SEQ ID NO: 70592 - protein, 223 aa, Chlamydomonas reinhardtii
MLEAFFGKKKTPAEMLRENKRQLDKAIRELDRERMSLQQQEKKTVAEIKKMAKEGQMDAVKVMAKSLVRNRHAVTKMYGLKSELQAVSLRLATLKSTQAMADAMRGATKAMRAMNRRMNLPNLQNIMREFERQNERMEMTSEMMGDAVDDALQDEGEEEETDNLVNQVLDEIGIGNMTELASAPVGTRVAEKPQAAPAMAEAEGGGGGIDEDLQARLDNLRKS

SEQ ID NO: 70593 - protein, 215 aa, Saccharomyces cerevisiae
MDQENERNISRLWRAFRTVKEMVKDRGYFITQEEVEWPLEDFKAKYCDSMGRPQRKMMSFQANPTEESISKFPDMGSLWVEFCDEPSVGVKTMKTFVIHIQEKNFQTGIFVYQNNITPSAMKLVPSIPPATIETFNEAALVVNITHHELVPKHIRLSSDEKRELLKRYRLKESQLPRIQRADPVALYLGLKRGEVVKIIRKSETSGRYASYRICM

SEQ ID NO: 70594 - protein, 790 aa, Debaryomyces hansenii CBS767
MLPDENTRLLERSSSLQIPTSRGGSPGPSSSSRLKRPPLISIPTSQSVRSLRSINNVNDPLVNSYISNRSKNGYSRGNSATDELDESIFKSRFWNKFNRIEADDSFDFYSYVSYYCPILKWLPNYDAKNNFLGDCVAGLSLASFQIPLVMSFSLSLAHLSPVSGLYGIIIGACVYSILGCVPVLIVGPLPSTALIYGEAIEAIRQLPNFAELSKLQISSAISAAMSGLLLGAGIFRMGFLDNVLSRALLKGFIAAIGFIMIINELSTELGIGDLILDNPYLTTFDKLMFVCKYARQSHIFTLLVSCITLGLVLSIRKLKNTLVNKYHMRHAVLIPELFLMVLVATYLSWRFQWHSEYGVEIIGNIQSSTPDSKSMVEFINPFKPSLIPLYKKAFSASFLCTILGYFDSTTATKALGAKYNYNVSSNRELIALGATNFVVSLVGGIPAFGTFGRSKINILSGANTQMASIMMSIATVLVIIYLLPLLYNLPKCVLALSTTIIGITVLEEAPSDLKFFWNIGGYDEILTFLFIFCTTILWNAEAGVLSGAAFAIIRIIKHSTRSRIQILGRVPNTTVFRNADELIEESFVTYANGSDPVNQEETSSDIEDSTDKLMNLIAEIEEIEGVLVIKIPEPLNFANVGDLKNRLNRIEKYGSLLIHPSQPTRRDFNNTTIKFIIFDCKGMNAIDSSATQILYEIIRKYIEVNEISVCFSRVAMSKDIRHKFKKLGIIDLVNNSYKTYENSNNVRSKSAGSENGSSTNLYSYGTSSGMEDGFFLSIDEAIKAFGSQNV

SEQ ID NO: 70595 - protein, 501 aa, Rhodopirellula baltica SH 1
MVLVSCSSAFSASRNGWFDCSSIENSTQKFDSPYTNVADACENAARVGLERAGGFRLFPGNFHLGVKMSDTFNPDTPNIDAPAIDSPTTDPEPAEFEVKLASRVDRLPPYMFGRINNLLYQKRRAGDDVIDLGMGNPSDPPDPIVVQKLNDAAADIGNHGYSKSNGITNLRREVASKYHRKYGVRLDPEGEIIACLGSKEGFSHMCLALMGPGDTAIIPSPYFPVHMYGVILASGNVVALDVADPDKFLSNVAYTCENLTPRPKVLIVNYPHNPSSAVIEGDFFVEVVRLAKKYGLMVIHDFAYADVAFDGYVPPSFLSAPGAKDVGVEFTTMSKGYNMAGWRVGFCAGNADMVRGLGTIKGYYDYGMFQAIQIAAIVALRETEATVAKQSEVYQSRRDVLVSGLRRLGWNVNPPKAGMFVWAEVPEPWKSQMSTMDFAMMLLEDGNVAVSPGSGFGAAGEGYLRMSLVENEHRLRQAVRQIGKCLAAGKADAGPVASSAS

SEQ ID NO: 70596 - protein, 328 aa, Magnaporthe grisea 70-15
MAKTSIKLNSGYEMPLVGFGIWKVPVDKTAQAVYDAIKLGYRQIDGAYDYTNSKEAGEGVRRAIEEGIVKREDLFITSKLWNNYHKHEHAIEMAKHEVDTWGIGYLDLFLIHFPISLEYISHSKMPYPCFWPDREKSRSTPLQYTPVAETWAALESLVKTDSNPDGILRSIGVANFRAQLLTDLWGSAKIKPAVNQIEHHPYLVQPQLLAFLKDHGIAITAYSSFGPQSFVELDHPRVSKVEPLFTHPTIKAIADKHGRTGAQVLLRWATQRDIVVIPKSNNVDRLKQNLDCVSFDLSDDEVKQISDLDCGVRFNDPADLSPPIYIFD

SEQ ID NO: 70597 - protein, 318 aa, Prochlorococcus marinus str. MIT 9303
MAVNPQGVAAVLADLKGRDFLSCADFTAEQTVALLELSRQLKSGDRRIDLGNRVLGLIFTKASTRTRVSFQVAMARLGGQTVDLNPQVTQLGRGEPLEDTARVLSRFCDVMAVRTFAQQELLDYAHWASIPVLNALTDLEHPCQAMADFLTMQEALGSLTGQTLAYVGDGNNVSHSLMLCGALLGVNVRIGCPQGFEPLPEVIDQARNLAVADARIEVMTDPVDAVRGAQALYTDVWASMGQEQEQSLREEAFRGFCLNEDLLAQADPNAIVLHCLPAHRGEEISSAVMEGEASRIFDQAENRLHVQQALLAAVLGGL

SEQ ID NO: 70598 - protein, 169 aa, Clostridium perfringens str. 13
MFKNLKYDIENVMKNDPAARTKLEVLLLYQSIHVLIFYRIAHGLYKIKLFFLARLISQLGRFFTGIEIHPGAKIGKGLFIDHGMGVVIGETAEIGDNVTIYHGVTLGGTGKDKGKRHPTIGNNVIIGCGAKILGPISIGDGAKIGANSVVLKNVPKGKTAVGIPAVIKN

SEQ ID NO: 70599 - protein, 479 aa, Escherichia coli K12
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVAFGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 70600 - protein, 300 aa, Clostridium perfringens str. 13
MVFNSLLSLIGNTPILKANNLFEGNNVFVKLEKFNPGGSIKDRAALGMIEEAEKNGLLKENGVIVEPTSGNTGIAIAMIGKIKGYKVIITMPETMSKERRDMIKAYGAEIILTEGSKGMKGAIEEAERLASTKGYFMPQQFLNEANAKKHYETTAEEIIRDIPDLDVFIAGVGTGGTITGVGRKLKEYNPNIKIVAVEPSDSAVLSGENSGPHKIQGIGAGFIPKIYDSSVVDEIIKVKNEDAYTMAKNFADKEGVLVGISSGAALKGAKDILENIAKDKKVLVIAPDGGEKYFSTGLYE

SEQ ID NO: 70601 - protein, 202 aa, Medicago truncatula
MGMIVEVENIDEDDDVLIPPPNFSMVEDCIYRSSLPKPSSFPFLQTLNLRSIIYLCPEPYPEENLDFLKEQNIRLFQFGIEGKTEVSLPALRDSIMEALKVLVDVRNHPILVHCKQGKHRTGCLVGCFRKLQNWCLSSAFEEYQRFAGVKSRAADLTFIERFDLVSLRQCLYSIIYQYQGASKKRRLMYQDENIQKPRLTSF

SEQ ID NO: 70602 - protein, 326 aa, Solibacter usitatus Ellin6076
MATETKTAKSKFEIKPGAATREAFGRTLVELGRENKDVVVVDADLSKSTMTTYFAKEFPDRFFSCGIAESNMVGVGAGLAMAGKIPFVASFSVFAVNKGFEQMRVCAAYGRSNLKVVGTHSGISIGEDGPSQMSVEEIALACSLAGFVVIAPADETATKALVRAAAAYDGPVFLRTGRPKAPVIYGAAQKFEIGKSIEVTAGTDITIIANGLLVAQAMLAADALEGEGISVRVIDMHTVKPLDRDAIARAAAETGAIVVAEEHLVDGGLGVRVAQVTAETNPCVMEFVGIHDRYAESGQPEELLEKYHLVAPDIADAARKALSRKR

SEQ ID NO: 70603 - protein, 244 aa, Moritella sp. PE36
MQQVKPTIVSCNIENAVATIVMDDGKGNVISPEMLRQLNQALDKAKKENAVVLLTGSNDIFCAGFDLKILKTGVLNTFAMLIGGFELSKRLLSFPTPVVIACNGHTLAMGSFLLLSGDYRIGVEGQVKIVANEVEIGLAMPHSAIEICRQRLRPAHFDRAVLLSELYNPQTAVEAGFLDKVVPKEALYEEALKLAKQFASLDLKAHKRTKLRMRRELLKALRRAIRADKIDFVAQGLQRILGKK

SEQ ID NO: 70604 - protein, 601 aa, Desulfitobacterium hafniense Y51
MNTAVLKLEKHLPLIDTLRTYKKEYIKKDITAALTVAVIAVPQSMAYALIAGVNPVYGLYTAIVSTIFCSLFSSSNHLIGGPTNAIALLVASGMKNYMALENAYEILFLLTFLVGAMQLLFGVLRLGKLINFVSHSVIVGFTAGAAVLIGLGQLNSFLGISIPNSSEMSTLNKLVYIATHLGTVNYYALGLGLLSIFVIMICKRINKNLPGALLGVCLSSALVAMFSLEQFGVKLTGTIPSQLPPFKMIHFDLGMAGELLSGAFAIAIIALVEAISISKAIASQSRQKIDANQEIIGQGITNVVAPFFQCFPGTGSFSRSAINFQSGAATRIAGILSGVFVAIVLLFLGSYAKYIPMASLAGVILNIAYNMVNRAEIKRIFKLNKADALVMGTTAIAAVLLPHLDTAVYLGIAVSIMIYLREGSKVHIKILTPAQGKENAFLEKEIQSVEEKADTLIVHIQGNLYFGCADELEKKLDLLVGKAGIVIIRMKRVNSIDVTSLDTLKLFVQKIKETGGKVIISGVSSNVDKLLTESKLAQQIGEENIFISQEDLFASSNQALNRAKYFLDYDISKVKEMFSNSTLVFNDQFDSSRQAVSQNTN

SEQ ID NO: 70605 - protein, 593 aa, Synechococcus elongatus PCC 6301
MDSGLDTTLLLIVTVAAGIAAQVLASWAKLPGIVFLLLTGLLLGPDGLNWVQPEQLGEGLETLVSLSVALILFEGGLSLDLRNLLQVSGSLRNLITLGAGITILGGAIAAHRFSEFPWPLAFLYGAIVVVTGPTVTTPLLRQVQADPKVSTLLEGEGVLIDPIGAIVAVVVLNFVLSGSQDVGLVLEGLILRLVVGAIAGSVGGGLLALFLRQVRFLSEELRTLVVLAALWAIFGAAQAVVSEAGLLAVVIAGLLLRAVAIPDLEAIKTFKGQLTTLAISILFVLLAADLSIASLFALGWGGPLTVLALMLLVRPLSIGLCTWGSDLNWAQKAFLSWIAPRGIISASVASLFAILLTDRGLAGGAAIKAQVFLTILMTVFLQGLSAKTVAKKLGVLDRPEQIVLVGDDLELRLLAILLEQNKQPHQAIATVPEEPDWESESITLLLGRDQSTPAEQTGLTVVDLCPLDDRAHLYSTQISADLWQQRLQEQRCELFQIELSDRQAVQQWQQALEADRILPLLHQRGEGWELALLPAVAETGDRFWGLSRDRQLALDEIEWQDWPADWSSSPEPPRSQPEDAVELAPPDAATPSS

SEQ ID NO: 70606 - protein, 366 aa, Triticum aestivum
MSDGKDTLDLSALGAAVPNAAELSAEDKANLVESIKNTLQGLAARHTDVLESLEPKVRKRVEALREIQSQHDEFEAKFFEERAALEAKYQKMYEPLYSKRHDVVNGVVEAEGVTKDSGEAAPDEKEEKGVPDFWLNAMKNHEILAEEIQERDEEALKYLKDIKWYRITEPKGFKLEFHFNTNPFFKNEVLSKTYHMIDEDEPILEKAIGTEIEWYPGKSLTQKVLKKKPKKGSKNTKPITKIENCESFFNFFSPPQVPDDDEEIDEDTAEQLQNQMEQDYDIGSTIRDKIIPHAVSWFTGEAAQDEDFDGIMDDDEDDDEDDEEDEDEDEDDEEDEDDDDGDKKKGGRVPAGEGQAGERPAECKQQ

SEQ ID NO: 70607 - protein, 572 aa, Staphylococcus epidermidis ATCC 12228
MVNTNNHISEELDKNLDEMEFLKANSDFLRGTIEQSLANPITGSITQDDAKLLKFHGSYMQDDRDLRDERRKQKLEPAYSFMIRVRVPGGKATPEQWIAMDDISNQYANHTIKLTTRQAFQFHGILKRNLKQSMKNINHAVLDSIAACGDVNRNTMCNPNPYQSQVHKEINDYATRISNHLLPRTNAYHEIWLDGEKVLDSSEEKEPIYGNTYLPRKFKIGIAVPPSNDIDVYSQDIGLIAIVEQDELIGFNVTIGGGMGMTHGITETYPQLGRLIGFIPKEKVVDVCEKILTIQRDYGNRENRKNARFKYTVDRLGETWVTEELNRRLGWEIKAPRDFEFEHNGDRLGWIEGINNWNFTLFIQNGRVKDTEDYLLKTALREIAEIHTGDFRLSPNQNLVIANVSPEKKEEIQAIIDKYKLTDGKNYTGLRRNSMACVAFPTCGLAMAESERYLPSLITKIEDLLDESGLKEEEITIRMTGCPNGCARPALAEIAFIGKAPGKYNMYLGGSFKGERLNKIYKENIDENEILESLRPLLLRYSKERLDGEHFGDFVIRDGVIAKVHDGRDFHS

SEQ ID NO: 70608 - protein, 831 aa, Chromobacterium violaceum ATCC 12472
MTTTLELLAPFSGPAIALDRVPDPVFAGLMMGDGLAIEPLSPTLLAPCSGAVAQLARTGHALTLAADNGAEVLIHIGIDTVKLEGRGFRPLVAVGDKVTAGQPLIEVDLDAVARRAPSLQTMVVIANSEQFRFPRRAEGLLEAGRSHFLTLAAREAVSPRESAGGPERRGEATVRHEGGLHARPSALVQQAAKRREAEVFIEFAGKRANARSVVALMGLGVAEDDRVAVIASGHDADAALADVIEALQTRSEAGHAAVAPAEAREPVAGYLAGVAAAPGLAIGRAVRLDAFEMPLPEQGAGEAAERAALAAALRRVRDAISSGIDAALRRGATAESDIFAAHLALLDDPELLSAAEADIAAGRGAGFGFRRAVRAQCAVLAGLGNPLLAERVADLKDIERQVLVALYGEPEQGPELFDDSILVAEDLAPSELTRLPPGKVAGIVTAAGGASGHVAILARALGIPALVACGPSALALQPGQTLVLDARAGLANPQPTPSDLAAARAEIDKLAARRRAMQASANAPAITVDGVAIEVAVNIANADDAREGVAHGADAVGLLRTEFLFIDRRDAPTEAEQTAAYQAVLDALDGRHAIIRTLDVGGDKEVPYLQLPLEPNPALGLRGIRTGFAYPDMLDAQLRALLAVKPLSRLRILVPMITDVGELIRLRERIEQLAGEMSLSERPQLGVMVEVPSAALLADQLAKHADFLSIGSNDLTQYTLAMDRCNATLAARIDSMHPGLLRLIAITVEGAKKYGKWVGVCGAMASDPQAVPVLIGLGVAELSVSPRLVPEVKSLVRGLSRRHCEEEALRLLALGSPQAVRGRVTELWPGV

SEQ ID NO: 70609 - protein, 332 aa, Chromobacterium violaceum ATCC 12472
MAIKVGINGFGRIGRMVFRAIAKDFPELEVVGINDLLDPEYLAYMLKYDSVHGRFQGDVKVEGGSLVVNGKTIRLTAEKDPANLKWNEVNAEIVIDCTGFFLTKEGCQKHIDAGAKKVVQSAPSKDDTPMFVYGVNHDKYAGETIVSAASCTTNCLAPVAKVLHDNWGIKRGLMSTVHAATATQKTVDGPSSKDWRGGRGILENIIPSSTGAAKAVGKVIPELNKKLTGMAFRVPTSDVSVVDLTVELEKEADYADICKAMKAASEGELKGVLGYTDEKVVSTDFVGNTAPSTFDADAGIALDKTFIKVVAWYDNEYGYTCNMLRFVKHVAG

SEQ ID NO: 70610 - protein, 118 aa, Taraxacum officinale
EYEPSEHDILYAEGVTQGNGLAFIEFSLDDRSPMSETYTDNLDAQSQPLTRVNAKGMNEGCRWVEMFEDVRVVVFCVALSDYDQMWLSPDTTGSGSLLQNKMVQSKEPFEAMVKHPCF

SEQ ID NO: 70611 - protein, 542 aa, Escherichia coli CFT073
MVSALWTVELNDSKTGTHVGLRHKHTFLCTLFRCHLSLERGTTTFVIPDSLSGSAPRKQVSPILLNLKTKTVMKKTKIVCTIGPKTESEEMLAKMLDAGMNVMRLNFSHGDYAEHGQRIQNLRNVMSKTGKTAAILLDTKGPEIRTMKLEGGNDVSLKAGQSFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 70612 - protein, 285 aa, Zea mays
  misc_feature (270)..(270): Xaa can be any naturally occurring amino acid
MAACSHLAAAGGSSPAAAAVVRSPAHSSAAAAFARLRSTLRFSSAGLSVKGSRATFPWVAAAGPAAAAPVADLDGRPATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEKETFPHDALEATAWTEDGLIMAARHKKYKHIQGVQFHPESIITPEGKKIIXLNFVRFIEELEKQRS

SEQ ID NO: 70613 - protein, 283 aa, Bacillus cereus G9241
MIRVGYLGPEATFTNMAVSRFFPEAEHVPYRTIPDCIDAAANGNVDYAVVPLENAIEGSVNITVDYLVHEQPLSIVGEITVPIQQHLLVHPQYAEVWEEVYAVHSHPHAIAQCHKFLNEELKGITARDMTSTSAAAQYVKEHPEEKIAAIANEAAAEKYGLTIVRRSIHTHKNNHTRFLVLHKKKKAILSNNGENRGEKTTLMITLPADYAGALYQVLSAFAWRKLNLSKIESRPMKTGLGNYFFLIDVDKAYDDVLLPGVTMELEALGFSVTVLGSYSSYWL

SEQ ID NO: 70614 - protein, 438 aa, Photobacterium sp. SKA34
MSSTSNKMGLMGLTTIVTVNMMGSGIILLPSSLAATGGIALLAWVVTALGALAIAYAFAKCGMYCTDDGGMSAYAEKAHGKSSFFIASYTYYVCLVISAVAIAVSCVGYLEYFIPWLKETPFQTFIGVVVILIITMFANFRGAKITGKISTITVWGIIIPVLGLSIIGWFWFDTKIFAEAWNPNNISVGSAIYAGMALTLWAFLGIESAGANSGTVENPKRNVPLACMLATVFSAATYIASTTVIQGIIPNDILAKSDSPFGLVFAQMFSPFVGEIITAMAIMACLGSLLGWQFTNAQVSKVAADMRLFPKVFSDVNKHDAPFKGMMIMLALELVLALMTISPTLLKQFNVLVNLAVFINMVPYILALTALGIIMRQSQVNQKEYNTGILIGSFAVIYSIYGSYSTGEEAVFYGTVITLFGYFFYGFIASRDAAPNKT

SEQ ID NO: 70615 - protein, 530 aa, Ustilago maydis 521
MPQVNPNSMSDAADEALRSTFQIVHAFLTEHAPQAAQSLASTLPDSPAPPRTLASALVDHVRNSPRRSWPGLVVQQPTEATSPSPMDEDPDSATDSDSDSSDSDSDSDSDSSSSSSSSSSSSSSSSSSSSSSDSDDSDSDSDDSDASDDDSSDDDEDSDSEDDKKVKAAQHDPPHQDTEAASSTIVSDSQDEAEAELPSNGIATPSRASSTAPPSANKRKREASPSDDPSSESSSDDSDEDSESDSSTEDGDDSDDESSDSDESDSDGAEEDDDEVKATIQKVEVAVKDESDSSSDDSNSDSGSDSDDSSSDDEAPSGGEKDSDDDDSSSDSSSSDDNDSSNSDSDSDADSDSSSSSSSSSGGGDSSSSSDSESNSDSSSASGSSSSSSSSSSSSFSKGAPPAKRQKVVSPPATPTPAPRANTSTSTSTSSSSALPHSARKAQPSSTQNTPFQRVKADQVTYLHDGMRDMSYAGKAGVTGDEYGARASRDLIVTRGKGFTKEKNKKKRGSYRGGAIDVYGSHSIKFDDDD

SEQ ID NO: 70616 - protein, 487 aa, Bacillus clausii KSM-K16
MAIKTEVVFGNYINGRWKQEAASPLASINPSDAEEVVGYVQNSTADVVDEAVEVAKGALLSWRKLTGAERGHYLYQAANQLESRLDEIAETLAREMGKTLPEAKGETARGVAILRYYAGEGLRADGEVIPSTDSEALMFTKRVPLGVVGVITPWNFPIAIPVWKIAPALIYGNTVVFKPATEAAVTAAKVVECFAQAGLPKGVLNLVTGSGKVIGNALVAHEHVHGLTFTGSEQTGKQIGKAAAARGAKYQLEMGGKNPVIVAEDADLHVAVDATISGAFRSTGQKCTATSRVIVAEAILQDFQELLLEKTKQITIGKALDDGVWMGPCASEAQLRTVLDYIEIGKKEGAKLLCGGKRVTDGNRAAGYFVEPTIFTNVNRHMRIAQEEIFGPVIALITAKNMEEAIEIANDSRYGLSASIFTTNIEKMLLFIDEMDAGLVRVNAESAGVELQAPFGGMKASSSHSREQGQAAKEFYTSIKTVFVKGR

SEQ ID NO: 70617 - protein, 344 aa, Magnaporthe grisea 70-15
MSSQSAAGKITDWVKPGDTSGEFKRQVSSFRNWVSSEAGAQFPAEKGRYHLYVSYACPWATRVLIARKLKGLEDVISFSSVHWHLGENGWRFPTAEEAAHPDGENVTPDPCPGHEAFTHLRQVYFAAEPEYEGRFTVPVLWDKVQKTIVSNESSEILRMFGSAFDGIVEDKFKGVNLYPESLRVQIEEAHGWQYDLINNGVYKSGFATTQEAYERNVTALFEALDRAEEHLAGAEGPYWFGKDITEVDIRLFVTLIRFDPVYVQHFKCNIRDIRSGYPHLHKWMRNLYWNVPAFKDTCNFLHIKNHYTKSHKQINPFSITPVGPLPDILPLDDEVPAVKAAKSA

SEQ ID NO: 70618 - protein, 197 aa, Blastopirellula marina DSM 3645
MERLLAAGVKALHLDVMDGIFVPNISYGMPIVAAFRKLTDLPLDVHLMIEKPQDYIRQFHEAGADVMTIHAEAVDDVASILREIKSLGAGAGVAINPDTPLETIVDALPEADLALMMSVNAGFGGQKFNPVALDKIREVRRLAPDLLIEIDGGVNLDTIGRCTEAGADLLVVGSAIFGKPDYVTAVRELNSAAAAAS

SEQ ID NO: 70619 - protein, 204 aa, Zea mays
PHAWRTEAKPKRPFPFALFDPSKKAAAEMVYYALLVGAELDGLTNLQPSGGCDDPSFPYYLKLKCENCGEVTAKSTYVTLSEQVDLPKGHGTAHLVQKCKLCGRDGTIVMIPGQGTPLTIEQSQKEEKTCLMVFDCRGYEPVEFSFGAGWKAESVHGTPFEIDCSEDEFSEYDEKGECPVELSKLQSTFKVVKKHEKGGKIRFV

SEQ ID NO: 70620 - protein, 95 aa, Zea mays
  misc_feature (44)..(44): Xaa can be any naturally occurring amino acid
  misc_feature (73)..(73): Xaa can be any naturally occurring amino acid
GVTKYIQALLFAGFLMQKELDYLVGAVANPKKPFAAIVGGSKVXRKIGVIESLLAKDDILILGGGMIYTFYKXQGILVEKSLGEKDNLELGTFLI

SEQ ID NO: 70621 - protein, 184 aa, Desulfitobacterium hafniense Y51
MILENSPKTSWNRTSKHPKVHHTAYVHPTAVLIGDVRVCENVMICPNVVLRADEGLTIIIGAGVNIQDGVIMHCLKGGSIEIGQDCSIAHCALVHGPAVIGRETFVGFRAIVHNATLGKNSFISHGAMVLNVELPDDSSVPVGKIIQSEAEVRELPAIVVQEISFKHDVQQINRELGRGYRERK

SEQ ID NO: 70622 - protein, 193 aa, Streptomyces lavendulae subsp. lavendulae
ILTIDLHADQIQGFFDGPVDHLFAMPVLADYIGSKVDREALTVVSPDAGRVRVADGWCDRLGAPLAIVHKRRDKDVAHQVTAHEVVGEVRDRVCVLVDDMIDTGGTICAAADALFAQGARDVIVAATHGVLSGPAADRLKNSQVSEFVFTDTLPVPGALGLDKVTVLSIAPLIAGASRAVFENGSVTRLLQSR

SEQ ID NO: 70623 - protein, 219 aa, Photorhabdus luminescens subsp. laumondii TTO1
MTQDELKKAVGWAALEFVTPGTVVGVGTGSTASHFIDALGSIKDQIEGAVSSSEASTEKLKSLGIPVFDCNEVDSLDIYVDGADEINGNMQMIKGGGAALTREKIIAAIAKKFVCIVDASKKVEVLGKFPLPVEVIPMARAYVARELVKLGGVPKYRQNVVTDNGNVILDVHNLAILDPAELENKINRISGVVTVGLFANRGADIVLMGTLDGVETITQ

SEQ ID NO: 70624 - protein, 325 aa, Triticum aestivum
TRGSPTAEAMSFDDERRTELFLKDQIPMAVAYGGYAVVASISIGTLPQIFPQLKWYYILVAYVVAPVLAFCNAYGSGLTDWSLASTYGKLAIFVFGAWAGLANGGVLVGLAACGVMMSIVSTASDLMQDFKTGYLTLASPKSMFISQVIGTSMGCVISPCVFWLFYKAFSDIGISGSEYPAPYAIVYRNMAILGVDGFNTLPENCLTLCYIFFAAAIAINLIRDLTPHKFSRFIPLPMAMAIPFYIGSYFAIDMFLGSFILFVWEKVNKAKADAFGPAVASGLICGDGIWTLPQSILALAKVNPPICMKFLTRGDNVKVDKFLGG
